United States Patent 10,113,201 (METHODS AND COMPOSITIONS FOR DIAGNOSIS OF GLIOBLASTOMA OR A SUBTYPE THEREOF) - sequence listing, part 10

SEQ ID NO: 132 - DNA, 111881 bp, Homo sapiens
ggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttctttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtttgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaaataggccaagcgtggtggctcatgcctgtaatcccagcactttgggaggccgaggtgggcggatcacttgagccattttttgtatttttttagtagagatgaggtttcaccatgttggccaggctggtctcaaactcctgacctcaagtgatccgcccacctcggcctcccaaagtgctgggattacaggcatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattagaagagatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagtatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagatataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacagtaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacgcatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagttcaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatgtctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattttggagctttttgtttttttgttttttgtttttttaaagagacaaagtcttgtttcgttagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagaatattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcccaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacggaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcagtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcaattgagatttcctcaggaggagtgcctttgatgtcatcaacataggagcatgggctaggaggctgtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcctgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgcaactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacacgacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacctggctgcccatcaagatgcattcccataaacaacagttcttatgcaaattcgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttaaacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagccgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctgggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccacttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattattgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtacttgctaatttagatttcctcatggagcacagtaaatatgagagatcctcataatagcctctataggtttaaattatattttaaatgtaaatgcaaaacttaattattttttagaggacctgatgtcatccttgggagtaatttttaattactttttatccttcttagagttgattgtattaattatttgtactggcttaacaataccatactgaaaaagcttttatttttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccgggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtaacctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacaccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaaagaaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaacaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacgcagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcagagatccatcagagggatcactatctgtggcaacaatatcctcacaaaatgctttttttaattgtatttaatttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacatgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctatgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccgtggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttagcacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgatagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaacaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccgtagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcctctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcacaccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgaatttgccatttatagtcaattatgtagactacagagacagaggccatatatatatatatatatatatagagagagagagagagagagagagagactgactacagagatgaggtctctctctacatatatatgtatgaatttgccatacatagccaattatgtagactatagagacagaggtctcagattaccaagaaaagaaaggaccaagaaaaagattgtatctttgatgtttgtaatgctgacaccaatttgccattacatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaactcacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaagaaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaatccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataa

SEQ ID NO: 133 - DNA, 56903 bp, Homo sapiens
cccctgctgctctcaagtttcccgttggcggcgcggcccgggcgcttcaggtagcctctcggctctctctgctccgctccgcgcccaggtagggcaccgacgggggctgcacgcggctggccggcttcctccctgctgaggcggccctccctcctcccgcggggccctcctggccggggatccgcagcgctgcgccctctgaacgcccggcccccgcgcctgctgcggggcgcggcctggccgggccctggccccggctggcctcagtgcccagcagccccgctccgctctgcccagcgcgtcccctttgctccagccctgcggccgtccctttcggccggcggcatggccctgtcgtccgaacccggtgagtgcgcgcgaggctgcgctgctgaccttgggccagccccgcggaccctgcggcccaggcgggaatcagcagcgccctggggtctgaaccgcggcttccgccttccctgctcgcagaggcggtggcgctgactccggtccgatcccttgccctgtcccctgttcctgtccctgtccctacccctgcctctgcggtggcccgagccccagcggcctcaggtgagcgggcagcatcccgattccctggcggcctagaatggaatcgcaaggtttagagaaattaagggacctgggacttgccaccctgggcaaagttcctaggtgcttgaggactggctggatgtggacagctgaggtggacttctacctggaggcgagggatgcactggatgatagggtgatgaggtcgtttgaggccttcatccttacctctttggctctctcccggcaagggaggtgtacagccttgggctctggcagtctgctttctgcccttgatcttctggtagctgctttgccagcagagctgctaatggctgttgtaggctggcagaggtccctggggagagttttgagaggccttggagtaggagaggcttgctaactagggtatcatttccccaaactgtatgtggctgaaagcttgatggcgacacatcagcaaaggagctgggtgaaagcaggcagcacaaggagggattttagcatggtcttgagcccctgttggctttccctcaggatgcagtgaccaacatttggccatcttcatggaaaagctgcctgcagctggaacctgcagaggagaaattctttccctggctgtgcagcactaaggccgagtgttagtggagccattgagccagacagacagagcctctgtcacttcacacctctaggagtgttgacagcaggtctggggtagttggcctggcctggctgcagcttcatggggcctggcttgctctgaggatgatggtatggggctgccctctctaggaataatgacacctgcataggtggtggctgggagactctttgacctctcagtcccatccttagctcagcctctgtcttctaaggttctcctagctctcagctaggtcaagaagctctttgagagatgaggttttttgtagttgtttttttttgcctctacactgactggatcactcttcaaatggcctcaaaatctgtctcaggtcttgaaaatgtcatgggcagataacatgtagccttcgggttaacagggagataccctttctcccctaaagctgcccattggcctccatgattcttccaccaagtataataatctcttagttcttctgtatgctggttgcatatctaggacaacagacaattgctttgggcttttgatttgtaaggaactgactggggcatgggaggatgagctcatggctggagtcctggctgtgtacagtcaccgagaagtaccattcataggggagaaggatgttcctcctcctgatctggcttcacatttaaatatgttttccttcttcctgcacccaggtaatagaaacttgggagagtgccaggcacatggtggtgctcaataaataaggttgaataaaaggattcagtgtctagataaaacttcatgttcattttcctagttcttctctctcgtatctgatatcataatgatgatgacaatgatgttggcagataatgcttataaaacacatactctatgccaggtaccagtctaaacacttcacttatgctcattgtcatggcaacctatgagattggctttttattatccacacttcatagggaataaaaccgagccacagaaaagttatttaacttgcccaaggtcatacaactaagtggtggaacaggattcaaatgcagggagtctagctggagttttttttgttgttgtttgtttgtttgaaatggagtctcactctgtcacccaggctggagtgcagtggcacaatctcagctcactgcaacctccacctcccgggttcaagcgattctcctgcctcagcttcccaagtagctgggattacaggcgcccgctaccatgccaggctaatttttgtgtttttagtagagatggggtttccccatgttggccaggctggtctcaaaactcctgacctcaagtggtctggccgcctcggcctcccaaagcgctgggattacaggcgtgagccaccacactcagcctgagtctacgtttttagccatacactctactcattcctgagattgccataggtggattgatctattataaatagctagttcacttgttcattgttttatgcattcattcattcaacaaatacttgctgaatgtcgaccatatttcaggtatggggatacaactgtgaatgagacaggcgagatttgtcatggagctggtatttagcaagtgaatcccctttgtccaactccttgtgtgagtcacacacacctcacaaatgagaagaaaaatgaacccctctatgcaagctcatgcctggcttttggggaggagagtgatatctttctttttctttttctttttttttttcttgagataaagtcttgctctgtcgccaggctggagtgcagtgcagtggtgcaatgtcagctcactgcaacttctgcctcctgggttcaagtgattcccctgcctcagcctctcaagtaggtgggactacaggtgcgcaccaccatgcccagctaattttttgtgttttagtagagatggggtttcaccacgttggctaggatggtctcaatctcctgaccttgtgatccacctgcctcgggctcccaaagtgctgggattacaggcatgagccaccatgcccggccgatatctttcttgatgagacataatttgattccgtcctctcctgtcttttagagtttgtaaggggtgcttaagtgataaaaggggatgcagtctagtctcgggcaggagaagcgggccctgtatctggttatcataaattgtcttgatgtttgttcgaaagggaaataaggctttgagcttgggatcagtgctcttcagtccacagagacatcttggctgcaagaagcagcaacaagttaggctcaaggtggaattgtgaggtcctgagaagagcttgctcttctgggacagaactgtatttttcttctaaactgcccatgttctggggagtcttcccgccttttggcttcagcaggacccttggtcattgttacaacctgtgtcatcttagtggagctgctgctggtttctgtctgaacccgatgcaatgggtctcatacctgtaaactgggctccaggaaggcagctttctctaagttggaaaatgaagactcaaggtggagggtgtttcccaaagccgataccacaagatattaataggtgtttttttcctatgacagcagttctaggatggtcaaataagtgcgtcgggttaaacaaagttaagcagctttctttactgcaggacttctcaggtgttgaatttgctagtagaaactgtgcatgaatacccataagggactacaggatgcagtgttttccaagccttctgacctttcatgttctgcagactgcactttgaaaaatgcttgtttagactaaggctagctgggatccggttaaaggtgcagaataaaattccctgaacgtgtcggacttaaatccttgggctggaatcctcccactgcagtccccactctacctcccctttccccaaaacactagcagaaaaagtcatctgcccctcctccttctggcagaatagtactaagggcttggatttttttctcatactgtaagttcatttaattgtttaatgaataaatattaccctccctctaggttgcttgtagcctgctggttgcactgtttatgaaacagctgtgaggacaggtgggccgtaatctctgggtagctaaagcccagcagcagcccgaggatcatgtgtcaaccctgtaatactgctctgtgcacacaggaattatgatgtgagctcagtaagacacaacctcacgattggacatgcggaggtgactcaggcccaagtcagggttacagctagcctcccggtaaacaactgacccatccttcctgagctcttctccccaggatttcaacagcaccacagaaatagccattttgctcatggttatttcccaggaccacaggatttgcctaagtcactgggaggctatgtgtctgttctgagccttcccactctcctaaagggcagatgaagatcagagctttgcaccctgtgatgccattttaatcaaccctgcttggttttagaggattgctcctgtgggtcacttgaggcaggctccaccttccccaggaggagtggcagagtccagccagcgctcggagctggaggcccacgtgggagcagtgagcggctgtaagcaggggagggtttggggtgggctccggtgggtcagttggggtgtactccttttctgtgtgtgtggatgggggtgggggttctggtaaagcttatcaggcttcgcagtcacctgtgatgtgggcttccttctgggaagaaaggaaggagtgggatggggctgtcagcttttcatcctagcctgcccctgtcctctgtccgcctctgtgctgaggcagttcctgctccctgagtctctgtcctttcctgggaaaggtggaagcagttcatggtctttccctttcagaggaggaggggatggaggggattgtattagcaactgggattgaagctccccctggcagttatggggtgcccttgggagggctgctttaggggggctttctgagaagaggcaggtcgggctgtacctgagaccaatccccttgataaaatgcagccaggcctgaagcacgttcagaacggaagcagcaaaggtgatgatatcgctcgttgctactcagctttcaggaggaggctgggcgttagagggaggctgtggcttatctcctgcagctgggcaggacggctgagtttactgttgtaaagaggaagccgccgctttagtttcctcttgtgagggctgtgaagagggccaggacactgcattcaggataccacagccattttgttttggataactgggattacctggggacttcagggctcttggaaattttccactcatatttcatattcacgagagaatttccagcccaggcttttcctgctctggctcactgctgctcacagatatgcaaaacagagacctcctactccagccggcagacaggacccagccagctgcacgcacgcactgactcagctgagcctcctgggtggcaggcagcacctcacccgggtgcatcacttgagtggcatcttcaggaccagtcatggagccaggctcaggtctgtgtcggggcttctgcaaggggagtctggcaagagtaggaaccagcttccttcgtataacgaggggatttcagtggcactgggcttcctttctggagggactgtggcaccatgaaaagttactgtttgttgaaactggcagtgttttagaactttctaactttgggacacttcttcaagttcatcagagcgtgttgcatgtaacagtgagataagctgtatcattggctgactgatgctggtgaattcacagctaagcctcccaagcctgctggcttcagctgacaaagggttggaagccaggcgtgaacatgcagctggagctgaagctctgcttggcatctgcagagtgagctttccttgtcaggcctggcctggcaggtgtctggagggtctgagaggagagacactctggagggacgggttggcaggtgggagctgtctgccaaggacatccagaaggcagcagatgtgggggcagctgctaaggcctgcagcaccccaagtgggttacttggtccatactaagatatggaattaattattttgttgtggttgctgttgtttcttgcttttttttttttttttttgagagaaggtcttgctctgtcacccaggctggagtacggtggtgccatcatggctcactgcagcctgcacctccaggactcgagcaattctcccaactcagccttccaaatagctgagaccacaggtgcatgccaccacacctggctgtttttttttctattttttgtagagatgaggttctgacatattgcaccaggctgatctcgaactcctggcctcaagcgatcctcttcagcctcccaaattgcttggattataggcatgagccactgcacccggtcttggaatgaattatctaccaactatttaagacactggtagtagttctgcggaagatttttatgggttctgtaaaacaaaaagggttctgtatgttaatgttactctatgatccttgattttaatgagccttatgaatgtgagttgaggggctgtggaatgcaacatctcccaataactgaccacaggacctgttttaccagcaacaggtatcaatttcttatggcatccagtttgggaaaggttgatttaagctaaagagaaaggaagatatgttatagaaagctgtgtcctgaaaagtatttttagttgattagagcaagctaaaaatgctttgtgcgctggtatgatggctcacacctataatcctagaccctgggaggccaaggcaggcggatcacttgagaccaggagttcaagaccagcctggccaacatggtgaaaccccatctctactaaaaatacaaaaattagccaggcatagtggtgtgtgcctgtggtcccagctactcgggaggctgaggtgggagaatcaccggagcctgtgaggtcgaggctgcagtaagctgtgattgtgccactgcactccagcctgggcaactgagaccctgtctctcaatcaatcaatgaataaatgcatgcttcatgagcaaacatggcaggatctggcataagagccctcagacatcaaggacttccctcccacccaaatacccattgccaagggagcctggttgggggtgtctgggtcaggcctgtgtgtgtctgagggcatgaaggaggtaggaaggtgctgctggtggtggatggcttctgtccagggtaggagctaacacagagataggtctgaatggtgaaactccctttggcctggcctctcaatagtgtgggttaggctgatcttgaactcttagcctcaagtgatccttcctcctcagcctcccaaattgcctggacaacatggcaaaacctcatctctaaaaaaaaaaaaaaaaaaaaaaattagccaggtatggtgatgctccctccctccctcccttcggcaattaaggagggagccctaattgccaaaacctgccagaaaaagaagtttgttttcctatttttctctcttttcatagagtcttaagtctactcattttctttctattctctttgtatttgttaaaaatggcattataatagcattcatcatcaaaataaaatatcctctcacacacaggcagccctgccacctggtcattttgactgcgtgaatctcttgcaggtcttgcccataaagggatgcattttcctttcactgtaaataaagcatgggtatggttctatgtattaattttttcatttactgtatttttatttttttatgtgattgcaccatcctcataatcataattctgattacttaacatctttttcaagtgagtatgctctaatttaggcattttaaagctatttatgtaaataatgcaggtaaatatccttgtgcttttcattcttaggattctttttttgaaagaaatttgtagaagtaaagttgcttagtcaaatggtatggtgctttatggcatttgcggccttttgcctgggctgttgggttgcatatcttcttctgagatgcgatgtgaggttttgggatggtgcccttgattggtggccttggaataaggggggaggtgaggatccagtttcgtttcagcctgatggagcctcctgggtctggttctttgtgctgttccagactttctctcccctgtcacctcctttgatggcctccagcttcccccctctctgctatcaagacatggaaatccccacaggcagctctgttcctcttcctttttgcagaggccaggcctcgctgtcttgatgtctgctccccagacagttgtgtgttgacaggctgttccccaccagctccctcccactcctctcatcagggagtggcaggtccttgggtctcagagttaagggagccacagacctcactctgattgcctgttgctagcctgctttcttccttcctgtctgtgtcatgacttagtcccacatgccactcagactcagagcagcaagccctcctcaggcaccggaaatctctctggtacctagaattatgccacttagagctgagagggccttagagaccacttagttcaatccctttatctcacagatgagaacattgtgaggccggagaatgactgtcccaagatggcctagtgtgttcccctcccctgtagctgcacttctccctgctggacagcagcagggctctgtctcatctccattcttgtctgtctggtccacaaaaccacttctctctttaaaccaactttaaagaaactgtggtcataggtagatgggaaactcctcttccagagctgctcccaacgagggtggcttgtcgaaaagggtgcagtattaatccattccacaagtgttatgctggggactgtgaggagcccctgcccggacacatacgtggacaaagagaagcagcacagcatggtgggtgaggggacagaggcaggaaccaggtgcctgggttcagatccctgagctgaggatcagagaggaaagggatgagagagaaaggctgagaacagcacaaatctctgctgacttattaaaagtgtgaccctgggcatgttagctctctatgccttcattttctcatctgtcaagtgggaataataagattaactgagttaataagtatgaagttctttgcagagtatatatatgtatgtatacatatataaaatatatattatatataatatatattatatataatatatattttatatatatatatatattttatttttaaaattgagacgaggtctcaccctgtctcccaggctggagtgcagtagtacgatcataactcactgcagcctcaacctccctggctcaagagatcctcctgcctcagcctccctagcagctgggattacaggcatgcatcaccatacctggctaattctttaaatcttttttagggatgaggttttgccatgttgtccaggctggtctcaaacttctgggctcaagcagtcctcttgccttgacctcccaaagtgctggtattacaggcgtgagccaccacacccggccccagagtatactttttttttttttttgaggcagagtcccactctgttacccaggttggagtgaagtggctcaatcttggctcattgcaaccttcacctcctaggtttaagcaattctcttgcctcagcctcctgagcagctgggattacaggtgcctgccaccacgcctggctaatttttttgtatttttagtagagacgtggttttgccatgttggccaggatggtctcaaactcctgacctcaggtgatctgcccgcctcagcctcccaaaatgctaggattacaggcgtgagccaatgcgcctggccagagtgtacatattaagtgctatacaagtaattgcaaaaaaggaaagaaataaggaaatgaagaaagcaagcaagcaagaatgaaacccaaccaaccaagcaggtggttgaggccagtgactgttagtaaggaatcagtatgcgaggaggtggatagagaaagcttctttgagggagtgagttttcagctgggtaaagagtgttctaaaacctttattttatttgctgtgtcttgttaggaggttccagagggtttggaactgcaatagcagattctttctcttcagcaaaaggccttgatttatgtaatgaagaatgcagctttggatttcccagggctctgctgtaatcttgtgcgaccttagctgttaaagcctctgtgaagtgggggagtgaggtttgattattgttgcagctataacagtatcctcatagtctggaggagggagagctgaactctctcttgtcccttctcaaacatgggaacaaagtcaggagggcagggctgccaggtgctgcagattccctgagtttgggaaaatggaagcccacctagttgaacagttcattctttgaattttgaacacttgctttctcctgacacctaagtggccctacatgcttcacatccagttacttattgagctaattttgaaattggcatgctgggtttggtctggggcattcctaagtagacagctgaccccaagtaccaggtgggcctggccctcacttcagtgccttctcttccccggtgctggtgactcagggcatcctgcaattcatgcttgttctttctttgctagctgagatgccgcggcagtttcccaagctgaacatctctgaagtggatgagcaagtccggctcctggcggagaaggtgtttgctaaagtgctccgagaagaggacagcaaagatgccctgtccctgttcactgtcccagaggactgccccatcgggcaaaaggaagccaaggagagggagctgcagaaggagctggcagagcagaagtctgtggagaccgcaaaaaggtttgttcccaaggcatggttttcgtgtacatagagtcatgcagacccaggcaggctgtgggtgtgtgtcctgatatgaggcacctcatggggactggtatgtccctagagctgtgttggttccttaaccaagaccacttaactcacctcttatttattgagggatgtctcggtgcctctgttgcactgaaaagatcaaaacccactttgctgctgatgtgaaaaaatacacaccatttccaaatggcatttctcttttctttttggaaatttgaggatttcttaggagacagcaattgtatttcttctcatcacttgacaagcattttgcattactaatgaacacagcttactatttgccgggtgctgtgctgggactggagatgttataatgaacaagatagatagagtccctgggtctagacaataattaagtaactggacaaattaacttaaaaattacaagttataataagtgctgtatcagtcagggtccaactagaagatcagaaaccaatgaagtattagaattttaatgcagggaattggttacacaggtggtagagagctgagaaaccaaacaggggagagagaggcggctcagagattagacacagtaaggagcagctactacccaggacaggagtgacaaggaaagcagtagtgtttctggagccaaggtggagtcgccctggggaaggtggaactgtggtggactttccagtggaaactggagccaaggggaagaggtggcagctgcagagatgcctcccaaggcagagatggaggcaggcaatacctcgtttgaccctttctgcaccttccaggttctcccagtggctgccatgggccaaacctagccagaatcctgctggcacacttgggaaacacaggagaggatgaggaatggatctgagggcaaacaggcccaggagcagcgcaagtgctatgaaagagatgaataaggatgagatggggttaggggagagaaaggccgggaaagagagagaaaaaatccttttttagactgggaagtcagggaaggcctctccaaggagatgacatcttagcggatgcttcagggtataaagaagctagctatgtggccttccagatagaagaatcagctagggcaaaggccccccagtttcttccagaaggcccatgtggttagaggtctgttaaaggaagaagtgctgtgaccagggctggaggacttgtggggcccagatcagactggccttgtgctccctgataagaagtttggattggagtctaagtgaaatgagaagccctcatcctttcacagtttatctcaccctgggctttatcagattttctgcctgcccggtaccctgcaaacatcaatagttgacatggtagacctttgagccctctccgacctagtctgtgatcacactagatactgcctcagttttaaaggcaagtcttttcctttcttggttgtgtagaagctcgcattttcttaactcgtttggaaagaagtaaaaagttgactactggtgtaaaggcaagaacagagcttcaccactcataagaccagtgctttccttccttgaaaggatggtgagcccataaaggcaggagtcactggtgccattggttaacctctgagtgccagccttgtgttggataaggtggggtggccccagccccagcagtgtgctcatccctggagggtcaagaagagtatgactgtagagaccctcattcacactccgtgggtggaacagaagggctgacttcatcaagtgaatggtctgcagggccttctgtgtgttatgaattgagcatttgagacccttaacaatgagaggaaaagaaatcctggcattttttattactaggaacaataagtttctggaaccagtttccactacagagtgacactgggcctgacatctgctgaagcgactgtgctcttctcaatgcccagactcagggcaaaatggaagctttcttactctaagtcttaatggtgctctgtggtttccagaaattcccctgcaaacttctctccaaaaactttgttctgtccttgcctaggttatggtgtcttagtttgcatctgtctgcgccatttgactagacgctccttgaggactggatccattgtggaacttagttggtgggcagtggatgtctggcagaggaagacatcctgcctccccattgccaccatggacactacatcagggtggctgcaacttcttggacctctgtgttctgccactcactgtcatgctctgtgactttggggaaattaggaaacctctctgggcctcagcctcgtcctcatctataaagtggagatgctaacagctaccttcatggggtgttgtgaggaatgagggaatccacaggtaaaaggcttcggacagtgtctggttatagtgcatcccgagtaaatataagtgatttctctgacttcctgctgctgagacagggaacaatagcagctcctgccattgaatacttactatgggctaagtactagcctgtgtaggttggattcattctttaattctcacatcgagcttatcaaatggatattcttagtattctgattttgcagattagggaacgaaggctcagagaagttgaatttactttcacaaagacacatagtgagtaaatgacagagcaagaactagagcccatatcttttgaatctagaccccacacttcaaccataaggctatcccctcttcaggtaggggtggagtcttcggttccctggtctgtagaccctggaatgacactaggtgctgctccctagaatgtaattgttgcttctaaatgaaatggagggaaactggtcaaagctcccgctctgtccatcggcttctttcctgaaaaaaagcttggtccctggactgtcagatgccccagcatcctcctctggggtctgcccatacccaattttgtcttttagtttctcttctcactagaggtgcctttatatgtaaatgttcgaaagttaacattttcatggaggacaccctctccccagctccctctttgtctgtggcacctcccatcccatctcctatttattcttactttacacagaattctataatctggctatattgtttcttatcccgtggcagatttaaagaagcaaattagaagcagggagagagacttctacaggcagggtcacagaggtgatgtgtggtgattataagcctgggctttggggtcagacctattgggttcaagtggcagccctgtcacttactactgaatggccttggtcaaagctcttgactgcctgagctggtttcctaaactgcaaaatgagaataataaaaggacataccttgtgagaattaaatgagcgaatacacaaaaaatccttagcgcagtgcttggagcaccattaatgttcctgttttgttattgttgttattagacagtcaacagtgagagaggaaacaaaataattatgaaaagcaggcacaagaatttgaagcacagtagtttagggataacacacctctgagatcataactggataatacagtgatgatcctgggtcattgagaaaactttaaattatgttcagcatgctttgaggaagaatgcaggaattatgtatttttttaagaagccagataaaaattgatttttaaaaaattaggatatagttaaggctggcaagatggccaattaggaacatctccggtctgcagctcccagtgagatcgatgcagaagggggtgatttctgcatttccaactgaggtactggttcatctcactggggctagttggacagcgggtgcagcccaaggagggtgagccaaagcaaggtgaggcgttgcctcacctgagaagcacaagggatgggggaattatcttccttacccaagggaagccttgagggactgagcctgaggaactgtgcactctggcccagatactgtgcttttcccatggtccttgcaacctgcagaccaggagactgcctctggtgcctacaccaccagggccctgggtttcaagcacaaaacagggcggccattcaggcagacactgaactagctgcaggagtttttttttttttttttttttctgtaccccagtggcgcctggagcgccagcaagacagaatcattcactcccctggaaagggggctaaagccagggagccaagtggtctggcttggcaggtcccagccccatggagcccagcaaactaagatccactggtggccaggcgcagtggctcatgcctgtaatcccagcacttagggaggccaaggcgagtggatcacctgacgtcaggagttcaagaccagcctggccaacatggtgaaacctcatctctactaaaaatacaaagattagccgggcgtggtggggggcacctgtaatcccagttacttgggaggttgaggcaggagaatcgcttgaacccaggagaaggaggttgcagtgatctgagatcgcaccattgcactgagcttgggtgacaagagcaaaactccgtctcaaagaaaaaaaaaaaagatccactggctcaaaattctcactgccagcacagcagcagtctgagatcaatctgggacactcaagcttcgtagggggagggtcgttggccattgctgaggcttgagtaggaggttttaccctcacagtgtaaacaaagccaccaggaagttcaaactaggtggaacccaccgcagctcagcaaagctgctgtggccagactgcctctctagatttcttctctctgggcagggcatctctgaaaaaaaggcagcagccccaatcagggacttatagataaaacccccatctccctgggacagagcacctgggggaaggggcagctgtgggcacagcttcagcagacataaatgtccctgcctgacagctctgaagagaccagcagtcctcccagcacagcgttcaagctctgctaagggtgagactgcctcctcaagtgggtccctaacccccgtgtatcctgactgggagacacctcccagtaggggccgacaggcatctcatacaggagagctctggctggcatcaggcaagtgcccctctgggatgaagcttccagaggaaagaacaggcagcagtctttgctgttctgcagcctccactagtgacacccagccaaacagggtctggagtggacctccagcaaactctagcagaggggtctgattgttaggaggaaatctaacaaacagaaaggaatagcacatctaatcagagaccacatccgaaaatcaccagcatcaaagaccaaagatagataaatccacgaagatggggatgtaaaccagtgcaaaaaggctgaaaattccaaaaaccagaatgcctcttctcctccaaatgatcacaactccttgccagcaagggaaaaaaactggacagagaatgagtttgaccaattgacagaagtaggcttcagaaggtgggtaataacaaacgcctctgagctaaaggaacatgttctaacccaatgcaaggaagataagaaccttgaaaaaaggatagatgaattgctaactagaaaaaccagtttagagaagaacataaatgacctgatggagcagaaaaacacagcacgagaacattgtgaagcattcacaagtatgaatagctgaatcaatcaaacggaagaaaggatatcagagattgaagaccaacttaatgaaataaaataagaagacaagataagaggaaaaaaaatgaaaaggaatgaacaaagcctccaagaaatatgggactatgtgcaaagaccaaacctacgtttgatggatgtacctgaaagtgacggggagaatcgaaacaagtggaaaacactcttcaggatattatccaggaaaacttccccaacctagcaagacaagccaacattcaaattcaggaaatacagagaacaccacaaagatattcctcgagaagagcaaccccaagacacataatcgtcagatgccccaaggttgaaatgaaggaaaaaatgttaagggcagccagagagaaaggtcaggctacccacaaagagaagcccatcagactaacagcagatctctctgcagaaaccctacaagccagaagagagtgggggccaatattcaacattcttgaagaaaagaattttcaacccagaatttcatatgcagccaaacaaagcttcataagcaaaggagaaataaaatcctttacagacaagcaaatgctgagagattttgtcaccaccaggcctgccttacaagagctcctgaaggaagcactaaacctggaagggagcaaccggtaccagccactgcaaaaacataccaaattgtaaagactatcaacacttcgaagaaactgcatcaactaatgggcaaaacaaccagctagcatcatgatgacaggatcaaattcacacgtaacaatattagccttaaatgtaaacgggctaaatgccccaattaaaacacacagactggcaaattggatgaagagtcaagacccaacagtgtgctgtattcaggagactcatctcaagtgcaaagacagacataggctcaaaataaagggatggaggaatatttaccaagcaaatggaaagaaaaaaaaaaaagcagaagttgcaagtttaacctctgataaaacagactttaaaccaacaaagatcaaaagagacaaggaagggcattacataatggtaaagggatcaatgcaacaagaagagctaactgtcctaaatatatatgcacccaacacaggagcacccagattcataaagcaagtcttagagacctacaaagagacttagactcccacacaataataatgggagactttaacaccccattgtgaatattagacagatcaacgagacaaaattaacaaggatattcaggacttgaactcagctctggaacaagctccaacccaaatcaacagaatatacattcttctcagcacctcatcacacttactttaaaattgaccacataattggaagtaaaacactcctcagcaaacgcaaaagaatggaaatcataacaaacagtctctcagaccacagtgcaatcaaattagaactcaggattaagaaactcactcaaaaccacacaactacatggaaactgaaaaatctgctcctgaatgactactgggtaaataaggaaatgaaggcagaaataaagatgttctttgaaaccagtgagaacaaagacacaacgtaccagaatctctgggacacatttaaagcagtgtgtagtgggaaatttatagcactaaatgtccacaagagaaagcaggaaagatctaaaatcaacaccctaacatcacaattaaaagagctagagaagcaagagcaaacaaattcaaaagctagcagaagacaagaaataactaagatcagagcagaaccgaaggagatagagacatgaaaaactcttcaaaaactcaatgaatccaggagctgttttttttttgaaaagatcaatgaaataaatagactgctagcaagactaacaaagagaaaaagagagaagaatcaaatagacacaataaaaaataataaacggggtatcaccactgatcccacagaaatacagactaccatcggagaatactataaacacctctatgcaaataaattagaaaatctagaagaattggataaattcctggatgcatacactctcccaagtctaaaccaggaagaagttgaatccctgaatagaccaataacaagttatgaaattgaggcagtaatgaatagcctaccaaccaaaaaaagcccagaaccagacagattcacagccaaattctaccagaggtacaaagaggagctggtaccattccttctgaaactattcccaacaatagtttggagctggtaccattccttctgaaactattccaaactcattttatgaggccagcatcatcctgatgccaaaacatggcagagacacaacagagaaaatttcaggccaatatccctgatgaacatcgatgtaaaagtcttcggccgggcgcggtggctcacgcctgtaatcccagcactttgggaggccgaggcgggcagatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagtcctcaataatatactggcaaaccaaatccagcagcacatcaaaaagcttatccaccacgatcaagttggcttcatacctgggatgcaaggctggttcaacatatgcaaatcaatcagcgtaatccatcgcataaacagaaccaatgacgaaaaccacatgattatctgaatagatgcagaaaagtccttcaatataattcaacaccccttcatgctaaaaactctcaataaattaggtattgatggaacgtatctcaaaataaaaagagctatttatgaaaaacccacaggcaatatcatactgaatgggcaaaaactggaagcattccctttgaaaactggcgcaagacaagtatgccctctctcaccactcctattcaacatagtattggaagttctggcaggggcaatcaggcaagagaaagaaataaagactattcaaacaggaaaagaggaagtcaaattgtctctgtttgtggatgacatgattgtatatttagaaaaccccaccatctcagccccaaatctccttaagctgataagcaacttcagcaaagtctcaggataaaaaatcaatgtgcaaaaatcacaagcattcctgtatactaataacagacaaacagccaaatcatgagtgaactcccattcacaattgccactaggagaataaaatagctaggaatccaacttacaagggatgtgaaggacctcttcaaggagaattacaaaccactgctcaaggaaataagaaaggacaaaaacaaatggaaaaacattccatgctcatggataggaagaatcaatatcatgaaaatggccatactgcccaaagtaatttataggttcagtgctatccccatcaagctaccattgactttcttcacagaattagaaaaaaactactttaaatttcatatggaaccaaaaaagagcctgtatagccaagacaattctaagcaagaagaacaaagctggaggcatcacgctacctgacttcaaactatactacaaggctacagtaaacaaaacagcctggtactggtaccaaaacagatatatagaccaatggaacagaacagaggcctcagaaataacaccacacatctacaatcatctgatctttgacaaacctggcacaaacaagcaatggggaaaggattccctatttaataaatggtgttgggaaaactggctagccatatgcaaaaaactgaaactggactccttacaccttatacaaaaattaactcaagatggattaaagacttaaatgtaagacctaaaccataaaaaccctagaagaaaacctaggacattcaggacataggcatgggcaaagacttcatgtataaaacatcaaaagccatggcaacaaaagccaaaattgagaaatgggatctaattaaactaaagagcttctgcacagcaaaagaaactaccatcagagtgaataggcaaccttcagaacaggagaaaattttttcaatctatccatctgacaaagggctaatgtccagaatctacaaagaacttaaacaaatttacaagaaaacaaccccatcaaaaagtgggcaaaggatatgaacagacacttctcaaaagaagacatttatgcagccaacaaacatatgaaaaaatgctcatcatcactggtcattagagaaatgcaaatgaaaaccacaatgagataccatctcacgccagttagaatggcgatcattaaaaagtcaggaaacaacagatgctggagaggatgtggagaaataggaatgcttttacactgttggtgggagtgtaaattagttcaaccattgtggaagacagtgtggctattcctcaagaatctagaactagaaataccatttgacccagcaatcccattactgggtatatacccaaaggattataaatcattctataaagacacatgcacacgtatgtttattgcagcactatccacaatagcaaagacttggaacccacccaaatgtccatcaatgatagactggataaagaaaatatggcacatatacaccatggaatactatgcagccataaaaaagatgggttcatgtcctttgcagggacatggatgaagctagaaaccatcattctcagcaaactaacacaagaagagaaaaccaaacatcgcatgttctcactcataagtaggagttgaacaatgagaacacatggacacagggaggagaacatcacacactggggcctgttggggggtgaggggctaggggagggatagcattcggagaaatacctaatgtaggtgtcaggttgatgggtgcagcaaaccaccatggcatgtgtatacctatgtaacaaacctgcacattctttacatgtaccccagaacttaaagtataattaaaaaaagaaaaaaattaggatatagagggaaaaattttattagttgaaaaatttggctatctaggacagccgcttccctagaatgttttgagtgaaattgagaaacatatgtgctttatgaattgagcatagcacagctaaagtgttgctaagtcacttcattttatgaaacttgtgaaaataagaatggggaactttttaaacattcaggatcattgacaaaggagcttcatttgaaatagtcaatctatccccttttaaagttagggagagattgggctgggcgcggtggctcacacctgtaatcccagcactttgggaggctgaggcgggtggatcacctgaagtcaggagttggagaccagcctggccaacatgtagaaaccctgtctttactaaaaatataaaggttagctgggtgtggtggcacatgtctgtaatcccagcaactccggaggctgaggcaggagaattgcttgaacctgagagtcaaaggtttcagaaagccaagatcaccccactgctctccagcctggctgagggagggagactctgtcttgaaaaagaaaaagttagggagattgggaagccgaggtgggtggatcacttgaggccaggagtttgagaccagcctggccaacatggcaaaaccctgtctgtacaaaaaatacaaaaattagctgggcatggtggtgtgcgcctatggttccagctttttggtaggctgaggcacgagaattgcttgaacccaggagctggaggttgcagtgagctgagatcgtacccctccattccagcttgggcggcagagcaagaccctgtgtcaaaaaaaagtaaaaataaaaataaagttagggagagagattgtaacacttaagttaacagatagtacagattgcacttcattttcatctccaggtctttagggaggaagggcagctgggaaggattgaggaagggagaagcgaaggtgagtggcaggagatgagtggagattacagtaggccaggaggggttgtggggaagggaggatggagaaagaaggggcaggtttccagaggagctcagggagagacagagggtggggctgtgagttttcacacctgattggctgcaaagtgttagaatcaaagttacacccacctggccaggatgctggtcatctggctgcatatgcggagtgagtgatctctgtgcgcccctgctctctctgtagggacccctgttatagtgcccatcgtgcagcatatttctccagataggctgggacctctggtctcaagtacagggaaggtgtcagcccctcttagttccctccttagatgggggtcccaattccaggtgagccaatgcaggggcagcgtgagcagcagcagtgtgagcctatggaagtggaggatgcctgtcccgcctgatggcattcagattcccagtgtttgcaaaactctgtgctggtttgtgacttctgattccaacctttattttagcgtaacaattctcatgtggaggggctgccagaatgagctgagtgtgcgtgggggaggagttcaaaccagcctccatgttctgaaatgtcccccctctgaccccattgctccactgctcccacccctagtctggattaagtgtctcctctggggtcccaaaatatccagggcatctcattacaccaaccacactgtatgataatctgtggaactgtctgggttcatctcagccatcacagtcggcccctggaggcgggagttatatcttatctactcctctacacccagggcctggcacacagtagtttattgaatgaagtggggtccacgtgtggcccccagctcatagtacacatatgagagcctggtgaaaggttggctccagtgcccctccctgcctagtagtcatctggacagaccacacagggcagtgggcttcagatggcccctggtaagatgctggctattctctaggagagcaaggtgggcctgaagggctcctcactttagcatttgagtgctatatagggaaggccctgggagcctgattccccagagcggaggagggctggggagtggagcagagtaagggaggggacttagtgactgtcaggggcaaccaagggccatagagcaggtggagcaccagacaggtgctgggaggtaagatgctgtaacaacagcccaggtgacctgatcaactctttgtcttgtgggcctggttagcaagaatgtccttgtgcgtcaagaggataaatctatttcagggatgacaaaactgctcctggccctttgagccctcaggcttggcctggagctggtgtcctcacagccccacactctgctggctccttggcaggagtgtgcttctgccaggtgcaagtgtgggtgggggaaggagggggtgtgccagctgtagcccagcaaatgctggcgccccaggggctagtgcaaggtgcagcaggtgagatagtggacagacagaccttggcccatcagaaggaagtgctttctaacaggggcaccagatcagttttgttcatacacacactcatagacacactcactcactgtattagtttgcactgctataaagaaatacctgagactggtaatttataaaataatgaggtataattggctcatagttctgcaggctgtacaggaagcatggcagcatctgcttctgaggaagcctcagggaactttgactcatggtgaaggcaaagcaggagcaggcgtcttacatggtgggagcaggagcaagaggcagcgagagtgggtaggggaaggtgctacacacttttaaatgcccagatctccatgaaaactctcactagaacagcaccaaggagatggtgctagaccattcatgaaggatccacccccatgatccaatcacctcccaccagcccctacctccaacaccggggattaacatttgacatgagatttgggcagagacatggatgcaaaccatgtcgcacaccctctgacacttacgcccacacgcccactcactcagctccaaccctctacctttactggctgggcctcggttgtatagaatggatgctagatatgggcctaggggaggtagaatttctaaaacggcccctgcagatgtccctccttaatctccagatgcagtgaataagatgagttatcactcctgtgatgatgttatggaatatggcacagttgaccttaagataggggggttattggtaggcctgatttaatcccatgagcccgtaaaaatagagagctttctgagtgtaggaggggagggcagagagattcaaagcaacagcacaatgaccactcctggttttggagatgaagggggctatgtgcagggattggagtgaggtcaataggagttgagagtgacccctggtcaaagccagcaagcagcctgggactccagccttgtgggcactagacctgaattctgccaacaaccggaatgaacttggaagtgaattccttcccagaaactccagacaagagtacagtgtggctaacatcttgattttggcctcttgataccctgagcatagagcccagccaagcccacccagacttctcacctatagaactgtgagctaataaatagctgttgttttaagccatcaagtttgtggcaatttgttctgcagcaatagaaaacaaatccagggtcatccttgggctccatatagcttttccaatttcctgagatacaagctgtggttaacttccagttcttccaagctcaaggggagtgagccctgaggagttagcctatctgtggttaaacctatcccttgtgcctacagagtctgagctcctggcccgcagatgctcatatgtgacaatctggagctcaactgaagaccaaggttgtcgccataatggatatccccaggaaggagaattctttgggcaccagtttgtgggtactagcttcctcactggggcagaagaacattcctaggacaagcctggtaggctgttggcttaggcagcctcccagcatttgggctgtagtgtttttttttttgtgtgtgtgtgtgtggtttttttttaaactttcttagctgttgctcaccttagatgtcacctgttgcttcttgttggtaggaccagacctcaggcagccttggctgaggcatttggaggtgaggttgcatggaaataaaaacagtgagctggaaggcatgtgtgagtgacacagaaaccagaatctcatgcgtcccagctgaggtcagaatgtgttggggagcccaaagtaatggctcttcctctgggtgtgggcattcaaaagatgccaaagggagaacctcatcctcaaggtgaatccgcctctgaggagtgactgacaaggtggcatccctggggcaggatgcttggctgagctccatttgatggaggacagaccagagaaagctgaggctgggggctcccagggctcaggttgagtttcccgaagcagtccagtgcatcacttagcaggaccaggggcaaggggaaggtaaattcctgaaaaggagccacctctgtcttgcaggttaaaatagccttgtcccaaagatgtgataacacagggtaggcaggtgagaaccagagggccatggcaagcactgggtgtgtaaacacgggaggagaactgtggttcttgaaaactcggcagtgaggatacctggccacaggccaagaggaagagagctgcttctgggtaagccctgaaacttatttggggatcaactgatttcttcaggcctgtaggtatcacactagtacctggagaggaggagggctctagtgggtcacagttgtcactgagtccttgctggtggctgtggttgtggtagaataaatactcaggaagctactgggcccatggcacaaggtagggcaggtggtcagttggtttctggcatttgacactgtgggatggcaccgtggggaggccgggttccactgggggcagacagaaacatgaggtaggagaagagtgctgatggcctcaccttaatgctgggtaatttttctgcagaagagacttgcagtgacataatctgatgtctgtttcatgaatgaggaaggtagagtcatcacaaatcagccttgcaaataagcatgggcttgtggcattttaaaccaaccttgggcccaagagccagtgtaatcatcttttggtgccaaggcaacaggtccagagggacctgaatttggtgccgatcaatccctctccccaaacagaggtacatatctgtgcctgctctagcagcggcagtcaggatggtacacggcgggctagaggagggagcagcagggctggaggctgggtggagcagccactgtgccatgggccgtgtgactttgtgccagccctttcccatctctgggaaagtgtctgtgagaagtaggctgatcttgcagatctccttggcacccagtaggtctgctgccagccatggggcctatgatgcctgtaagcttggatggcggtcgctagtccacggtcctgagcactgtctcgactcctttgtaaaacaaggagattggattcattgagcatccctctctcttctggctccaatgccccaaatgtctaactgtgtgaaatgcagtgtgattgtctctctgtgaccctattcctggtcctttctgagaccgttcatatgttgggactgagagtttgtgttatctgaagccagcatgctgtccacactgtggggaaagcctgcatgatttgctattgtcctcccctctagtgccctgtggttttagagcccctgccatgtggtctgccatttgtctctctgtctcctagggcatttgcctgctttaatcttctgtgggctgtgcaaacagccctgagcagtgcatggtgaccacaggtaggggtgtctggagggccgtgttctatctcaggcagacatgtgtaagaggaaggcatgaataattagaaacttcttaatggtagggccagcaccagtgattaatcatagcaaaattctcctgccacgcacacagcaaagagtctttatcactcaccccaattagcttctgatgtctcccacttttccttgtccttggctcttagaaagaaaagtttcaagatgattcggtcccagtccctgtctctgcaaatgccgccacagcaagattggaagggccccccggcagccagtccggccatgtctcccacaacccctgtggtcactggagccacttccctgcccacgccagcaccctatgccatgcctgagttccagcgggtcaccatcagcggagattactgtgccggggtaaggcgtctgtgagagtgttgaatgtgccttgcatgcaaaggccaggggccccatgggccacagggtcgtgcctccctctggagcctggccctgtccgtggatgtctgggagaaggtgaagaggaggcacaggagacaaggagggccctagcagaggttgtggggtgtgggtgtggtgtctcggtggctgcctgttccccgtgaggagggtcccggggtgcaggctggcacactgtgtctgtgactcgtaagttccacatgttctctaagtccagaaagctggaattggtccctgtagcctgttgagaaaggtgccagcttgggcctttcagtgttgccaaatgtttagtagattcaaagccatggtactgagtggtttgtgtgaaattagttgttgctaaatcatctcttcttatatgtaggttcaatacccttaaatataggctagatcccttcaaccaggaagagagaatcttgtttagaaattgagcaaattggtttacactaagtcaattaacgcagtcactgaaaatgtgctaatttcacctgattggatgatgcattttttatgcatgtctgcttcttggagagaaatatcactgagttagtgccagggttaagtttggctccatctccctggccccaactcactacttaacgcctcagttggcttcattagtctctttttaacagtagctgtagaaaatatggtgaatctgagaaagcaatgcagcttattgctcttcctataaaatttcccctagctttcaaaaatttttttggttatgtgtaatggagaacacttgcagatggtacaaaatttaaaagatacaaaaatggtatcaattattcagccacccattctcctcctcagaggcaaccactggttttagtttcttatgtattctcacatatatggtctatgtacctacaattatttatgcatacatagtttatttacttatttttacaaaaatggtagtttacaatatacattatactgcatcttgcattttccacttaacaatacatcttaaagataatgccatatcaatatataaagaacttctttgtccttttaaaaaatatgtacatagtattcctttatgaggatatatcatagcttattttaattaagttcccatggatgggagtttaggttgggttggaaacaatgcaggccttgtctggagatcagcatcctgaccatgagtctttggtgttcacccaacctgaggcaggtgggcagggcattggaaagcaagagtcgaggtgggtcggccaccagctgaatgggaggatgtcagcctgtagcatataatagcttctttctcccagtctcctggctggcacagagtagtgcatggagcacctgaactgggcaactggtcctcagaaagctaagtgtctgtgagaggcaggctgatcttgcagatctccttggcacgcagtaggtctgctgtcagccatggggcctgtgatgcctgtaagcttggccggtggccacgggtccacaggggtcctgagcatcctctctgatgtccttagccatggcatgagccccttgtcatgctgagtccattggttccccagagaaagaatttggcttcgttgttggcagggacatatttttgtctaggatgtcggtgtctgctcacctattcctgccgctctcagaagccatccactggaagatgtaaaaggaattaacataccttatggggacatttggaggcaggaaaggagaatctaccatcgtaacaaaaagtcttgctttttgtatttagtatttactaaatactacttcttagtagtatttagtaaaagtataaaaacatgcataggaaaaatatattcagacttcttccctctgaggatggggtagggaggagagtagagttttagctgtatctgtgatgatttatttctttaaacctgtgagaaatttgaaagaattatgctaaatattattgtcagctctagaaggtaggttatattatctttggtgcctgtctgtatgtttaaaatattacaaaattaaaaatgatgattttattaaagcagaggagatcactttcaggccccagccctccccactctgggctatgccagcatatggtgcctccctctgctgttccccttaccctgcattgtgtctgtctggccacttgtctccccaagcatatttctgcgattcccatccttcccaaacagactaagattaatgagcctgttggaaggcgggaatttatctcattcatctttgaatatgaggctgctctggtaaagcagaacatccttagactttgggactcaatcaggttagagtctgaaatttgactctgtagcttcctggcaagtgatttatcctctctgggcctcagttttcccatttgcaaaatgggttgctgtaaggagcaaaatgaaatctatggaaaggtctggcacataacacatgacaatggggcttgttgcctggatgagttgggtgattaacagagttaatcagaagtgtggggttggcaaagaagcaggctgagcatgcagaatttgcttttgcttcttgttttgtttcgccatctgaaggacacatgaattttctcaactgaaaatgacggtgctcatcgccttcagggataggactcaggctttgtccctccatgggcctggtacaaaaacagacttttggcttaattagctgcatgtgaggccggcttctgggtgtgcaggctggagcacttgtctgtcttccaacgaccctaactcctcctgtgtctcctgtgttgggggtctccaagaccactccaggttggatgattcaccaggaggactcacaggactcagcatatagctgtacttacagctttgatttattacagtgaaaggatacagagcaaatcagcaaagggagcgatacatggaggatacgaggtgcaagcttccaaggtcctctcccagcagagtcatcagaacataccaaatacctccagcatcacattgtgacagcacatgtgggaagtgttgtttaccagggaagctcattagagattcggtgcccagggttttcactggggctggtcacatgtctgcatagcacatctcaaattccaggctccagaaggaaagcaggtgtccaacataaaccatattgtttgtacaagtagtttaggtgcaatgaaccactcttattggtcaaggagtggtgagaaccctcctgaaatctaggttcccagataccaggcaagggccaatcttgcaagcacatctttccaaggatggcagtctcaggcctgctgcatgaaccctttcctgcctgcctcccttctgcagatcactttggaggactatgagcaggcagccaagagtctggccaaggccctaatgatccgggagaagtatgcgcggctcgcctaccaccgcttcccgcggatcacatcccagtacctgggtcatccgcgggcggatactgcacctccggaagagggccttccaggtatggagctctggctggaggttgggtcccaagtgtgggcagaccgagagctagtcagggcttttttctggctcggtctatttcccctgatagtattttaaaatgacaatgttctttcattggcttctcccacactgatgtttgatggttcccccaaggattgattctatgtgtactgtatgcctagcctgtgcagagctgaactgttgaagtcaagacagagatgtgaaagacagtccttgttcttgggagtccaccagggagacagggagtctcatgtgggaattttttttttctttttttttgagatgggtcttgctctgttgctcaggctggcatgcagtggtgcaatcatggctcactgcagcctcaatctcctgggctcaagcaatcctaccacctcagcctctcaagtagctgggatcaaaggcacacaccgccacacccagctaattaaaaaaatatatattattatgttttgtagagatgggggtcttaccatgttgcccaggctggtcttaaactcctgggctcaagtgatcctcctgccttggcctcccaaagtgctgggattatagatgtgagtcactgcgcctggcctcatgtggcatatttaaaagaacacaatcacacagtaaatgccaaattggtggtagggtggatcggggtgggagtaggaacagagggcatgttccctgggaagacatgtaggctctggtgtcaaacacacctgcatttgtatctgggctctgtcaatttcttgggattttgggaaagatatttctctaagcctcactttgtaaaatgtaatctgtaaatggaaatgcaaataatacctatctcccagggctgtcgtgaggattaaacaggagaatgcatgtgaagtacttagttcagttctggcatctagtgagtgttcaataaatggtagctacatttatgctgccgagttcagggaaggggaggtcggagagggctaggtggtttcctcatgaagccttgccatgaagaacctaggagcagtagaggcagtgatgaggacagtaggaaaccccactcctgaaagttggtggtgggggacacataagggcctggtggtctccatcaatgcctgggaccctggctgcctctgggggtagctggtggtgccaagttgccccagtctctggcttccttgaatttcaagtcctgtactttgagcatctggggccctaggtaaatctcagccctttgggcctatttccctatctgagggaagtgggtcctaccaccccagttttggcaaagacagacagaaatgactgtcaaatgtgtactttacatggacagaggacccctgggttctgggcatgagtatggggaagaggagcaacttccgaacatgcaggctgtagcttcacccgggccttgaactgcctgcatctcacagaccactgcattgcattagggcctcctgagctggcctgtggccgtgcctgatggggcattcccctctccagctctgcctgcatcagcccctctgtggctcctcacatgtgctctagggatggtctgttccttccaagcacagatggaggatgcccaggcaggtcactctgccttggcagcttcctttgatgcagatcttgaggtttgctcctgcctatgctggcagctggacagctgatcctggatggtgctggctgagctgcatggagttgaagcctccagctctactgatatttagcatcaatacactccttggccagggacagagtttatcaagagtcaggaaaactaattatgagaataataagaataatatcctataattcattatttgtagtgcattactgtttatgaagaattttcctatacacactattgcaaccctcacagcagcgtgttaaggcagggggtgttatcttcagaggagataggctcagagaggtaaaggagtttgctgaaagtctcacagcagggaaattgcatagaggagttttctacctcctgttggctaattctaaccttaacctatagtggttgggggcagatggctttatcattggcattctctgctctgggggagacaagttccctatcctttgctcctttggggagggagtggcttctttatctagcccctcacctggcctgggctcgggacagttattcccactgggcagtccaggtgcaatctgtttttttcctgggagaagacaccgctgctctttttaatattcctggaatctctgaagtgccgaggaaaatgaagcccatttcagttaaattttaaaaaattgttgaagtgctagccatgtgccagggactgttctagacactcagcagtgaacagcacaaattaaagtctctgcctgcatggagtttctattggagtggagaagacatcatatctgagataaagaagtgacatggtttgacatggtggtaagtgctgacgagacaaaaggaagcagggaagagcatatgagatgcggggccggcgcagggttggattttgggcaggaaggccagcgcaggcctccgtgtcttttgagcccatgtgtgctcacaaggtcaggggcactttgccatccctcaatcctgttttgcagacttccaccctcctccactgccccaggaagacccctactgcctggatgatgcaccccccaacctggattacttggtccacatgcaggggggcatcctctttgtgtatgataacaagaagatgctggagcaccaggagccgcacagcctaccctaccccgacctggagacctacacggtggacatgagccacatcctggctctcatcaccgatggccccacgtaagctagcttctccgcggctgcctgtctttgcacaggtgctgttctgtaggaaggagatgagaaaggcctcacccctctgccctggggtcccctgtacttaaagcatcccagaaagagcgcggtttctcctttcctcagtgctttgcgggtttctgcaacagttttccttcataagctggcatagcctttgacttggtactccctgtcccctcttttgtttttgaggcaccatcttgctctgttgcccaggctggggtgcagtggtgcgatcttggttcactgcaacctctgcctcctgggttgaagtgattctcttgcctcagcgtcctgagtagctgggactacaggcacgtgccaccatggctaattttttatatttttagtagagacaggggttttgccatgttgcctaggctggtctcaaactccagagctcaggtagtgcacccaactcagcctcccaaagtgctgagattacaagtgtaagccactgtgaccggcctccctgtcccttctgcgtgcatagtgtggagcctctgcttgctggtagctacctgggtgcctctgaatggctgtcatccctctccccaggcaggacagcagccttgcagagagttaccagcccagagcataactatttggtgaggagtgatgaagacattgcttcaggccttgagttttctgggtttctggaggggagcatgcagggagcctggggaactttgctcatgggcatggtgcaccatgatgctcgtgggcttggctccagctaacctggtgggcagccatctttctgaatttggcccctcacttcttggtgggcacttaggctgatcagtaatacctggactctgtgagcctcagagtggctgtgctgggagtgggagtctgggtgagaggaggtgctagtcactcctgaggaccttctctcttgttttctgggaatcttgtgatgccagtctcgaaagtagcatagtgagcccaatgtggatgggcagcatgattcttagtcctccctgatctgagggcagaactaaggcatgggaagggcaggggcggttcctcagaggctgtcctcagccaggtgtgcaagtagtggctgtcccatctgggaggctgtgaggatcctgcctagggagagagactgagtgagatggcctttaaactcccttccgactctgaggctgtcctgtgctccgtccactctggggcttgtctgggcagatggatgactgtgctgttgcagtgccggcagatgctcttatggaagtctacgtgattagatgccaaggaagctgctgtttgttttgggggcctgaggaagcagggtagcgtgaattgtggtcgaaggttccatgcggctgtggatgcaggtgtgtggctaggcacctaggctgtgtgtgggctggcagttggccacagcagtgagcacccccatccccaaaggcctttgctggctgataaatcatgggccccttctctgagttggtgggaatctgggggcatcagtccttacagagatttctgtctcggtaacaaatatccctacagtcccaatccacccatgatgcaaaatatcctcctcttgtcgtgaagcctcagagttgagagatccttgggccgtggccattaggtcagggggctggttcctctgcaacccaaggtgggcaggtcatgccttatagtttgactgtgttatcaatcctctgggcaacaaactccttcttcaaggaatgacaagtggctgaggatagaaaagaggaaggaaaggaggagatgaaggagggagacttccactgagcatccactctgcttggactcaggccctttcccaggcataaaccagtttaacccttacttcagccttgggtgttaccacctgatatttactcatgggaaatggaggcttgcggttaattccctaaacacataaacaagaagtcaaaacacctgtatgaggtcccagagctggcctgctactgccccatctcctgactctccactgactttatagagtctgtggatatgactcaacagttcagcagggtctgtagaaagccagaacctcctcattccgccctgctccgtcctgacccttccagccagggttggcccctgcagatgctggaggcctccaaactggagagctcgatgcgactcaactatggtctctccccatctccaacttgcaggaaaacctattgtcaccggcgactgaactttctggaatccaagttcagccttcatgagatgttaaacgaaatgtccgagttcaaagagttgaagagtaacccccaccgggacttctataacgtgagaaaggtgcgttaggggcgagtgttcacagctgcctcacccggtccccctcccagcccatgggatgccctgagccagtctgaggcttgtcccctgtgagaacttcagggctccttgctaagggcggccttcgtggccagaggggtatgaagcatatgtgcagaaggaagatgggtgagctgcatttgtgtcaggctgggcctcagacagcacttgaatcactctaggtggaaacatttgtccgcattgtatatctgttgggatgtgccctcttccttggaaaatagggcacagcctattaattggtcataaaagttgagcacagcctacttttaaggtaggggatgtattagagtcatcaaagaaagacacagctgttaagatctctttggtcccctccttgtgtccatgtgttctcattgttcagctcccttataagtgagaacatgcggtgtttggttttctcttcctgtgttagtttgctgaggatgatggcttccagctgggcttaatacctaggtgacgggttgataggtgcagcaaaccaccatggcacacgtttacctatgtaacaaacctgcacatcctgcacatgtatcctggaacttaaagcaaaataaataagtgaataaaataaaatttaaattccctgaaaaaaaaaaaagatctctctggagatgggagtttgtggttttgcatccttcgggatcatgtggatttaaagaaaagcctctgatatgctcagatctctgcctctcttctcccaccaaggggatggcagccttgtccggggctcctggcagtctccgcctgcaggggccgcaactgcggtaggagcgaaggttaaatgatcatggccctagcctttccattctcttttgctgaagcgctgtgcagtgaggcacagggtcagtgctaggcagggggtgtttgatggtgagcaagagtcacttcctgtcaaccaggtggctttgagggagaggccagaactgagctgacttagagtgagtaggagcttgccaggcagagggtgtggtaggggaatggaagtggtggcattccaggtagaggcacgtgatgtgcaaatgtcaggagggagggatggtatgagagagtcgagagagtcagaacagtgtgttgacataactgcaagcagtgtggtgtggttggagctcaggcattgggagcggggagcagcgggttgtggggagagtaaggctgcagagatgtggggaggtcctggatcatgcaggggctgtgggtttcccacagaaggcagggaggtgggccggggtgtggtggcgagctgggagagaagctcctgggggaagagtcgggatcaggctttgcttggaggagggatggctaaagctgggtggagtcacagtggggttgccatctccacaggagctctgtcccagctgggaacctcttggggacttcttctttttggggtcagctttgataagggagggtaggccaggggaggatgtggctcctctgggaaagcccagctccagcctccctgaccccctggctgggagcatatcagcaatgcagatggaagaccctacctggaggccctaagaccacttctgttacacgccaggggtccaacacagactcccacttggatgggatcaagagctttaagaagtgagagtttggcttcagctcatgtgccctgagaggcttacagaagtgttttggggatttccaggcagaagtgaaaggtgttttagacaccacttacgtgggcaccctggcattttcaccttcaagcaccatttgttccttctctgtgaggcttaggcgttcagacaggtggatgcctccatcactgtgtgaactcctctcagccctgcccaaagaacttcacacgcctagcacatgcccaggcccgtgttcaaagaaacgccttgcccagcccgatgcagccctgccctgagcatacgtgaatgctctgggcttacctgcttcctgctgcctggggccaaggtgtcctcactggctgtgctggcactgacactgttttcttctaaggtggggccccagtgggtgttcctgggtctaccagctgccctctggccacaacatgagaaacagtcctggcgtggggctagggtaacaaatcagagcctatccccagggttctcctgcagtcttggggttaatgttttctctggacagagatgaccttgatatctatgacccagtggcctgttcttaggcaccacagtcagtccataaacatgggcgcaggtctgctatgagtcaggtctgtgcccgcccctgggtgctgcctacttgatagcactctgtctctcttttttttttttgagatgaagttttgctcttgttgcccaggctggagtgcagtggtacaatctcagctcactgcaacctcagcctcctgggttcaagtgattctcctgcctcagcctcccgagtagctgggattataggtgcctggcaccactcctggctaatttttgtatttttagtagagatggggttttgccatattgcccaggctggccccgaactctcagcctcaggtgatctgcctgccttggcctcccaaagtgctgagattacaggcgtgggtcaccacacctggccttgatagcactctcatagcctctactatggggaggagagctgctttctaaaatccagaatgggctggatgatggcctccgtatgtctaaagtggctattggtgtccctggggcagacaagggctgtggtctgaggcaggagctgcgacgtggccgtggatctgtgtgggtggtatctgtgaaggcacctgtcacactacagcaggtgaagggctgagacaccccgaggcccagccagcaggactgtgtgactgagacacttgttttctatgcagaagcaagacagaagagctgagtgtgtttgctgcttgggaattgggtagaagtaggtgacatccactgtggtttaagtgtcatattaagaatagcaaataggttttaccttctgtgccaaacctgaccaattaggggccacccctaaagcttagtgaaaagagtgctgtgttcgattattgatgcctgccatgggtatggaaatggtcaatgttggcttaggtcccaggtctggaaactctgctctttctttacatctgaggtcttaggtgaacacggggaatgcacttggatcctctggtgaactgaaaacactgacctccaatgaccttcaattattttgttcctaaaataatcacccttgagttctgaagtttggatggggtgcttcctggattgtccagttgttttcctcatttatcttgtgactcatgggggtaaggacaggctgacccccctgtggtgtgtcattggtaagccagaggacaggaccagaaagcccagaatccgctgagtcatgctgaggtcattgtaccaagctgtgtccagctgagctgagccaggctgaccttcttttgtgcatcccacgtgagcccagcctcatctctgaggagcctgggctttggggatgttttagttttctgctttgctttgtttccccagtgtccagtggtctgtctttctggtaagaatggcaagattaatggcaggaaggatgctgatgagtgagtgctgtggctaacgacatgggctggctggcataatgctcacagaggtccagtggatcaaatatctggtttggcattacttggagatgctcagccagccgtggacagcattccctgccctgaggtcagccgcctcctcaccccagcccgggctgagcgcccagtcggccgcagcagtagctccagagtgtggtctaatggctgtcagcagcctggccttgaggctgctgtcgtcctcccccggagctcccataggtcccttgtgctcagggagggggagtcagtttacccatagtgacttgaggccatccctcagcttagctggggcttcatttccttagggcttgtggttgtcctatgagtgaagcacagtgaaaaggcagactggggatgaggggttggggagatgggtaggatccaggcaatattagcagagccctcatcctaagattaatgaagagggttcagtaacagaatcaaattacatttaaagaatcccttctagcttctgtgtatggagaatgaattgaaccagagcacaagaaaaaggaacaagaccagttaggaggtcactgtgaattcaggcctgagaacatgcaggcttgaactcccgtggtggcagtgaggttggagaatattgtatggatttgacatccatttggaaggtagaactgatgagactcactgagggaagggagtagtaggaaggccaaggatgactcccagtttttcagcatgaccagctggattcaggacacaccatttcctgggattccagaatctgggagaaaatcaggtttgggctggggtcagagatggagagtccacttttggatatattaaatttgaactgcctttgggttatccagatagagatatcaagaaggcaatagtatgtacagttctggagcttttggctggtggcataaatttgggaattggtataaggaaaataattaaatgcacagaaatggaacagatcacctttggagagaatttatagtgagaggacaagagggcccaggaccaggcatcaagaaattccattattaagaggtctggtagtgaggatgagctgactaaggaggctgaaaaggagaggacagagatgcaaggggtcggtctggtatcacaggacttagcatgatatagagggcatgagaaatcccatgaggtgttttgagaccttgctgggctccttctgcaaaggtgccttctgcaaaaaactgcctttccctggaatgtggggagaagtctaagctgactgttcatttctgcttcttaggatttgctctaagatctttggccttgggccccacagcttgagtccatatgttggcttagggtcagtagagcggcttccagtagagtggcttcttcttgggacttggatgccctggagtttgggtgaggtgtaactagtcaaggaagggtgtgtttggaggcttggcctttagtgtctgttcttttcattcattcccacttggaggtttgctttgggaatgctctgagggttctgagagggatcaatgggaagagtgggatttgatgggccctcagggttatcactaaaactgtgagaacctgtcgtacctgttaatttgttcattcattcatccattggttcgactttgtactaggctctggggtaggtgctgaagacttagaggcatcaaacatggcccttgtccttgaggagctcccagtctagtgaaagcgtagacacacaaacgttagagtgatcgggacggtctgcacaacaatgggatgcctgtgccaggttttgaggttgggcaagggaaagagcattcagttgtgcttggaggaacaaggttggctcccaaatggaggaggttgtgggaaatttctaggtggatgagatggtggagagaaaggagggcattccagactgaagaaacacgtgggcaaagggatgcagtgtactgtaccttggtgtgtggtgtacccgtaagtggtttgtcacggctgcagcacagaatggggcagtggcaaggcgagagttaaggcttgaaataagccttgaatctcaggccaaggtgcttgggctttatcttgagactgatgggcccataggtcatttgttaactggggaatggcctgatccaatctgcattttaaaaagatttcctggtgctgtaaggaggtggaatgcgcagcaaggctgaaagggagggataccagttccgaagtctggaggagaaatggggggtgggatccagacactggtggggctgcccggatggcccatgaggtgctggggttctgtgcacattgagggttggatgtcttaactcttgttgctaggggaggtggcctgactcagggcctggtgggcgctgtgttccaggtggacacacacatccatgcggccgcctgcatgaaccaaaagcatctgctgcgcttcatcaagcacacataccagacggagcctgacaggactgtggcagagaagcggggccggaagatcaccctgcggcaggtgtttgacggcctgcacatggacccctacgacctcactgtggactcactggatgtccacgcggtgagtgagcttctgctccagtgccgccagcagacagcagccctggctggggactcagccccctggaaagccaccatgattgtgcttgccgggaggtgctacggaagcagctttctcttctatctgactgagaggtcatgcggcctcagagaataacaggtctggggcagccatgggacagggaaagagggtgtgtggcttggggcctgacaggtctaagcactaatcccactcctgccacttaggagttttgtgcccttaggcaactcacagaagcctttatttccttgcctataaaatggtgacagccatgtgccttattaacttaaaaaaatattaaaacactaaatgatggtgtaactgctatggaaaacagtatggtagttcctaaaaaagttaagtatagaattacctatgcctcagcaattcatttctaggtatatacccaaaagaactgaaagcaggaacttgaacagatactcacataccaatgttcatagcagtattattcatagcagccaacagatagaaacagccggtgttcatcaacagatgaatgggtaaacaaaatgtggtatatccatacaacggaatatcattcagccataaaagggagtcaagtactgtacatgcaacaaccatgaatggatttttcaaaagattatactaaatcgaagccagacacaaaaggacaaatatcatatgattccactgatataaggtccctagaataggcaaattcatagaaacagaaaggagagtagaagctaccaggggctggggagaggaaggtatgggaagttagtgtttagtgggtatagagtttgtttgggatgataaaaaagttctggaaatggttagtggtgatggttgcacaacaatgtcaatgtacttaaagccactggaactgtatggttaaaaatggttgaaatggtaaacgttgtgttgtacatgctttattagaacaaaaaaaacttttgttaaacaaaacattgaatgatataatgtggagaaagtgctttacaaaatgtgagtagtgatagggaatgttctattattcagtggtgcagcctctctgctcactaagtcagccatgtcctgagccgagctgtggtaacttgcaggtggggcctctgctgttccttcacagggggccttgccaaaggatcccaagctgaccgagtgaggatccatggtcctggtgctcaggagtttctaaggtttcatgcaagaattgacatagaagatgtctttcggtgtggccatacagaaggccgcctcgtaaaggtctagagaggggaacgtgcatggtggctgcagaacgatgcgttgattggtgtggtctcccccctcagggccggcagacattccaccgctttgacaagttcaactccaaatacaaccctgtgggggccagtgagctgcgtgacctgtatttgaaaactgaaaactatctgggaggagagtactttgctcggatggtcaaggtgagtgaaccctcagtctctctgaggcctctcaggtgcctcccaacatctgccttcagagagtgggggccctgtgtgcccctggccccttcccctccctctgtgtaccatcagctcagggaagggtgaggtgcccaggtgcccagtgctgtggtctggctgcctgctccaggcagtgctgcatgtgccaactgcaggaaagaggagggaagggtatccaccttggccaagctcacagcacctggcctggctttcgtgtctctgcagcctgaacctagctgggtgcagatgagctccgtgtggagatgcttctgctgtggcctggttctgcagacccaaggccttcctcaccagagggggcctctcctaaagtggaacaagagcttacaggagcaggcagccctggggatttagatgagtgcttccagcctgggagcaaggtggctgggggagcaacaggaccctgctggtgacggagagtgagagtctcccatgtagctgggatgcactggggctgacccaagctcttcttgtgccaggaggttgcccgggagctggaggagagcaagtaccagtactcagagccacggctctccatctacggccgcagtcctgaggagtggcccaacctggcctactggttcatccagcacaaggtctactctcccaacatgcgctggatcatccaggtgccccggatttagtaagtgaggtggcccgctgtctaccctgtgccctacagaggtgacaatctgtccctcatgggctgctgagtctgcactcctgaggggtagggcctgttctggtgccagcttacgcttgtcctttccagggatttttccatagaaggagtgatgaaaaagatgtctgcatgacactagagctcttttttttttttttttttgagacagagtctcactctgtcacccaggctctgagtgcagtggcatgatcttggctcactgcaacctccacctccctgattcaagcaattctttgcctcagcctcccgagtagctgggattacaggcacccgccaccacgtctggccaatttttatatttttagtagagatggggtttcaccatcttggccaggctggtcttgaactcctgacctcgtgatccacctgcctcagcctcccaaaatgctgggattacaggtgtgagccactgcatccagctgacactagaactcttgatctttgaaaaatatagatgtgcaaaggccttgggggaactactacccccgccttcttctcattgtgggttgaggatggattgtccttttggtgagccccagggtatggggagagctgtagtggtctacattgctggcctctccctggatgtcactcagacggctgctgtcctctccaggcggctggccagggtggagcccatggctccaggatgggctggggtatgtggtttagggaaacagagctgagtaacagaatgtttgggtcactgggaatttgaggattcatatctcagtctcttggtcagccagaatgccaccatcccattcctagtggcttctggcttgagaaagtgctctgatgggcatgggtaggtgtggagcttgcaaaccaaggcagaatattgcagacattgctgggagaggaggacagaggagggatctgttttctggtcccatctgacttgattctgggtgtttgatggggacacagggtgcctgaggaagtgactggggctggtctctgacagggcagcaggctgttggatccacctgacaagcgagtctttgctgtcccccagtgacatatttaggtcaaagaagctgctgccaaactttgggaagatgctggagaacatcttcctgccccttttcaaggccactatcaacccccaagatcatcgagagcttcacctcttccttaaatatgtaagtgtgggtggtgccctaggcagggctcatagcggcagaggcaggaatggattcgctgtgagctgggtcaggcttgctcctgcccttcacgatggtatcttaggtcctgccacctgtgttccaggcgtggggtcaccagccccaagaagctagatttctaaaaagtccccttctcctcaggggcagctctgggagtcagtgggtgtggggggatgggggtggtggtcttggggtaggcctttcccccagcagggaaggcaacagtgggcaaagactgggaactcggttcctgccaggtggggctggaaaggctggatctagcccccggcagcaccaagcagcagcctcaggtttttttttcggaaatgcaaacacttcaattcacctgctttacctcgcaacagaggccctcacaccatgtgtgattaagtacaagcccctaaagtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgagggctggggcacggggaaagaattgagtctgtgtgcccagaaagtgactggacaagctgagggacatcatcaaatttatgttttagacaaacatattctggctgttgtgtggagttggcccagaagagaaggtagctggaggtgggggcaggggtgagagtcaggggcctgcctggagacaggaggggagcttgacccagcggaaatagctcacactcgtgcgtgcttctgcctggcctggtcagacgccacaacgtgatctcacctaagcctcacaattaccccgttactatcaccattttgttgttaacagtaagcggaattattatgtgcttggtgcgtgttggacacggtgttgagtgctctccctggattatctcatttaatcctcaccaaagccctgtgaagctgctagcttcaattgacacacaaggaaattaaaacagatcataaagctaaaagtggcagagctggaatgcgtttccaggcaggctgactccagcgatgtaccctgaacccctattctatgttgcctcccaagtgagaatagtaaggtgcacagcagctaccagcttgcgtctctgaggtgtggcagcgcagggactctgcacaaagtgtggggcttggtgagaagcggtgggcgtacacctggcaggacctggacagagactgaaggaggcactggggggagtctaggatgcctcccaggtgcctggctttgcaggagcatggatgatgtgctgtccgaaggttgctgccagcaatggaggaagagcaggtatggggaggaggaggaagagcaggaggaggagacaacgcattttgcacccgaggctgtgggagatgcagtggtgaggccctgcttcagctggatagagctctgaagaggggctgaaattatccgcatgccaggccccagaaagttcgggtgaagtatggagctagtgagcacagagcagagctcaaggtcctccctggccccccaaacccgtctagggagtgcttagggtcatagcagggaccctgtcatttcctttgacacacagggctctgtgacacggaagattctggccaagctgccttgctcctctgggcctttgctgcccccataggaacaggagaggccagcagacctggctggggtctggggcgtgggctgggagccctccagtttgggccagttgtggattaagggggacagtctctttctcccatctgctattcagaggcccctttgcaaagcactgccgtggcctggtagcaagcctcccctgtgcgctgagagcccgtaccctccatgcatgtgttcttggttggggatgacccctgggatcagccagaaggctccagtgactcaggagcagccccccaggggtcccagccaaggtagaactgcagtggaagggtgggggtttcctgaggctactcaggcccatctcagagggcagctcccagtggggattggagagcagagctgcctcccaggagccatggcttagcccagcaaggaccctcttatctgtctgtgaggcagctggcgggtttctcctggccacacctggacatgccctagagtattctctacctaccgccccaaagagtgcagacccagagcccagaacctgttttttttgtttgtttgttttttgttttttttagatggagtcttgctctgtcacccaggctggtgcgatctcggctcactgcaacctccacctccggggttcaagtgattcttctgccttagcctcctgagtagctgagattacaggtgcacgccaccatgcccagctaatttttgtatttttttttactagagacggagtttcaccatgttgggcaggctggcctcgaactcctgacctcgtgatctgcccgtctcctcctcccaaagtgctaggattacaggcatgagccatcatgtctggccaaacctggtttcttgagcaactttcttaattgctttggccctggtttgctcaattgtaaaatggggctggcagccaacccctccctcctgggttgctctgaatatgaattaactgacgtgagtaaagtgctttgagcagggcttgatgagtgatgtgtactaggacccttttccctcatcgcttgtcgctgctgctgatggcaatggccactcctccctgcaggctggcctcggcatagcagaggggcaggtggtggccatggctgctttgcccttcacctggcttggcagtttcctccactgtcaccaccaccacacaggggcttggcactctcctgtctcacctccagagtacctatggaagctccgaaggggcagaccttggtgttgtacccacttttcatccctgggaggaatatggcctcaggcaggccaaggggtccccagctgaggtgtgaacctgaggggcccagacccacaggcctctggcagctatgagctctgggaggctgaaccgaggctgagtcctggtcctgccttggcctggtgctcaggacctctcctgcccaggtgacggggtttgacagcgtggatgatgagtccaagcacagcgaccacatgttttccgacaagagcccaaacccggacgtctggaccagtgagcagaacccaccctacagctactacctgtactacatgtatgccaacatcatggtgctcaacaacctccgcaggtgcgtgaggcctgccctcgcacatgcttgggttcatgtgttagtacatgcacgcatgcacacacatgcacacacacatgcatgtgatccttgtgtccgtgtgcacctgaaccaacatgcatgtccatgtgcccacacacctcaaaacacacagcactttccagcctgctatatgaggcatgtctccacatgatcacacacatgcaaacatgcccaccataacacacatgccagtacagacatatgtcatgtacagtatgcaatgcagccacagtccacacgtgtccacacatttatatgtacacacaccagggcacactccacgtgtacctgtacatccctgagataatggaagcataggacatgctatcacacatgcacggtcacttactgccacaccaacaatgtccacacgtgcatattttcgttcagcaaatcactgcatctggcatgcgataggcattgccctgggcactggacaaataacggggaacaaaacagactaaatccatgcatgcccttacaggcagaggctcctaccaatacgcacacagacgaggcacacgtggccaggagttagctgcccagggcagcaggacactgagccattcccttccctacaagtcttgcatcccactttcccctgctgggccctggggtctctctagctcagcctaaactggtgctagttggtgggtgtggaggtttcgaatggggtcctgattgaaagaaatggcctggcagggtggaggcagtcctgggctgagcttttggagatgggggctctggttctggctttgctactgacctgttcagtggcatggaacatagacttcactctccgggccttggtttgcccatttccataacacagaggtcagactctgtggtttctcatggccttccctgctctggagttctacgaatgcgggacacaaggccaggagaggaattcaggagagtggctggagggcacagcagggtctctttctactgcgaggcccactctctgcccgtagaggtgatgcttcttggttctaaggggccccagggcctggacctctgcattttaggaggggtagtttccagggtgcactgggtcagcacagctgaccatgggtggtcattccccccggagctggccctgagctgtggctgcaggccccaggcagagccaactggggggggccttcctgattcggaaaccccttctcttacagggagcgcggcctgagcacgttcctgttccggccgcactgtggggaagccggctccatcacccacctggtgtctgccttcctcactgctgacaacatttcccacgggctgctcctcaagaaggtaaccaggtcactctcgggagcccgtcctgagtgactgccctgccctgggctcctgggaggctcaaccagtgaggccagaaggctgggccctcttctgggctgggatgtctgtccttatcttggttttatttttaattatgaaagtaatataatcaaactcatcacaattttgattttccaaaaactggagaaatggaaaaaagccagcccttatgctattacattaatagaaatagccattattagctttttagtatatctaatttccatcttttatccacagcatatttttaatgtgtttattatcataatgaacacagaatttggttcctgcctcgtcccttactgttgtatgacaagcattttttgatgctgcaacgtaatatctatgctcctttttccaaaggctgttgttggatgaagggtctgccactttgtctgtaattgactcaaccagtccacactagttgggcacagagtccatccaccttttcactggtgtacccttgagctctgtgcatacagtcttctccgtattttggatcactttccattggcacgatgtttgatcaaaatgctccctttccctgatcccggtgaggtgtaaccatgggtcacatttttgggtggggtgggtgctacagtagaaaaccactctatcctgggcaggtccacccctcccatcccttcagggatcatctcccaggagctggagtgtttatagtctcaacctggctgtttgcagtcaaagcaataaaacagctagaggggggcatcttctagactgggtccgtgcctaggagaaaggagctgaaggtgtaggctggagtgggctgcccttcctgccctgagccttgcctccagtttggagcaagaatgagcacttccaacagtgggtagaggcaccagggagggctggcatgcaatgtaggaatgagatgaacagtggggaaggggagagtgggtctgagtgtcctggcttcgaggaactcgggttgaggacttgggcagacatggttcagacccctggtttccactggtgaatgcttcttcccttcctttctcccttcccttttcccttctcccctctctggcacttgtcacatgagttcggtggttcttttgcagagtccggtattgcagtatctctactaccttgctcagatccccattgccatgtctcctcttagcaacaacagtttgttcctcgaatattccaagaaccctctgagggaattcctacacaagggactgcatgtttctctttccaccgatgaccccatgcagttccactacacgaaggtaaggactttggggtgaggacagtagtgcttcagtaggcaccagtcctagcctgtcctcccatttcaggaacctgagcccatggcttagttctgcttttggggtggggttggtggcccagtgaaggcaggaaggaagccactgttgggggaaaattgtgccatccaggagccctttctttggggttcttgaaccctcaaaggcacaatttagtatctttgccttcctctattttctctttctttgacatttatgagctctgtgaccttggtaaagttattagatttctggatcaagttcttcttcatctgtaaaatggagataaaattttctctgtccctaccctgtaaggattcatgaagataatgaatcaaaggttctaacatagtgtctgcatatattcaaaatggttgctactttttaaatcaatgctattataatttctacactttgggtctctgggaaaataaaagaggaagctaacagtggtgtcatgcatggggactagccgcaagtatacccagcatgttttgatggtgtcgacaagaccagccattgcttaacaaaaacagaagcaccagagtcttttaggacagaggttctccaacctcttggtctctggacccctttatactcttaagaattgaagctttcaaagacctgttgtttatgtgggttatatctactgatatttaccatgttagaaatgaataagaaattttaaaatatttattatctcatttaaaaaccacatcaataaaccaatgaaatgttacataataatgattttttttctgaaaagtaacagtttcccctgcctttgttttgcatttttaagcctctttaatgtcttaatggaagtcagcaggactcttctagccacttctgcattcaatttgtttttaatcaaaatatgtaaaaatagaaatcttgcctcatgaaaatacataattggaaaagacaagacctttcaaaaggtcttaggaccctcaggggtccttgacctgtacttcgagaactattgctctaggctacagcggcagtggggtggggaagaggtcacagacggcttgtgatgaatagacacttcacatcccagaagggaagcaaaaccacagctcaaacccagatcattctgggattacaccattttaccacttatcctatgatcacttctcattttttttttgatgttccatctctgcttttagtactttactcatctatctatctatctatctatctatctatctatttatctatctatcatctatctatctattgcaaacttaagaaaatagtgtgttaaaaagaaaagctagagggcaagtgctaaatgtggcatgactagagggcttgtcacaggagagcagagactgccatccctgatgactggcacagggtttcaacatgaggtctcagtgctggtcaatgaataaatgtagaggcgtgattttagatctctctttgataacccatgattttacagaagaaaagatcttaggctttgaaggtgtgatgtttgatgatccaggtgccatttagtgaggaaaagttaaacccgcagtgtctgatgttgttagctttggacatgtgtgaacgattgacatggatatccccccttctaatccacatgctttgggggaggatctaggaagcacttatggaagaatatgccattgcagctcaagtgtggaagctgagcacctgcgacctgtgtgagatcgccaggaacagcgtgctgcagagcggcctctcgcatcaggtatggagtgtgacggtgctgcctgtgtccctcctgggaaggctgcctgctgtgtgccaggagccttccaggcactggggatctgtgatgaacatagcaggcagggcctctgagacactcaggcacagggagagaagacgcggcagcctcctgtgttttcatggctgcttcctcacccttctcagacctctacgcctccttggagaggccttccctgatcgcccattctaaaatagccacacacttgctattattctctatccccttaatcagtttttctccataccatttattcctgctgatgtttagttatgtgtttttctgtctttccctctagcatgtaagctctgtgagggcagaggtttgttcagaattatatccccgggccctagatagtccctggcacatagcaggcgctcaatatttcttgaatagatgaacagtatctagactgaataaaaatctagactatgggactcagacatctgtcattttttaaaaagcctgatgaggagctggcactgagacccatgttctgatgtacgttaggtcccccgacacctccctgggtgatgtcactggttgggaagaggttgcattaggggctgtgctcgtcggatgatgatgcagcagagttaaaggcttaagattcttttcatgcgcagtgtggtgccttggattggccctccccaggaacattgtccttgtcagctctcaggggcttcttaattagagtcttacctccttcccctttgcctttcccatccccagcagctgctgcagaccttatctttcctctctgatcaaggaaagcacagccaggaatgaagggctgtctgaggatgactgaggttgtcagggtgacatccttgaggacacagaggccagcaggaattttaagagttctgtggggataagatgtcctgaccaaagatctgcttcagggggactagtctgacttgctgtgactgatgtcaaagctgcccacatggctatagaaagtgaatcaaaagtatatagtttcatttgtatttctcttggtccacaggaaaagcaaaagtttctgggacaaaattattataaagaaggacctgaaggaaatgatattcgaaagacaaatgtggctcagatccggatggcattccgatatgagaccttatgcaatgagctcagcttcctgtctgatgctatgaaatcagaagagatcaccgccttgaccaactaggtccagcatttgacatgcattttaactttttggttcaatttcaagtctgctgtggctaatagtggtcaagattccgaactaggactttcctctgtgaagaggatgcctctgaagaaattttaaactggtgattttggttgcactgctcactttaagagttaacatgctcacttgttagtatttctgagtaacaagatggtgacttctccttggggatctgggagctgagcacttgtctatacttgttcctaattttccaagtatttctcttgaaactgccagtgcctgaactgttggggccaggattttccctggtcagatgccaagtaacatgtggttttctgccatacttttctccattggcccaggtaggctaattggtagttgttcatttcagcctctggatggctggctgccttaaacacaatcaatttcaaagctccatttcataaaggggctactttgaaggagttaagatggaagacttccttcttgacaaattgtgtttttagtgaatttcttaaaccgttttatttagccctccttccctctttctagttggaagccaaatgtactcatgaaaacagccactcctattctgagtcttggtttcttcacctagaaagtgagggtttggactagatgagtggctttcagggtgttctgtgaatctcctcatgaatactttagggtaggggagggaagggagtgagtgatgctcaggggctgtcaaagtgactgcgttcatcagttttacactggggctgctacataatattttcatttgaacgaagaacttcaaaaagcacaggactagatgatctctgttccttttggctctaatatgctacaactgtaggccaattatcactttaccaattaagagttaggccagataagtgaaatttaacttaagggcacacagctaataagtaataggcctaaactggatttccttattccaaatcctgtcttttccccactattccattagaccccacaaatgttagttgtgtgtgtgtgtgtgtgtgtttttaatcactgtaaccggatgcatttttttaaggcaaaatttctcccttatctactatgatgacttcagaagatacaatggtcccaggggccaagtagaaagcatttttaaagattaatctgaattaagctttatcagtgtactctttatctgtgttactagtgcctggtatgtagtaggtgctcaataaatgcatattgaataactaagtgaatttcttttggcaactttttaaggacatgtgctcttagtacttaagaggctgctcaaggaccttcctatctatttctgtggtcaaattcagactacaggaggtctttttgaatcattatagttagaagaagaatccagtttctgcctgtgaacttatttgactttagattgtctcatcttgtgactttataatgcctgtcccctccactggtcaattcagcatatggaagtataaatgcagtctttttactaggcagatatatatgctatcttacagctaattatgaaattgaatgaaaatccattgttatcttagggattagttttgaaaagcccccgtttatatacatttgccctaacataggaagtattgtgtagtttctcattgtcattttatctgtatcaagtatctttttttaaattgttaaataaagtcagctaggactgtg

SEQ ID NO: 134 - DNA, 29243 bp, Homo sapiens
atgcagaagccgaagacagtggcctgggagaatctgggtccagagatgtcagctcttggaactgctttttcaagagaagtatggatttttatgataaattttccaagttaaaaaaacttgctaggtcaaaaaacactcctacaacgcagatcagcttatagactgcttgtgcgaggctccgttctagcctgccttcctcgtgtcttcatctgtattgttggtaattttagaactatctcacgtaagttaaaacaaaccagaacatagtcacactgaaattcaatgttttactgtaaactgctatggctaatataaaatggtaatgtatcagtgaaaaactatttttcttactatgttgtttttttcagggtggccgtaaagttgaattccctacagatccaaaggtaaaaatatatatgtatttttgtatgtatgtatatgtaattatttaaacatatacacatatatatgtacttaatgttattcccactccatctctatgaagatattgcttatgtgacttctcatattaaacctctgtcacacataaatgcagccaaaggaagttgccaacttacacttgccatccttcagggtggaagatgatgctaatggcactggttatcactaagagtacatttagccatggctcagaagggtcattgttatattgagttaacaatttgcagttgtatttactaattgcagggcttcttgctgcttgccaattagccaggaaaaaacttttttaagacaaactttccctactccaaaataccctttctgctattcccaattcccacatcgatgccacacactataacttttcaattttcaattttaacactactttagaatcctctggttccttctatgtggttctaaatatcagttttatatatacatatatatgtgtgtgtgtatatatttattttatatatatatgtatataaattattttaaaactgtttggaaccatggctttgggctataccacattagggaaaaaaaaaagccagatttttttttttctttttactatcttatcagatgccattatttagggttttttttttttttgtggagaccaggccttgctctgtcacccaggctggtatacagtggcaccatcacggctcactgaagcctcgatttctccagctcaagccatcctcttgcctcagcctcctgaatagctgggactataggcatgtaccactacacccaactttttttctttttagcagagatgaggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttattttattttattttattttattttattttattttgagacaagagtttcactctgtcacccaggttggagtgcagtgacgtgatctcagctcacttaaccctctgcctcctgagttcaagcggttctgcctcagcctcctgcgtagctgagattacaggtgtgcatcactatgcccagctaatttttgtatttttagcagagatggggtttcaccatattgcccaggttggtctcaaactcctgagctcaagtgatcctcctgccttggcctcccaaagtgctggaattacaggtgtgagccactgtgcctggcctagttaattttttaaaatatgattagaacattttattttattttattttattttatttattttaattaaatttaattttattttattttatttattttattgagacaagagtttcactctgtcacccaggctggagtgcagtgacgtgatctcggctcacttaaccctctgcctcctgagttcaagcggttctgcctcagcctcctgtgtagctgagattacaggtgtgcatcactatgcccagctaatttttgtatttttagcagagacggggtttcaccatattggccaggctggtctcgaactcctgacctcaagtgatccacctacctcagcctcgcaaagtgctgggataacaggcgtgagccaccgcgcccagtcagaaaattttaatttgtgtgtcaggacttagtgatattaaatgactgatttaatgttaagctgttgggatacttcttacagattactggtatatctcatttctattgtaggtagttgtttatgaaaagcctttctttgaaggaaaatgtgtggaactagaaacaggaatgtgtagttttgtcatggagggaggtgaaacagaagaggcgactggagacgatcatttgccgtttacgtcagtggggtctatgaaagttctaagaggcatgtaagtacatgggtgacttgttaggatttcttttttttccgaaatattaagtaataaatgtgccctttcccccctaaaaacaacattcctgattctatagtatggtgaattttgacagttatatccacattctcctcagcctatagtgactggatttaagaaagcagtttgaggctgggtgtggtggctcacacctgtaatcccaacactttgggaggccaaggcgggcggatcacctgaggtcaggagttcaagaccagcctgaccaacatggggaaaccccatgtctactaaaaaatacaaaattagctgagcgtggtgtcacatgcctgtgatcccagctacttgggaggctgaggcaggagaatcgcttgaactcaggaggcaaaggctgcggtgagccaagatcgcaccattgcactccagcctgggcaacaagagcgaaactctgtcaaggaaggctgatacattggcctgttcaagttgatcaaatctacaaccttgcttattagaattatgctccaagctattgaacagtttgatagttcgctttctgatttttatatttttgcatcttatagatcttgcacatttcccatagaagtgcacactaaagttgctcttgtaaatcgctaactattcataatatttttgttactatctgaagtgagtttatccagttttgcttgctgaggttcttttgagtcagccctgattaaacacacacacatacacaccactcacacacacgctccccttcccttttttatacaactctgatatatgtctcttaggttattttcttggggccattctgttattctcctaaattttaaagaattccaatgataataaagcagaaggtcatgtctagctttataactatttgtatttttcaatgaaattgatatgtaccttgaaaaaatgttaacatgtctggaaatgactactcctcgtgttctttatgttgcagttgggttgcatatgagaaacctggatttaccggtcatcagtatttgctagaagaaggagaatacagggactggaaagcctggggaggttacaatggagagcttcagtctttacgacctatattaggtgtaagtaaaggacaagctaatggctaatacttggtcttctttggataataaatggctagcctttgaattttgaattttttttctcaataggatttttcaaatgctcacatgataatgtacagtgaaaaaaactttggatccaaaggttccagtattgatgtattgggaattgttgctaatttaaaggagactggatatggagtgaagacacagtctattaatgtactgagtggagtgtaagtgaaataatccagttggaattttaaacatgcgttttaccttggtttgttttaaactggtaagagtctatcacagagtaggcattcaatacacaaatatctcaacagcttaacattaaatcagtcatttaatagttgctgtcatgatattttcgttaactctctttaaaaatcgttctcataccatctcttctttttacgtttggggtaggctttgggtatcatgatagaaatctacagatctgtttcccttgtcattctgcacagaaagatagtgaattttttaaatgatggagatcaaataataataatagtaatctaacataaacctgaggctgggtcaaagtcccagtagattttcctgtggtcctacacctgttccagtatatttcttcactattagtttgacataaaaataattgttctatgtacgtggagttagcagttgactgttttattagtggtgaagcaagtttttattgaaagatgtttagtcaagattctttgggatgaagtgactgcaagccaagctaaattggctcaagggattaaaatggaacttactggcttaagtaactaaaaagtcctggagaagattttgcttcaggcatgcctagatgcagcggatcaaacactatcagaacttagtctctgtgtcttgactgggcttttttctgtgttaacttgactttaggtaggccttttgcatttggtggcctgtggccacattcagcttttgttctcctaactctttttttttgaggcagagtttcactctgccacccaggctggagtgcagtggcaaaatctcagctcactgcaacctctgcctcctgggcttaagcgatcctcctgcttcagcctcccaagtagttgggaccacagatgtgtgccaccaggcctggctaatttttgtatttttttttagagacaggtttttgccatgttgcccaggctggtctcaaactcctgagctcaggtgatccacccgccttggcctcccaaagtgctgggattacaggcatgagccaccatgcctggccccagctcatttcttgcagtggaaagagcttctctttctcacaagttccatgtttgactttgctttcctaggcttgggtcatgtgcacatgcctgaaccaatcactgtagccacagagacggccatgtctgggctacgtgtccatctccagagctgagatgtagggtctatcccataggagccacttagatatgaatggggttggtggttccccagggacatcagaaagagtggggagatagatgccagatgggcaaaaacagcagatggctgttatagggagttacataattattcttgtaatccaggctaatgtctattctaatttgttataagtgagagtattctcaaatagttacatgaaataatgtgacattggttatgctgaaagtgtttggtgttaggtttttgttgtcatagtgacatagactatttgaatcatcctagcctcaaccccattgtatctcatggggcctcccacaatagccctggatatttgaaaagtgtgtacaatgtactaaaagttgatgaacatgcttaacttttactcttagtaaatagagtaaaaaaaaccttgttcaacaagttcttgtctaggccgttgcatgtggtgccattttggcagagtatcagtgatttccgggtattccattctcagcaggaaatgcctactcttgggtcctattctggagccctaacattttagaatcagtagcctgtttgcaaaagccagaagtcatctgaaatataaggtacaagttatctgaaatgttgctggggctctgcagtattttagattgtctttaaagctaattatttaggaggaaaacatagtgaccaacttagtctggtgaaacagttgtacattttgatactcaccagttgtgttggttctattagtcagagcctagtcatccaccctggcagaggaagcaaaaggatgctgggtagaatgaattcccttaggtattttgtagatgatgctattaacacaggtagaattattgtgccttgagccaatctcctttcctttttaacccaggccttgcttacttgaaatcagttccctttataaagtgctgctattatatgtttctatttttagtcatttctaattgcatttcctggcttaagcttcttttttctggctgtagcagttaagttttggtagaagggggaagttgaagggagctacgtacacatacgtggacacacacacacacacacacacacaccacttcctttgaaattctttgcatatggaagggcttttgtatttaccagggccaggtgcttcctcatattttgttcgatttgtcatttgacaagtatttattgcggtctgttatgtgcaaagcattgtattatgtcctcaaagaagttacggtatttatgtaaaacataattattgctacaaaagaggtacagattaaatgctctgggaatccacagcagagagagattaatttccagtctggacacagggaaggaagactttgtggaggaggtggcattggagttaggcctgtgggataggataggaaggctgagatgagccaagatgatggaggaggactacctattcactttaaatagtttcaaaggaaaattattgtattttaatggctttatttttattggcaattaagtattttagcttggttctttatttcttattatggcatgcattgtcagaaaaaaactcttctgaagttcttgttccatgaaagtatctcccaggaggctcaccatcacatgggtaatacatcccctgggcagtaaactcatcattagtcctgaaacagagaacagccttcaggaaggatgcccatgaaaccagcaactgaggtttttaggaactgcatttgattcttactggaaatgtcgaaagaaactccctgcttatcagtttctagttctatgctatattcttgctcaaatagtggaaactgggctagttttttaaaactaggagcaaaatgaaatatttctggtattcagatgaaaacgaaaagtgttgttgttttaaattctttttcctttggccttccacggaagggcaggtttaccctgctgcccttatcttctgagcaattattccaccaggctgggacctgctagtacttgtgtacatgcctttcccccgtctccccaccagtctttaaacagaggagtgttgattcatgtgtacagaatacatctggacaaggacagggagggattttcttaagagccccaagtgtaagttgtaagtagactctcggatcatagagcagagaatctcagatctgggttttgcggcttctcccctcccccactccccccattcatgggtgattcatcaggtatcttggagggaaaacaacactactgtcagttcaagtaacatcttaataaattgttttccagcttcagcttcagtgaattagagataggcttagctgggtgttgggtatttacttacaagtagtttagtttcataggaaaatacagtacccatacttgttagtaaaaagaacagagtactggctaaagctgcttccagggctgtcctctctccttggcattcagcctcccacctcactgtcttttttccctccaaaccttgaagtcaaacagaaaggcctttaaccctcttatctctctacttgttacagactcggagccctggtgagaaccctttttttgatgtggctctacttctttaattgttcgttgtttttttaaagtcctagtgtttgtaacgtagattttctttttttttaaattttattattattatactttaagttttagggtacatgtgcacaacgtgcaggttagttacatatgtatacatgtgccatgttggtgtgctgcacccattaactcgtcatctagcattaggtatatctcctaatgctatccctcccccctccccccaccccacaacagtccccggtgtgtgatgttccccttcctgtgtccatgtgttctcattgttcaattcccacctatgagtgagaacatgcggtgtttggttttttgtccttgcgatcgtttgctgagaatgatggtttccagtttcatccatgtccctacaaaggacatgaactcatcattttttatggctgcatagtattccatggtgtatatgtgccacattttcttaatccagtcatgtagattttcttgatgtgcagacactcctcccacatagcagtgctccctgctctggctttactgttgcttcctttcatgctgggggtaaagcctgaggccctgtgggcagaggcagcacatgcgggtacccgtgtgctgtacagcatcacctggtcagcccggggaccttggcccactctcctacttacacttgaaaatacaaactttcacaaaggttaagtgagttcttcaaagttatctgaaagttaatgtcatggccacaggtggagccaggtctcctatctcctcacctctcagtgataaaggataggtttttaggccgggaacagtgctcacgcctgtaatcctagcactttaggaggctgaggtgggtggatcacttgaagtcaggagtttgagaccagcctggccaacatggtaaaatcctgactctactaaaaaaaataaaaaataaataaaaataaaaaagaacaggttttaaaaattgctagtgaggttctgaaatcgggggatggggggtggtagggggctgtatttcctgaaagactgagtggtgcatatagcagcttctccatttggatggctgggagtgagtgcacagatgttggctgttattagctacttctcactggagattttggcagtgttctttttttccttgatggctgttcatattctagtaattactgtacttgagtttttgtttaaatcagccctttggatagtaaaatcataatctgctctaattataaagtgtgtggactgttttaggcatggtttactagaacagtaaatgaaagggaactttccagggcacatggcaggttgggtcacaaagcaaggagagcctggtgggcctcaggacaggtaggttcagtcacgttctggccaatagtcgattgtgtcaccctggacaagtcatttcccattcaaaacaaataccaacaaatacttccatgtgatgctgcttacccatctgtgggctttggaggacagagattttgtctttttcatctttgtatatctagtgccagtctagttcctggcacctggtaaatgaattaacttactgtgtcttaggtttttcccatctgtaaaatgggaacaccaatacctccctaggagattaaatgtgataacagatgtggaaacattttgcaaagttctgatcaccctacataatacatacatagatattattcctttaagctttgagaggatcatgagaatgatgaattaattgaaaagatacttaatgtcttcaatataatggtattaagtatctctttaatataacagaactgaaaaaccttttcctttcaaagactttatctttgcataggaaatagcatcattaaattggttttgttgattttcctctgggtgtagatcacttaaaagagaaaaaaacattccaaaagagatttatttttagtatttctatgagtttgctcaattttgtttatttaatttttacatatttatgtgatgttggaaacactgttggaaacaatattttagttctgttctgcatttttaaaagcatttcttctgttaacttctttttcagtgtggtttgttgtgtaatagacacagcttcctaagatctttctgcaaaaatattttaaggttgagaatgaaaggacttattgattgcttattaaaagaactaggttcttcttgaaagtcctgtttgttttgtttccttagaatacaattagaaaaaaaaaagcacagagaagtattgcctttgtagctttctcaagaaatagtatttgataagcgagaacgccaaaaagttcatgtcaagatacccttacgcttaccatttcttttgcattaagttttttttcaactcttattttagattcagggggtacatgtgcaggtttgttacatgggtatattgcatgatttcctgaagtttggggtacggttgaacccgtcaacctgagcatagcatgcaacaggtagtttttcaaacccccctccctcctggccccttttgtagtccccagggcctatttttttttcttctttatgtccatgcatgaccaatgtttagctcccacttatgggcaagaacatgctcataagtatatgttcttgctcataaatatttggtatttgattttctgtttgtgttaattcgcttaggatagtgacctccagttgcatccaagttgctgcaaaggacttgatttcattcttttttatggctgtatagtattccatggtttatatgtaccacattttctctatccaatccaccattgatcaatgaacacctaggttgattccacatcttgatattgtgaatagtgtggcagtaaacaagacacgtgcaagtatctttttggtagaataattcgttttcccctgggtatatcccagtaatgggattgctgggttgaatactagttctatctttagttctttgagaaatcttcaaactgctttccacagcagctaaactaatttacattcccaccagcagtgtataaatgttccctcttctctgctggcttaccattctgatttgtcctatagacaaacccatctgcttctaaaggttaatggagaatcagaaaaattaaaatttcaattggcaaaacaaatgaaagtttctgtatgatacatagatatccaaatatgtgatcgttttatatgtaaaatatgaactccaacaagtgattgcttttgtttcttagatgggtagcctatgaaaatcctgacttcacaggagaacagtatatactggataaaggattttataccagttttgaggactggggaggcaaaaattgtaagatctcttctgttcaacctatatgtttggtaaggagttatatttttgtatgagaatatttaactgaattctggatttccttaatgtgtgttcctggttcatgtaatagtaattgctatggaaaatattctgagtttatttttagcagtaattgctaataatctagaagaaaaaaactttttcaatgtgtttgttctattcatttccttttctccttcctttaaaaatttttaggattctttcactggcccaaggagacgaaatcaggtaactttaaaaatattcttttatattaatatataaagggccttccattgaaaagctgaacttatgtttcaaatgtcagacatttggggccgggtgtggtggctcacgcctgtaatcccagcactttgggaggtcaaggcaggtggatcacttgagctcaggagttcaagaccagcctgaccaacatggggaaaccccgtctttactaaaaagacaaaaattagctgggtgtggtggcttgtgtctataagctcagctactcaggaagctgaggcaggagaattgcttgaaccccaagaggcagatgttggagtgagccgagatcgcaccactgcactccagcctgagtgacagagactctgtctcaaaaaaaaaaaaaaaaaaaaaaaaaaaaaaatcagacatttgggacattttgttagttttactcatttttatgcctgaaagcataattgtatttaaaaaataagatttaagtttactttaatggttaattgacagtactgacccatgtctaaataattcttataaaatgcttattgtataaagctgaattttatatcattacattgactcagtttatattaatacattgagattaatatttcaaacaatagcatctagttattgtgatggtaaaatgaattttcatatttgctgtgtcgacactagacattttttatggtctcactcaagctttctgaatgctgattcttaacatcaactggggtgtacatttgttatttcggccttttaatggaagtgttcacagagccataattatagaggaacaaacaccactatagcctcctttattggcattcacaggattccgataagtcagcaagtgtcttccattgagaaggaaggaaactacactatgtctttccaaaatactgtttgtcgttaatgtcagaactgatgaacaatgatttctgaccacaataaagctttaaaatacctcacagcttcacaacagggtgttctatagaaagttacctttgttgttgcattttactttgatgtctctgaattaaataaatagtcacgaatggcgcagctaacatgtttctaattgatcatgaatgtagacatggaaaattaaaggatttctaaaattcgtaccagtttactgtaacaaaagtcagcaggtcatgtttaggtcatcatttcaaaggctaaattagttaatgtgtttaggaaaataattttatgtgtttctgtttactttttcaaagattcacttgttttcagaaccacagtttcaaggtcacagtcaaagttttgaagaaacaacaagtcaaattgatgattcattttctaccaagtcttgcagagtttcaggaggcaggtaagtgaaacaaaggcctggcagagctgaatcactggagtaaaacagaattcacacatcagcaagtatatagtgatgcctgttaggtgcttggcactatgcgaaaccaccatcttagtccaatggcgtgcttcgtgatatctgagtaccagacgccagaggacacgggcttcaggttggttggagaagctgaagatcatctcattgtgtaatggaattcagagcaggttctttactctgtatgtcttcccatcatctagaaagggagagttgggctctagttaatccaaggtacctcccaaggtggattgttcaaaggacaggatcggcactctgcattaacaggaaggtagaaagtacacgctggagtggagctggtggacacgcgaatcagggagcataccagtccggcttgctgggagggctttgtactgggaggagaagcaaagctgagcacactgagtttagatggcttccacaggaaacacaagacccagggcaaaggcaatgggctcaattgtttcatgctgaaacaatccttgtacaaaagcttcatggagaggggagagcccaaggtcagggaaactcggtcaggaaagccttggagcaatctgtgcaagaggtgttgaggatttaagtctcttaataatagtagtaatagtgcctttaatcacgtggttctttatggttgaaataatgctatcctgtcctttagtattgcacagcaaaaaagcactgactttgcattcaaatacacagatggaggccgggtgcagtggctcctgcctgtaatcccaacacttagggaagccaaggcaggcagatcacttgaggtcaggagatcgagaccagcctggccatcatggcaaaaccctgtctttactaaaaatacaaaaattagccgggcatggtgacacacctgtaatcccagctacttgggaggctgaggcaggagaattgcgtgaacccaggaggcagaggttgcagtaagttgagatcatagcactgcactctagcctgggcaacagagcaagactgtctcaggaaaaaacaaaaaaggcaaatacatagttggatagtaaagcttcctagtttgttggacatactgctaccacatccccactcctcgttatcccctgcctgcttcatttattacctccagtcctgtgcatgtttaaaattacctgtctcagctcactagagtattaacttcaggagagcagggactttggttctctgctgtatccccagcaatagaaaagtacctgacacataatcctcaaaaggcatttgttgggttaaaaacaacaacaacagggccaggcacggtgactcacacctgtaatcccagcactttgggaggccgaggtgggcagatcaccaggtcaggatttcgagaccagtctggccaatatggtgaaaccccgtctctactaaaaatacaaaaattagccaggtgtggtggcatgcacctgtagtcccagctactcaggaggatgaggcagaagaattgcttgaacccaggaggcagaggttgcagtgagccgagatcatgccactgcactccagcctgtgtgacagagcgagattctgtccccccgccaccaaaagaaaagaaaaaaaggaaaaaaaaaaaaaaggcccacaaacttctaggggagcatggcaaatcaccattttatgaataatgttgataccagagaggctaagtgacttgtctaagtcaatatagtattttgactcctggcccagtgcagaggtattagaaatgaggatagaggagtgtgcgagaaattttggaaggaaatcaatagaccaaatcaataggccttggtgattaactagtcacaaagcttgaagaaggattattcaaaaaggacttgagggcttgaagctccactggctgggcaaacggtggcacccatgagaagagcaaggaaggctggaggctggggaagtcagaaagaacgtggagaaagaagtttgtttcccaaatgcaaagttaactgacttattatgaatattattttgccacaagcagaaatgcaataaatatatccaaatatttttgaagaaagaactctgtttgccagaagcattgtgtttattttatagcaggccacctctaaaaatcagacttcttgaataggagtgctcaagttgcatattctgtgcatgtgtgtggtttttcccattgtagctgggttgtatatgatggagaaaatttcactggtaatcaatacgtgttggaagaaggccattatccttgtctgtctgcaatgggatgcccgcctggagcaactttcaagtctcttcgttttatagatgttgtaagtatgtcattgtgaatagtgttgcagaaatgtatgcctcatatagctgatggtcagagtgaggtaaccagccggtagaacctgctcttaaagttagttaagggcttggagatggaactgtccatttggctctgtgtacatctagtttattgattctaactggtacacgttttccaccaccctgttttactcacttaatcctcatatgcatatccctatggacctgagtgggagtctcttggactatatattaggagtagaattactggatttcacatgtaagaacaggcagtttcattcagtactgccagatcccaccacttgagactcccaccagcagtacacattgttgccattactgaatattctctcattctaatttttgtcaacttgatagaatgagcagaaagcagtatgtcgtcattgggttaatttgtatttcactattagtgaggctggtatctcttatttataatttgcattttctattcaaggaattgtgtattgtatcctttgcaatttggcttcctctacctttggttgttattattgaagaaattccttataggtttttagtctattattattctgtgttttagagatttgcaatcaaatgacttctcccagtttgccactatgtgctaatccagattatagtgccctcttttggacagaagtctttcagtttgatgtagtggaagtaatattcaatagaacaaaactgcaagatcatgttgagatattaaagtctggaagtatctgtcgtttctgacatttttattagtttttggtaactgctttctcataaaaagctttaaacacacgtaattgctcattttagttttaaatgtaggaagaacgtatgtgagttggttttcatctcatccctgcctgcctgtttaaatagcaaaaatgctactgagacatgaaaatagtaacaaagaaacatgaaatgaggtagtaagattcattagcttacaagtaatgaataagactttgattgttattctgcctagaattctaaaagctacctacaagtatatatttgaaaatttcaatgccttccctcaaccagaacttggcatatatgctcacaacactctgaggctatagatgacatctttttatgttttaattgtgaggaaatgaatgttttacccatatgaagactacatatctttgtgacttaatacttcaaaattatttaattgctttttaatactaaagtgtttagaacatttttgggcttgccatctcaaaagtgcaataaaagtgcaaagtagtaatactactataatttttgtcttctttcctccatgtatgttttatataaactaattcctagaccacacaaactacttctacacactaacatgctctgtttactgatggacaaaatctttttaccagtcaggacacatccacataaatgaagcagtaaggtaccgcaccctttccacaaactttaagcaggatagggaaaaaattgtaatccccacatgcttttattttttttttttttgaaatggagtctcactcagttgcccaggctggagtgcagtggcatgatcttgactcactgcaacctccgcctcccaggttcaagtgattctctagtctcccactcagcctccaaagtagctgggattacaagcatgcaccaccatgcccggctaatttttttgtgtttgtttgtttgtttttgtatttttaatagagatggggtttcaccctgttggccaggctgatctcaaactcctgacctcaagtgatccgtccacctcggcctcccaaagtgctgggatgacaggcgtaagccaccatgcccggcctcccacatgctttttaatgcatcatttatgatcttagcagtactatcattagagattaatgtagaatcaaaagtgtctataatttgaaaaaacaggcataagctgccaacttttcattttcctgaacagtgaacgtttgtgctgttgtcctctttaaaatgattgacagtttgaacatagagcttccatcctgttgttttttttctctcctcttgacaatgattcctacaggaaagtttgggagcatgagtacacagaatcattgtcttagtgatgaacagaaaaaaaaaagacatttgaaaatacatacaagaggaaggttccctgattaggcaataccactgtacactaagtgactaaacatcagatgccacagccctctgacccttggcaattatgtccatgactttccagcccctccttgtcccagtgaaaatggctaagtcaaaaataaatgccatcagaagtgttgatattcccagcgtatacccatttctcttttttttttccccctgttttacaaactatttatatttacctgccttcctatgcaatggagaaactaactgcccctctgtgctttctctctagcttggagtacacaaacatccaggctcccttggaaaaggagtttatggaaaggccaaatctagcagattttttgtgctttgtccttgtaacaagatgattttcacataagtttgaattattaacaaagatgaataacagaacattgtttttgttcctcaacaggaattttctgaaccaacaattattctctttgaaagagaagacttcaaaggaaaaaagattgaacttaatgcagaaactgtcaatctccgatccctgggattcaacacacaaatacgctctgttcaggttattggtggcatgtgagttacctacttgttgactcaataaaatagatcattttaaaaatcaagtttgggctgggcacagtggctcacgcctgtattcccaacactttaggaggccgaggtagaaggatcatttgaatccagggattcaagaaaagcctgggcaacaaagtgagaccccatctctaccaaaaatttaaaaattagccaggtgtcgtggcacatgcctgtggccccagctacgtaggaggctgaggccgaaggatcacttgagcacagtaggttgaggctgcagtgagccgtgttcacgccactgtactccagtctgagtgacaaagcaagaccctatcttaatttaaaaaaaaaaaattgatcagatttctccctctcttatattatcttaaactaattgacatataccctctctttttgtaagggttaataattatgcacctttgtagaacacttttccactgggaaaagtcatatgtaaagcatcttttatttcattatccagatttttagtttatttaaggtaaggattttgtctttaacacctctcatagtctagcaagtaagaaagagctgactttacttatccctttaaaaaagagcaagtcctctgattttggagctcagggttgggattttcctttagctgggaatgactggcagatgttatacaaatgattaaaggtcaacttggaaagatttttttcccctcaacttcgaatacttttgaataagatataaaaatgaatgagtaccatcaatgtaatacatgtttttaagaaagtatttttcttttattcacaaaaacaataggtatggtctacctgtgtacaacagatgttggggtggactacatctatttaaaaaataatcaggccgggctgggtgcagtggctcctgcctgtaatcccagcactttgggagggcaaagcgggtggatcacctgaggtcaggagttcaggaccagcctggccaacgtggtgaaaccctgtctctactaaaaaatacaaaaattagccaggtgtggtggtggggcccctgtaatcccagctactcaggaggctgaggcaggagaatcacttgaacccaggaggtggaggttgcagtgagctgagatcacaccagtgcactccagcctgggtgacaagagtgaaactccatctaaaaaagaaaataaaaaaaatcacagaagctgggcgcagtgactcacgtctgtaaccctagcactttgggaggtcaaagtgggcagatcactggaacccagcagttccagacaagcctgggcaacatgttgaaaccctgtctctattgaaaacacaaaaattagtcgggtgtggtggtgcacgcctgtagtcccagctactcaggaggctgaggtgggagatcacttgagtctgggaggttgaggctgcagtgagctgtgatcgtgccactgcccttcagcctgggcaacagagtgagacctacctggaaaaaaaaattatagaatattagggtggtagaattatgggtgatttttttgcagtaggttttaatattttgtttttatgataagatgactaaaatgataaaattttatccaggatttaagttccaggattaaaagtagagtgcattcttccctgatgtaatatgcaagagaggagggcgctgggctgcttccacgccagtctgcgcttaaacccatacttcctcaggtgtgcagcagtagcatctgagcggaagggaactgagtatcttagcagttttttagatttaacaaagattactctcactgcagacaaaactttttatttaaccctatttagcacctactaagagctttggaaatattaacaacttaaagacccattattacaactgaagctattttatgaatagttcccaggaagaactgaggaatccactaaaagacaatatttcactgctttacggaggaaaaaacttacctatttctcttcaagaatggaactttttggcataagtactcatgtaacaaaaatttgctatttgtcaagaaattacttcttttaagtgttctagaaaagatcatttttcccccaatgtatgttaaaagtatatagttcagtctagaaatggaaagcattctaaaaataaatgtaattggggtccactgtcaaatgaaaattgccacttactgtggttatttttgttttcagatgggttacttatgaatatggcagttacagagggcgacagttcctattgtcacctgcagaagtacctaattggtatgaattcagtggctgtcgccaaataggttctctacgaccttttgttcaggtattttcttcctctccatgctctgcatagactcttctctgaaatttttttgtaaatgcaatccaactttttatccaatttttttattcaaagtttataactggcctcaccctataaactccttccctgccccaataatctgggctcagtttctggtgctaagaggtgtggctgcttcagaaggccatcaaactgaacatcaaacgcagttatccacaggcaggcaccctgcctcaggcgctttgacattttgtcaaactcttctcattgagaaaatttaaaacctctgagactcttgagtatggtaattacccttaatccatatctcactttggattcttcctgatattcatgcttgttcagtgcttccagcagcacatctggtataacaactgctgggggttttgtcttctagaagcgaatttatttcagacttcgaaacaaagcaacagggttattcatgtcaaccaatggaaacttagaggatctgaagcttctgaggatacaggtcatggaggatgtcggggccgatgatcagatttggatctatcaagaaggatgtatcaaatgcagggtgagctttaggattccacgggggcctgtgatggctttgctaggaggtgactcatcctttcatatgcttttgatcttttcttcaagtagatgcaatttcacaattcctggagtactttcagaaatgaatttgtttttttcatgacagtatatcctagctctgatagaaccagtctaggaacttaaaatgaaaggtaaatatagcactgatccaagatagaatatttatttctatgcttgatttttatatagtagtagaaaaaggaagtgtgttattcttccctttttccttaatgtaactgttacagaaacaaactataagctccagccctgtcaacaaaaatcactcttggtttgttttggggaaatccacagaacgggatgaagggtaaagagatccctctgtgtgctgcacagtccatttcctaagtgtcatacgttgtaaattagaaaatggcccatgtccctcctgcatcattcctactattaacagacacttaaaagctgactgtagtaagatttttatgaaagaagctcatgcttctatggtagataaaacttttttactccttgattttgtgagcttgaccgttggctcctgattttctttaaaaaaacaaaacaaaacaaaacaaaaaaccaaaaaaaacctggtgccccgtgagtcagcagaaggaacacagccttgcgaaaaggagtacaactcgttaattgggtctgttgtgctggagggggaattctttcagtaaacagaagtactgtttggacatgcatagaagaactagcaggaggaacagaagtagttgtaatatggaatcatgaaaagaagctttctgcctttgaattgtcttaatccaagaaaatggtgtctttcagcagttatttctaacagacatttcagtgatgttatttaacaactttgaattcaataggtcaatgagaaaaagtctcctagattatcacagtgctttcatctcaatatagaataatatactttaattttttttagacggggtcttgctctgtcaccaggctggagtgcagtggcactatctcggctcacttcaacctgtacctcccgggttcacgcgattctcctgcctcagcctctcgagtagctgggactacaggcgtgtgccaccacgcccagctaacttttttgtatttttagtagagacggggtttcaccatgttggccaggatggtcttgatctcctgacctcgtgatccacctgccttggcctcccaaagtgctgggattacaggcataagccactgcgcctggcctacaataatacacttttaacaggcatttttatagcaacattgttttgtttttgtgtttgagacagagtctagctctgttgcccaggctggagtgtagtggtgcaatcacagctcactgtagcttcgacctcctgggctcaagggatcctcccacctcagcctcctgagtagctggggcccacaagtgcatgccactatacctggctaatttttaaaacttttctgtagagatagggtctcacaagtgatcctctcaccttggcctcccaaagagttgggattacagttgtgagccactgtacctggccagtaatttttgttaatggcatgtgaacatgactgccatacattatttatatattaagggtagattcacttcagggaagggctcataaaatctttgcattaaaacaccctctagtgagtctgcatttttctgttttcatagctggaaagcatgcctgtttagaaaattttaattctcatgaaggaaagacaaatgctaataaatgcaattccgagttttaaaatgataaaatgccctttagccacccagtgctacaaaattagaggtgcagtcatatactggaaggtcaggccaagcagaggtggagatgtcagagggagatatagctacagaacctgcctgggatcatggtcacttatgacagggaaaaatatgatgggcagttctaatgttatgaggctttccctactagtaagatagtcttgcaaagggcagaagtctctgacgatgcacaaacattgagattttcccatcattcgtgtcatctgaaataaatggcataaatatttattgtccgattctagttggctaagagctgaactgcctcatgtggggtaaatgaagctaggaactaagataattttaaagcccaatgtaaccagagaaataattgctatgagacttacagctggatacatatttaagatatctggtcttttccactgagcagatagcagaagactgctgcctgacgattgtgggcagcctggtaacatctggctccaagctaggcctggccctggaccagaatgctgacagccagttctggagcttgaagtccgatggcaggatttacagcaagttgaagccaaatttagttttagacattaaaggtaagggtcacttcctttattttctttattgtaatgtgtatgtcttttagttaaggaaaaatctattcataacttttgaaaatgatgaatgtattattagtagtaacagtaagagagcccctactgtgtgccagctgctgtgctagccactttcagtacaccatgtcccgtcatcttcacagccgccctatgaggcctacattatcccctctccctcttttctccccagttttacagacaaaacaacaacaacaacaacaacaaaaccccggaagctcaaaggggttggccagtttggccacaatctcacagctgtaactgctgaaccagaatctggccataggctgacttcaaacatttattttattataatagtgttaggctaaaaatcacaagctgaaaggccgtgattgcacttagttcggtagagttgatgattctcatgtatacacgtgacctttcattgaaaagatctaagatctcaaaggaattaacacagcctacaggatttcaatgcaacatgtgttcaatgaagctaatagggagtgaactgatggtgcttgggggagaataaatttagcgtggttgtcctcaaactttatttgcatcagaatcacctggagggcgggttaaaatagactgtggggccacatcctcagagactgagtctgtaggtctggggtggggcctgataattccttttctaacaagttcccaggtgttgccaatgctgctggtctgaggcccacacccggagaaccactgatagtcatttaaaaataacataagaatgacctaacctctgtgtgggaactcagtgaactagtgtgttgctattgacaggtgcagatggtgtgttcatgtcatctggggtaattctgctttaaattaatgggcacttttttattccctatcaggaaagtcagcacaattgtgttttgtagcgaactggtgataatgtaaccatactacatactccattaatttttttaaatttttatgagtatattacatactctattttaaatcatcactacaaaatgactcaattttactttaatcagggatttaggccaatgctgtcattaaagtttatgatgtaggggtaaagagccaggtgccgtggctcacgcctgtaatcccagcactttgggaggccctggtgggtggatcacgaggtcaggagatcgagaccatcctggctaacatggtgaaaccccgtctctactaaaaaatacaaaaaaattagctgggtgtggtggtgggcgcctgtagtcccagctatttgggaggctgaggcaggagaatcgcgtcaacccgggaggcggacgttgcactgagccgagattgtgccactgcactccagcctaggcgacagggcaagacttcgtctcaaaaaaaaaaaagttgtagggacaagaaagtgctgtaatctgatttttaaaaaacaacttttctggataatggagaacgaatctggacattttcatcaggggctttggtaactgtatggggagcaaaagtggctgtcacttctgaatgatctccaggtaggtagcttggccaacccacttaaaacaatggacttaggatcagacagaatctgagaagttggaaagatgctcagaagcaaacaatgcctttgccttcattaaagggggcacttagggaacacaaactaagcactgcaactacaggctggatggagaccacaaagatcatataaaatgcaagtagtacccttggatataagaaaataaatgcaatattcagaaaccaaacagtaacatatagtacagctccctcaccttacatttggtacaacagatttgtcaatatgtagacaggtgaaatactcattttatagatgatcaacctgaggttcaaactagttaagaattatgcagatctttgtttattcttattttgataaactttattgcactagagtgcttcagtgttgacaagagtttcaaaatctccagagacaccaaagaaatgtgactcaattggaaaaaatggagtttttgacacaatgttagagaaagtagggtatgtagttctcaaaggaaatctgaccaaaccttcctgttttttacaaatgtgatctgcttcctatgtccagggtggacaacactatgatccttagctagagctttcttctcttattctttcaacatgtattcacggggtacacactatgtgccaggctcggtgctagacacggagggcaccagcgtgaaaaaaaaaaaaaaaagcctcctccttggcttcagacagtttacgttctagatgcgctaggcacacaggatgtccctgacttgttacattagcagcggaccagaaggaaggacacctcactccttgtcttggctctgacatgaaccgtgggactctaggtttcttaagacttctttttaaagctccagagccccttcctaaatgacactatataaattactcaagtgcctgctgagtaagcataatgtcccgtatatttgtgaaatctcagtatctagcacggtagcaacaacagtctttttttttttttttttttttttttgagacggagtctcactctgtcgtccaggctggagtgcaatgacacgatctcggctcactgcaacctccgcctcctgggttcaagcaattctcctgccttagcctcctgagtagctgggattacaggtgcctgccaccacgcccggctagctacaacagttttaattccttgttaaactgaatttaattttctcagactgggagaatggtgccatcttgtggacatgagagagcagcgccgcacgtcccacaccccatgcaaaggaaaatataaacacgtctcttctcgttggtgcacttactagcagaccatgatttccattagctacaactactgaaccatttgttatctattaaaattgccctaagaattattagatcatgcatctgtcttctagctcatcttcttgtgtttgggaaatgagttcttttggtagacattcatgtattattccagaccacataccttgtaacaacagtggaagctgattcatgttcactttaaaaaacatgaagtctgcacaatttaaacactctccaaaggcaagagaatgaatcaaattatttctcaagaactttctagttttcatgattctagttgaatttatatgaaagtattttaagatactttacttttaaaatacaaaagatactcttaaaatacaaaaagtattttaacatactataatgaagaatgaaaagagacattgtgactttaatacttcctgaaatttcagtggagtatgctgtgtgtctctgtctcggcagagtgtagggtttgctggtagttttttccctactgctacaaacttacacataaaggcccaaaacaccttacccttgtattctatagtacatctagccatacatctagctgtgtagaggctgtagattaccaatgatgataaatcagtgtctcacaagagaagagacgatttccttcctcaactataatacctagatttattgtgtaaattcccaaacctttttcatattttgtaaatgcttcaaaggtgaaaagaatgtttatttcttcttgatccaaggaggaagcatgctttcaataccagtcactccctgcatcaaaatgcacagatttttactttgatggggtctttgttgatacatccttggtgctgaggtttatgctaaaaaaaggataagccatctgaagggatctttattctacactggaaaaaaaaaaatcagataacccttttgttaatgatacttctccaaagaaagaagccatgaggctgtttttagcactaaagtatctgaaacatccagtaagcacctttggaaaatcttacaaacattctggtaacagggagagagttcatgataatagttttacaatactgtggtactcagcatcctaaatgctatgaaattttatccaccaactgagtccccagtagtgacaatgctaccgcgtccccttatgtacttccgggtgtcatccaaacctcccctttgacctaatacagcccgttttcattgttcatgcaagtgctgttcctcgataaccattcctcccacctttccaccactgccaggactacctgctctttcctcgctggtgtctcgaatctaccatctcaccaccaaatatatgttagtctctttactccttttcccttctctcgggttttcccagttcccttgaatttcagacattgtaagagtgactgtggactagctcttaagaactgggtagaaaaaggagcccgtgaggtgggatgtcctgtgtgaaggtgctggtgccccaatggtgggatctggacagattcacccatggcaggttgaccctctcatcccacaggggcccaggcttccctccctgccttgcctccttgaggcatgcagttctacaccttgtttacttgcttacttttgctgtactggtgttaggggaattgtgtctgctatagacccttcaccatgggtacattcatcttttattattttcctttcttttagggggcacacagtatgatcaaaatcacattatcctcaacactgtcagcaaagagaagtttacacaagtgtgggaagccatggtcctatatacctgaacaaagaaggaagaagaatcttctggaggtccttccagccaccttatttcttaaaaaggacaatgctgatggaagaccagactggaaagtggatcgactcctccttcattgattctaaattcaaccttaaatcatgctgccatgactcagagaacttactcatcgtttcaaaagactatcatagctttaaaccaataatttgtcctcctttcatttcttgcctttcatttttggtagctgcttaaacaggttgcctaattagcagcttttgggtgattttgtaaaatgttatatcaagatttcaagactgtgtacattttaaattatttccaaagatagtgacaggagagaactggaacaaatttaccaactttgtggacctacaaagcccttacactttaaagggtaagacaaaggcttaagtttgaaaggtagagaactgtttagcatctgagaagaaatactttattaggcctgtaattttggttcttggccttaaacactttctggaacctttaaatatgctgcatagcacaatgggaaagccttaggtattcacacatttaaggaactctaaacaaaatactattttcctttagttcatattaaaaattaatacattttaaaaatttaatgtcaaagtctggtaacatttgttagtaggatttgagttattattttttgagacaggatctcaggctggagtgcagtggcacaatcacggctcactgcagcctctacctccccaggctcaggtgatcctcccacctcagcctcccaagtagctgggactataggcacacatcaccaagcccagccaaattttgttttttttttgtagagatggggtttcatcacgttgcccaggctgatctcgaacctctgggctcaagcaattcactcgcctcggcctcccaaaatgctgggattacaggcctgagccactgcgcccagccaggatttgaattattttaactcatccatgggctgccctagaatgtcacaaatgagggttgtttaatgcctttcttatagctgctactggaacactattatgacctaatttatgagccatccttactcatctacaagtgctgaagcaatgttacatacttttttgctaaactcagattttttagcctaatttcttgtcctcctatccacctgcatccacacatggcctgcatggggctgccttccctgcagtgttctgcagccatgcttcagggtatagctgttggtggacagcctcaggtcttgggggcactatagccactaaacgaggtgtgaaaggctcaagaggatgaccagcaattaattatccccagaaagtgaaggaaaagagacctttagggatgttgctggtcaagtcttgatttgaccggagtcaaatcaatcttcaagcaatcttggaatcctcaactgcagtaagcatttcaaaatgcaaacaaactgcttaacaactgacaagacaccagcccatacgctgctcttccaacagtgggttctagctttgaacaaaagtgctaaacatttccttgaatatattcttcctctttttgtcctcatcactcaatactggtgctcttgtcacaggtagaacagcttgtttcttttccatctattcaagtgtgtttctaattctaaaatgctgatcttctctggagtctatggtaggcaattatggtcactggaatagtttgtcttgttttaaaatattattggtgcatgtacaacagcatccaacatatctgtcttgttcctagatatatagctctgattttaggccttttgtgcataccattacaatatggtggggtaagacattctacagtagcctgtgctgaactgatctcttaaataaacttgcttctggttaactatgttgatgaaa

SEQ ID NO: 135 - DNA, 73080 bp, Homo sapiens
attgcagacggcaactccaaactaacatggcagtcagactgtgtgatgtggcttctctgcttagaagtggttcgtgggcagcagagccttggaccggggtctgtgggatttttcttaaattctgtaggctacttttttttagcatgttggaggagtgctgaggccataccaaacacttgaatctttcatttggcatactaattattcttacatttaacctattgtggtatggccatcattaggacttaaagcacattgcaattttaactgtagtggtgtatgtagcatcagaaccatgctctcgtatgtaatttttttacaatctaaattaggatttagcgcagactcaaaagagtgacaagcttttttaaaaaaacaaaaaaagttttggtatggtctgaatactaagttaccgtaattctatacattctgtttactatgtatttttttggttactaaattttgaagttatttacaattctttatgctccaaaaaaaaagttgaaattgtaaatctggctgaaaattatttgcccagtaactgttgaaagagtttgcattctgtgaacagttgtgttgagcctatcaatggaatatgcattatttgtaaaatatagcacattagtatcattttattctgagcagatggtcctatagcagagagatgctgtaattttcagcgcacacagcctactgcagctgttcacttgaatgttggcttaggagctcattcttgccacctgaacatggaaataaatgtgcaattaagtgaggagtgtttgttgtcctttctaaatcttgctgatttcagtcaatgaacactttgtatttcaaatgctatcccaatgagctttagtccgaatctcccattcgggtctcttgtagtttctacacccatccaaacttttcagtagtgatttaagtgtctttggccactttaatcttgtagctcattgtttccataactgctgggcaagggttaaccccagaagaatttttgctgtgaaaagagtgacccacagctaatattctacaaaccagaacagttatgtttaattaggaaatctgaaacttcccttttcaaattcaaatagatttgctaattataataaaacccatatcttgaattatttaagatttttaaatacagatttccaaaggtttattttccttcatccctttaagtattccctgagaaaacttagcttacgtagagaaacagcttgcagcttgtagaataaattcccacttctttgacaaggaaatgaagtcacagaggggttacaggttgttggatatttcaaaagctattctggattttgcctcatgtttttttatcatgacagcactgattcttgttcagtctgaccagtctcaatatgtccaacactgccttcttttgtaaacatctcctggcagtagagatttcttcctatatgtttatctgctaatgtgcccttttatttttcttaggcaatatgtgttttaaaagacagttttttctctttccttgtaaccctctttccctttactttgctttttttctttgcctcaagttctttgccttttctatgttaaagcttccctaaaactagcatcccgtcaattcagaattgtcagttttgagaagcagttctttgtggaggtgagagatgtatgcaatatgaaggataatcctttcagtgatgcgttgatttttagattccaccacagtcttggctgtccaaagataggtagttagtggaaaatgattttggaaaatttggggctgtggtttgtgactcttttgcataggattggttttaggaaactagatttaatactgcttaataagtgatttgtagagtagcctgaacagtttgaggccattttccccaattctgttctttatctggtgtttggagtttatagataccctattacttgcattttcaacaggcttatgtgctcagacgagaattccttgggctggtctgtttgcaaaagttgatatatttacattgttgttttcattgactggataggttttcttttttctcattaaaaagcagagtcaaggagaaacaccatatcgaagtgtttggggattttattttgatgttgtagatcagtcaccttgttggtaatttttagctgccaaggttgacaggagtgtcctattagattctaccagttagacaaagtattcatagctcattcccaagttaccttacagttagttcctttccactccctaaaatatagcatctgtttttttcttaccaatggtagagataagatattgtccatcaaaaacgttttcaatatgtaaccaaaacagtacatgttgacaaatttatatttttaaaagtactcttgctctttgatttttaagttaatggctatctgtcagttttagaatattgaacctcttaggataactgaaaatctcttcagagttaggtaggtcatttttttgttcatttttgtagcatgttaagcacttttattttctagtatgatttttagttagggttcaattctgtgccctttggtacttgattttctcatctgtggacactgcaggtgagtaaggatatgtgaatagacccagaatgtgattctagaaaatgtttaagatttaaattgtgcttatatgcatgtatggaatatgtatgtgaaaatatagttgtaaccttaagatgaataggttaatatgaagtgaaaattagtgtaggtattacactttttgttgaagcattgttgtaatttcattagaacgacttgtgtttagtgacaagtgtttaaattcttggatggagtctctaataggttgtgaaatatgaattctgacatttcttgttttctctgtttttagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacaggtaagcagttttatgtagatgatttatatttaacggatcgtgtctcaagataggagaaaataataagattactgcttgtaaataattcactgctgcaattttacatatctagattttctctctgttattacatcagcaatatgaaacttagtttaaaattttctttttaaatcataaactattttgggggcagtatatattttaactggactttaatgtactctgatctggacaggatctttggaaaatcttctaaaagtatatgtatctgggatagccagtgtcatgttaacttttatcttttagtaccctgagtgtatttaagttagcatttcaacagtgagatacaatatgtgtttgggagaggggaaaaaatcttaaaatgtgttttccttatgttaatataatcattttgcttatatatgataaaataaatggtaatgttcacattgtcagtgtataaacattttcactgatataataccaagcgtgatgagatcttatgttccgttccttaacaaggaaaggacatggtatatgattgtccttcttgttataaagataaagccttaattatagtacattttgaatattaggtgaaaatctccttagtattttttaagatttgactaaatttttagagtaaaccaaaacctaatttaaagagcacgttcttgggatagaagggttaatgcttcctgcaggagttgttttcaaacactaaaaatacatgaagttagacatacatatgaagttaaacactaaaaatatacgaaggtagacagactctgtggacttttcatgttaattaaatttgattgatagtgtataccaaattgctttacaaagcttataaccaaaaatataaaatggaatatttgaaatgagtaaaagatacttaaaggcagtgtgaagaatgagaccaggagtctgaactctcacctagtcatgtgacattggataagtcagccctagacttctggtttccattggcaaaataaggtaaaaggcagagaaaaagggggtaacactgggccatttctaagttcacttttgactttttcatacatgggactttgagctattccgttaatcgttagggctcattctctccaagatctgcaagtgagttctagagccagcccctggacttggctcataatcatatttcctcaagctacagattgagattcacagagacaacttactgaaatcaagttaaaaagctaagtacaaactgattgtcattgatccatagcaaacggccattatattttaattatgttgcttaaatgttcactatgatattaggaaggtggttcttatgtttctgaacactgataatcagatggatgagatttttcaatttcttttccaaaatgagtgtgataagcatatgtgaaatttatagtgtttttaataagttgaaaaaggtgaagaacaaaaggctgctcttacgtctctgtcgtgatgtttttaaacatctttttaacatgttttaaacatgttatcttttgtttttaaagtaaaacaacacccctgacatgtggattttgcaacctttttaatataaaagataaaaatatgataaatgacttgagggctatgacacaaatgatgcaatttctgattgcttagtagagctccccttactattaaaaagaaagatgcatgaacagagcacaaaagtcatgttttgttatgaaactgttacgaaatgatacattttatcattttataagatgaaaatattagacaaatcatacatctttcatattaggcatctgccacaggagacatcttacagatcctcacgtctcacctctagtcaatcttgaattaatcttactcttttgtgaatctttagagctgttatgtggcaaaatgggataaatttgagttctttatcttcacctcctttgcctctctaactttagtgtggtagacggtggtaatagaagcacaacacatgggtattctttaatacatacctagatactaaaaaactgtgtaaatatttctcatccatttccttcacctctgacccctgcctgttgtcttttcagtggcttgaggggaaggatgtaatggagatttccactgtggtaaaatttctattaaaaatatttggtaagcaagtagagtccccaagaaattccacaatggtcatgagtattgaaagatgtttctaaagatgtaagacgtttctatacattatatatatatatatatatatatatatatatatataatactatatatgatgtatacacatatatattacgtgtacactactatatatagtatatatttgtatatagttaacacataattgaacaaatttgtggagtacagtgagatgttttgatgctatatacattgtgtaatgatcaagcagggtattatagcatttccaaatctcaaacattcataatttctttgagagtgttcaaaatcctctcttctagctatttggaagtatactatacaatattgctaaccatagtcacccttctgtggaatagcacaccagaacttatttcttttaacagtgaccctgtactcattaaccatctggccccctccttccttcctcctctcttctccaccctctggtacccactattctgctctcgcctccaatgagatcagcatttttcgattctacctatgagatcgtgtggtatttggctgtctcacctcacttaacatagtgtcctctaagttgacccatgtttctggaaatgacagaatttcattcttttttgtggctgaatggtatttcattttgtatatatagcatattttctttatccatttattggttgatggacatttgggttgagtccatattttggctgttgtaaacattgctgcaataaatatggatatgcgtgcatcccttttgacaaattgatttcatttcttttgggttaacatgcagtagtggggatgctggatcatacggtagttctgtttttaattttttgaggaactttcataccatttttcatagtgtatttggtgtattaatttgccttcccacgatagtgtgtataagattgaaagatgtttttcaaccttcatttggtgagatactagtaattatttcttaacataagtattatattgacagacaagtttaggaagtgctgcactctgtagttctttatttaagatccatactcgataatcactgtattaagaactatgaaaaatccagcagtaaagaaaacctgtttgaattatagttccccggccttatttgatcatagagcctatttggggactgtgggaagagtgagtatctctccctgacagtagattacactgaacatggtgctataaaagcttttgaaatcatttgttgttaactggttatcagaccagtttaacctgttcacatcaataacatatgagcatgattcctaaaagaaacatatatgataataaattcaaaagtggagtaggtaaatctgaacactaggcatctcaacttctggtaatcttggtttgatttggaccactgacatatttgtaatatgggttaaaatggcttttagaaggatctcactcatttaacttaagcataaactgctttaggatatttttttttctgagtttcttactgaatacttctattgagtaaaatagtctagaaaatggtagtatctaaatctgggttctgagtggttgtactttgaaaagtaggcatacttcgtaagaggtagtactaatgtatctctagcaaggttttgaaagaatttgtggagctttggaccctgtcctgtggtgtgtagcattacccgtcttgtgcagtttctcagtacgtattttagggacagaccagagttctttggtccttctctaattatccagcttattctacctcctgggaagcagttgggacccatttctgtattccgattttgtaggagcatgtgcgttaattgggttacaggaaaactctggagtcactctacaggaagatttgaaatctttccttttcccttttcttaaatctttcttaatgctgaatcaggaaactatatctaaggaacaaaaatatctagttaggaaagtgtgtgcttcttaagtccttgaagagagtgtataacttttagactgtgtcagtgttagcaaattaatgtcactattttgatcgagtgaggattagggaagtacattaagaaatgtcttcagtagcaaatacaataatcttctctctagactaagttctatttattatgttatttgtcaggtccgtctctttgggcttctgcccagctgtatgcttcagcctgtttcctatctataggcattcatcatgagaagcttctgctgcttgtacagcttagctgactttagtccatccctttgcgtttttaaatgcacttgggagtccttgacacctgctgatgctgcattctagatgaacgaaatggattttatgatgcaaggaatgagtaataaagtgttacagtcagaaaagccctagaggtgaccttaaccaaccctctcccttctttgccccaaacatcataggtgatgagaggcccaggtttgtgaaatgactagttcaaggccacagagctattaagcggtagagtagggaccagaattctgattatcttatgctttacctggatgtttcctctttgccacttgttggaggcaagagctcactctttaaagatgaagcaaatggccaactgatgaatttatagagagatgtgtgatttttacagagttatccagagggcatcttctggcgagtgtgtcttctctggaaggagaatggaaggtttttgacagtaaggactgacgaatacaccaaatgaacaagaacatctgtgcttctctagaaacattataatctatggttgtgaacttgatattctagcccggtggtacccaaatttggctctacatcctcacctactcacctaagggagttttggaatctgttgtcagagagcttcccaggtgatcttgaagcccaaaaaagttttgggaatcagactgtgtctcatgaagtatggtcacaggattcccgcattggaatcacttgtaatgagtgctagaaatgcacggtcctgggctctgtccaggcctactgaatcagaatctgtagtggggacctggaaggtactcgttagctaggagttatcaatgtcttaaacattttgtagggagattgaaccagggatttccaggtttacctgaattctagatttagggcgttatggaagaggtgttaacaattgcagtacttaattctttggaaagtttaagtttaaagtgctgtcccctcttcagcattggtctctgagttaattcctagctttcagaactagacatgttgagtttacgtcactaggctgtgtccttactgatctgatatgttgctgaaagcacgtgtgcgagcatgtgtgtgtgtgtgtgtttaagtgtaattaggtttttgaaactccagggtagattgttctttcactgttatttttcctttcttctaaaagaatggctagaggagtagttggtggaagacctcaggtaatgagtatttcaccattactctcagttgtttgaggtaggtcttgtactgacctcatcagctgctaactagaaactttgacaaaaggggaaaaaacaaaaacccaaatataaattccagagggcccaaagagatgttgattacctctgagtaggtagtgccttgcatgataaggctcctgccatgccccagcacgccttagggctagtatcttaaaatattttttattaatatgagtgttcttagctaggtttatcttgtgtctctgcttgctgagaattttacagctagttttgatccttctttattctatcaaaataatgtgatttccaaactattttaatggcataggattctcttctttttaaacaaatacaatcttagctcctcaggattgaaacagataagtggtattttattagactaatgggaaccttcaaatttaatagcacttatttcctatgagtcaatcacagtgaacacaaagctgttttgatgaacattaatttgaaaatgtgattttgtatgtcagttacagttgtacagtgagcatgtgaaatgtccatagtatcaagagatcaagaattctgattcttgcagaccagtagttggaaacagcagggtggttgggtgggtggtaacttaataaacacctcactttgcaaactctgtatgctatttaattagaaagatggcagaaaggttgtgtgtgttcttaggtctgtaggaaaggagatgcctgcacaggggtaaatgctttggtccgcagtgcgttaactgtggaatacagtacatttgaatctatttttagattttagtgcccaagtttgtataaaatgaaatttgtgtcaagtttgtggaacctctatttttggaacatctctcataggcaaaaggtaatggagaaactttatttatatcttcattgatgtatctttaaacttaattattttttcattatatcttgtttctttgccaaaggtcttgcagtcatttaaaaaatttggtgttatcactgtagaagcttcatataaaattttggagaaagtctttaacatttattcttctaggttcactttttacttgaacctgggtatttttatagaacaattttcagtgtcagccttgattagtttagtggaaagattacaggatgatgaaactagaaatttgtaacattttaagaaatcaaatacagtacagttctttatcattgttaggaaaaacaacttctgtcctcttttgtttagtacctggggacttggaaattaattggagaaatggcacacaatttttgctcgtattttgtgtttgggagttgacagaaaagtattataaaactaaagtggtcagggttggggggcttatataccattttaacaaaggaaaggtttggactttgcggaataggaaatcatggggaagcgttcagaaaatatgtaggggtaagtaatgacaagataagggcacttttaacaaggttggtttatacagaactgtatgcataaacaatctgatgttgactgtctcaagtaatgagtcgcttacttctgaactggtacaggacagagagacatcttcccatgggaaatttatactctgcttttagggagaaaaggggagggcagagaactcatcttgcatctgttgacttcttattttcctcagcctaaaataatacttgatgccagccaggcgcagtgattcatgcctgtattctcagcactttggaaggccaatgcaggcgaatcaccggaggtcaggaattcaagaccaaccatggccaacatggtgaaaccctgattgtactgaaaatagaaaaattagccaggtgtggtggtgctgcacgcctgtagtcccaggtactcacaaggctgaggtgggagaattgcttgaacccaggaggcagaggttgcagtgaactgagatcgtgccaccgcacttgcatttcagcctgtgtgacagagcaagactccatttcacaaaaaaataataaaaaaaaaaaacttaatgccaaagtggaatattttggggtggcaaatctggaccttttcaccattcagtaagttaattcccagttaacatctcttcataaatcaaagagctgcttctttagataacctgtggtaatgaagcctttaatggctagttgctaggatgaagaaacatctatttgaggatacagaaaagtatgaaacaatattcttctctagtaattcattaatcatccagatttgtttctctgatttcctgatattgatatttgtgttacttggtattttgttccgttagaataaaatgtaaaaaaaaatatgtgtcactcccacgagacagttatacagttttccaacagctgtcttagagtgtttactgggaaaataaagttgaacctatggtgtaaatgaggtttaggagttttgattttgtgctttcctagcccttatcagaggaacttttagaatagccgtatttgccttaccagtagattaggaatagtcttcagtaacctttctctttgttgctttgctggtttgatagaaaacacaaactttgtaaacatattcaaattcatagaaaataaaattacagttgaaattctcttgtaacatttgcccctttataattcagcataagagtgcacgtgtgctgtttgctattccagaccttttctggggggtagtctttgtttactttgcatcaggagattggtggtatagaagagacaccattctcaatttaagcgcttgtcgtaggaatgatggaaaatgtcgatgaggaagatggtgaactaaaatggaaatagttcagttagaagataaaaaacagttaaattgtgatatgaacttgttgcttcttttttttgtagtttatagaattttaaaattctgtttctttggtatgaaaatgatttataccccccatttttatgatgtagtacaaaatcaacctgtttttgacagttttcattctatttcactaccttaactatgacacagctttggccaccagccttttattttttttttaactttgtttaaattcagaatagaccgaagcacttttattctgtacctgttggaacatttcctttcaaatattcctgaacagaatagttgattattggagctaaaactgtgcttcaaaatttgccaacttcttttgagcttgttctaagttaattgactttcagctgagtacactgctgctactgaacgttgagagctgtggaaaccctcagagtgtgcttttccagctcaaaaggtcaactttaacagatattttctggcattttatttgagtgtcattcgatttgtcaggtctatacagtggcttaattagcatgttttagtccttaaggtatttgttttggctctttaaagttttagattgtcaatatttcaaaacccttggatgccccttttattggtgttgggaaatgtaatcaaatattttttgaggggctgtaaatcacagagtagcatttgctgctctaagtgttgtgaagaaacagattcgcagttaaaaccatcttttcagactccactcagtaatttctgacaccatatatcatctttatgtaatcgaggggtgatcattctgtattgttctaaattagaacaaagatttaccttatgcctcctttaagggggaaaaaagcaagacagaagtatttaagctgtgtttataagagttccttggctgggtatggtggctcatgcctgtaattccagcactttgggaggccaaggtgggcagatcatctgacatcaggagatcaaggccagcctggccaacatggtgaaaccccgtctctactaaaaatacaaaaattagctagacttggtgctgggtgcctgtaatcccagctcttcaggaggctgagacaggagaatcgcttcaacccgggaggcggaggttgcagtgagccactgcactccagcctggatgacagagggagactctatctcaaaaaaaaaaaacaaaaaaaagtttcttaagtggtagtaggatttactaaacccctgtgtacactaggtttgttacttagtttgggatcaagttcttgggattaagtttgaatcaaaatacctttgcttcctcctgctagggaggtggcctactggacactaatcttagagcttttagcttagaacattgttacacttgggttccaattccagcctagccactcaatttgtgttgtgtcctgtgtgtgctttttgactctgaacgtcagtttctttcataaagtacctagcacacaggggtactgtctctctttcctgtcctcttcttaccagttaatacccattcagttacgtgacagttgcagacttttgtttttccccccataggtaaaaagtagtttttgaaaaacatcttgaagtagatctgttgtcctagatttcttggagtttgtcatgatgtgggaagaatgcaaagctcatcctccatcctttgctttctaggtgatttgaccaacataattgattttccaggggtggaacaaagtaagaatagaaagtgcgaggcaggacttgggagcccagaatgatgattaatgatattacaccagcctttatgaactagagcaccggagtgtggaattattgctctatgtggtattgtgtgaatgtttcagaatgaattagcttgacttaaaatatgaaggtgctctcaagtgagctttccagtgagctattactgggctttcgaaggtcagcaagttgttaaattgagccatgaagtgttggttagataaaaaccaactgcggcttatttttacttttattgacatcatcttccttaagatgagtatccgtttaatataaaacgtaaatactatactaaatagtctcattttatcaaagatgatgttcaagtctagatatacagagacctgtgttttgggatgttcaaaaacctaatattcctgcagtgttagcagatcagaaggctgaggaaaaaaattactatccctttgttttcttttccattgaaatattcattgaaaacatctaaagcatttcttcattcagtcatcacagactttacagatttcagtttgtgtgtatgggggagggggcagtttccatgagggtatggttaacttagcagatgcaattttacatcttgttttccttttttgttaaatccttatgcatattgtgaattagagtttatttttagctcttaatgagttcttttctcatcattgtactttttgttggaactctgttttgtacatactgctttgattttgtagggaaaatgtgtatggcgtacaagtcctgtatccaccacccccaactcccatcctctagctcaacaaaaatttgcatttcttggtgagggatgatagacttgaatgtttattaccttgtagagtagatctgatggggcccttgactctttacaacctgtttgacctttggacttaatactgagaaagtcaaatcctccttttaaagtaaagtttaagggaggcatagctgtgtgtaaactggtaaatcagaatcactgcactgtttttaaggtcactggagcctgagagaacagttttatttcctcacattttaatgctttaaatccagtcttaaggagttgcctccaagggtactgtcgtacgaatcctttttcctaaccctggtactaagtaagccatgggagcttttttcattccatttaaatgaattgtagtttgctcttattctactttaaatgtatctaaacattttgaatataaatgagagactgatggtgtatcaaatcaattgacatcttctcatgtagacaagggctctcctaaatgacttcccaaatcctgcctctaaaattgtcttttttttcttttgtgaacctgagtattaggttagctctttttaaacatggtgccaagtgattttgccattatatggtgcagacagtgtactaccttctcaagtagaatgatttgggatctaatatcttaaaatctaacaatgttataccaggtttgtttttagacctttatattctttattatttgttgtcctttttttatgggggtaagcccttttatacatattggaataggattaaaatacagaattgttaataccgatttgttactgtgttttatatcaatatgtgtatttttttaagtgctggaaattgggagcctttgcaaaaaggcgtgataacattccattatatccccagctctagaacatacaaagctagtcctgatgtgctacttaaaagtagaatatggaatcttctggggttagtttcttactctatttgatattttagttctctgaatgcttatagaaaacaatatatttggatatagccatcaaagtaaggaggatgtctaatattctttcctagcctttatagttggacaaccgacttttaaagagtcttttttttttttttccttttttaagacagtacccttggaggccactgtgttcatgaccagtgactccttgagactgggtttattaaatggacctgttagtatagtgaataacagctcttaggtaattttgcgtagttgttagtaggcaccaaaggaggaagggtgagcgttagttgctctatagattataatgaaagaaggtctcaggccagatcccaccacacatagaaacctctatctagcaagcaggaccaaattgatggagaagccttttctgaaagcttggtaaagtcccacttctctcttcttttttaagtgctttgaacacactttaaatgaaatgttcaccggaggctaacaatatcccaaaagtcacgttctgcaccctcactttgcatcatgcaaaaagaaatccctttaaacaaagactgaaacccaggaccatttaacatttaggggttctctccataaagatataaccaccttggattatgccaccttggattttgtgccctgtttatacgaaggtgggaagtgtctctaaactaatttagcccatctgcgtatcttgaactcctttaattttaccggtaagactccatttctaacactcgttatgctaattaacaaataactggcttacagaacaaaaccctattttgacatccattaggtgaatcagcagagaattggttgttgatttaggtatggatagtatgtaggcttacactagtcacttgaattttagcctacttgtattatactagttaactaatcctggattgtgcattaatgatagtatgttagatgaccacccagaattaaagcttaaatggctggtgcacacgtgtcatcagattaattctaaactttaaaaagaaatgtttttattgtggcaaaatataacataaaatttatcatttgaaccttttcaagtttacagttcagtgacattaagcacattcacagtattatgcagccgtcacccttatccatttccagtaccttgtcatcatcccagatagaaactctgtaaccatcaaacagtaactcctcacccacctcctttgctcccagcctttggtaaccattatattttctgtgtctctatgaatttgcctattctcggtaccccatataaatgaaatcatacaacatttgatataccaaagtattttgaaagtaaattatgataattgttttcaggagatactagtttttttccccttgggctgtagactcttctgtatgttttatttctcttcctctccaagtggctttagggaccaacccctccccctgaaataagtagcctggcttcaaatttagttcatgccacattccccgtaaaagaaacgtccaattaaaatactgaatttgtgcaatattttgccagattgctgactacttgcagggacttcatcttaccccctttgcagttgttctgcctggtttcaagcttgttttattcttttgaaaattgccttcaatctcttatcactccccatcttggcaagttacctggaggaagaggcagttggtgtatgtacagtgggtcagaaagaagaacccaagtagttttgctccctggaagtcttctctgccttcatacttttctactcttttctcccagagagtcagagcatccagggacaaacatccgtgtggggtcttgggacacaggacacagtgtgtaacatccccagactacttctcgttacctcacttcattctctgctgagcacttgaaggaaatcttggcagaaagccattcctcaatcagagtcaaagagcgacgagttagaaattctcttctgtagttttagttcttccatttttttctcccccttccctagtactctttccccctacccctcaaggaagccccccatcaatataacagtcaaccacccaaccagaaacccacaggacagagccatttcttttttttagaccactggaacaattattgtagttagagaaaacttaaatatctttctgaagcaaccttgggagacagatgctgatgtatgttgaagctagagaggcaggtggtttgtggcctatttctgcctttgcattatttcagattctgttactgagtagaacagtcctttttttaaaaaaaaaaatttaggtcttatatcttggcctcctgccttctctgttggcatcagccaaatgcatgttggctgcaagtacatcattccacacttagtgactggatttattttcagacgttggctattgacaactgaaaagcaatttcctgtgttggggcttaacagaaagcctcccctgggttgtaagagtttaaaataatgaaaaaggtgaatacttcatgggtaagtcttaatgcaagctttgtgtagacttatccccactgcctactttgcactcatgtttgtagggagtttccaaaagcctctgattgagatgaggaaggtcttctacctctggagctgtaaggtcttgtcttgattaaagatgactcaagcttaaccagttgttcagtagtctttgtctgagctttgggtgtgctggagaatatcagccagtgttaagttcttgatttcaagtggtgactatctgttgaagagagcctgtgccatgaaataccgtagtcctcccattatcaacagtttcgctttctgcagtttagttaactggtggtcaaccatagtgttaaaatattaaatggaaaatcccagaaataaacaatccataagttttgagttgctcaccattcagagtatcgtgattaaattttgcaccttcctgcccaggatgtgaatcatccctttgtccacattatccatggctggtacatgttccctgtcctttaatcacttagaatccatcttaacagatcggaaaaaaaaaagtagtgtatattatgttggattcagtactatctgtggtttcagttatccactgagggtcttgtaacccccaaggataaggtagggggtggaggactactgtactcggctagtggaacttcttgtggtatacctcatggttcaagggaggtagagaaggagggaattgtcatactgtgaaggtggaatgcaggatgttctaaattggtgcttgttttgttgagcgaagatgtaaagtatagtctggtccactaatgatttgttgattatttcatttgatgattaatattggatgcagtcatttatttgaacagaaatgagagaggcttttttttttttttttctttttcagtttacatggaaagacttctaaggatgttcgtggatccaagacaaacttgtctcagtcttacatttcattagggtccttctgtattggggaattctctttcttagtatattgctgatgggaaaaagctaattccagaagccagttgggtgggtcctctctctttctgcctgcctataggcaagcagccagtaaggaaccgaagtaaagtcaattaggcattttatctcaggacctagggtctcaaggaagtgatagaaggataagatggtgatgatgactcacctctctgttctgaggtgggggtagttttacttcctactacttaactccttgaagtctggttcccagcccttactcattctgaaaacgctctgtgactcttccagtgtgtttctttgtgccagttaggtagagtcagtgtacaatctagaactccattgaaacaatatttatgtaattcatattttttatctttttctatcagtgttttttaactcaaaagtaagcttattaattttgtattggtctcaatttgacctataagagaataacttttgtaattggttagaagcccctgttgtgaacttgccatagctattggtaaaggagtttgttttgagaggtgtgtatgtatgtatgcatattttgtaaataaagtcacttgtcagtgcctttcaaacaatttactcatatttgtgtcactttgttagtgttggaggaaagcaaagtttgaatttaattttgaaaatagtaggtgcagtgaagataccgatcctcccttccaagtcatctcttgtgacttcctcccccttttgattatgtttcttgggcactactttgctcactgagtgtgagcaagaacaacctgaagaatgactgagatgactactagcagtagcattcacacagcaggtctttttgaatgtttcatctctagcttttagtcttcagaggtcagtaatgtttggtgactcccattgcttttagtagctaaggagagccatatatcttgtggtaaaacagatttgcctctgaatgacctacatttatctcctctgcttatttagtggtcatttctttaaaacccttcagttaacgcttttggtttccagccatgtagggacatgtgtatgcttacaggcattatatttctgtgtcctatgggataagtagtatatgtcatcattaggtttttggacagtctttggttctccttgaaaagatgcaagtctagttttacctttattacagtatgttttttttcccagcaagtaagtcattgatggtgaattgtaaatgtaattgttcaaaaaagaatctagtcaattttgtgttcttctttgcaacctattaagatgtttgtgtacacctaaaggatttgaatgggatatctgttcaggtagcttaaagtgaaaagatggtggtgggtagggcaggggaatgacctggccaagataataccaggttatagaggattacacagaaaatctttgtataatatcttaatttggctgtagattatacattcagaaaacattcttctttggggattgtaaaaatctaccatagttcctggttatttgatttgtattttatttgtttcttgagacagagtcttgctctgtcactgcccaggatggagtgtggtggtgtgatcacagctcactgaagcctcaagctcccaagctcaagtgatcttcccaccttggcctcccgagtagctgggaccgcagacatgtgccattatgcccagctaatttatatattttgtagagacaggttctccctattgttgcctaggctagtcttgagctcctgagcttaagtgatcctctagcctcagactcccgaagtgctggtatttgggagccactgtgcccagcctgtttttttggtttgtttatttttaaaagaatttttttgcttcattttctttaagtcatagattacaatgacagagagtgcaaatgaaggaacaaattagctttgtagggaataatgaggtaaaagttctaattcctttactattagatttaattattatttttatttttattttttttcgtggggggtgcgcgagaaggataaagaagcccaaaatagtatagtaggcttttgtgttaagatccatttcagtatatatatgttttcttgctagaaagtactcttgcttgagaaaaataaagtttataatctaagtagaatccttaataatgttgttgtcaattaggataactagaataagcacttaataggttatattctgtttgggtacaggggctagtaagtgatctggcagcatacatatttaaagtttttccctgaataaaggagattagtttataatatataactattttattccttcattagaaatagcaaggaagaagttttcagcaacaaaataggaaaactcttgacagcataggctattgaatattggaatgagctgaaaaactagttatttagtaaaacattcatttcttcgagtggtgtacttgtaattgaatacctaacattttgtatggcattctacattgtaggaacctcttttaacaagagtgattctaacacgcacatcagaatctatttgtgaaacttaaggtggagacggtagaataataggtgggggcgagcatcagagagtacctttagtgcagtttcttttcccacagatgagatcccaatctcaaattcataaggctagttagctggaggccttaaactcctaacctccttttccttagggacccctttgtggtaataagatggattcttctgatccacttgtcttagccttaatcttaaaatgtgtttgccaagtgggcatgtaatgtggcccaaatagctgagaagctctgtgtatagaagttacttcccacatcagatggtccttcatattgtttaatctggtgccataaaaacatagcgccttccccaagagtgggtctcagatatgtgaataagcaaatcgagtaacttcagtaacagcagattaaagaaagcatcacattaaaagtttttaagatgaattaaaattgaagtgttgttgaataagatttttttaaccctctaccctgttatacatttaagagtacttgagatgataaaatggtaatatgttaaaattatttttgtgtttaggtttttcctgtttcataggaaagatgtatccagaattagcagcaatggtcagatgtactaagttgctgggtatatgatttagatagttcgtttttaatatactttaaagtcagtggtaaaagacaagacaagcctctgtgctctgctcattcggcaggataatgcgtttactataccatgctgatgtggatggtgccacattacttttgtgtcctaatgaatcattgtctaggtaaaatctttttagcaaaatcttcctcaaagtatccgtgaattttaaatttggaggattacaatagctaatcacttcaacttttggatgaggtgatttgggaagaaatgcttatgtgtgatatgaatgtggcaatcgtaggagctgcaccattttgtacttctctttaggagccatctgttaattggtgggcaagttgccctgtggtctcagagtggtttgctgtagcataagctgtccctgagcaaaaacaaaattgatacttatttctgtcagggtacctctttgacttaattcgtagccatggttcccatctgacccatagcctttacaactttaaccatgtacagctcaatttcctctggggactgtgttccattaggattccttttctttattgcttcagagagagtgttcttgaggtttgtgaagctgtgtctgtagtatttaaataggtttcctttatactcagcatttatacccccaccagcccaaacaccatcagtctgttttggaatttttcctaagcatgtaaaaatcagtgctgtgtgtgactattttaagtttagaggaaagaaagaaaaatgttcctcctaccctcttgattaactacctcttcattaactataaactaagcaacatgtcctgtacaaagagaagaaaaatcacgttatttatacttaatccttgtgtcgactggggacgatggatgtcctttggaaatttacttcctttgtctttgctaaaaatacctctaatttaattctgctctttctttttgatataaaaggaattacagtggacattttccccccggtggaagggttgtacatatcggtctatagcagatactttatgatcagtacacataaggtgaaatatgtttttattgaaacacctgatcatgtgatgctacccaatattcccttcttaatgactcagcttccctccctctttcactccttttctaacttgatgtcaccatattgtatgcgaaggacgtaggtatgtacgtgcattcacaaggcatgtgtaattttgcagttgctactcagttaaaaataaggtttgttaacacttgcagtagtttttccccatttactgtggtagttattaacactttgtccactcataatagcagcttagcttggtcggggggcagaaagaggattgaggtacttgtttttacagctgtgtaaaggaggtctcagaaaatcgtaagccctgcctgatgtagtcatcttgggtttagctttttggtggttggggttatccatatctgttagttttatagtgcaagaatactttcaaggctgctgagttggtgtgttgtattaatctctgggtattatggttcaaaaggtttcttgcccttctagttacttttacaaaggccagatgttatcatgccaaggaagtatggatcctcctgggacacaaggagttgctaggtttcaatcctggccattactctagaaggcctgtaaccgaacccaggttcagctgcttgccacttgaaagccagaacacaagaggcaaggattggtggaaggaaaagcatttttaatgggagccagcaaactgagaagatggcaaactagtattctaaagtaccatcttcaatttaaaaatttaccgtagggctttcaaagggagaaaggtatgggagacgtgcagaagtggtgcaggatctgtgtgtcttgttcagtggctctctcaggtgtctgaaggtctaattggcattatcttgactttggctcagtggtggtggactaattatgactcctcctaatcatgaggattttgcagtggggactctgttcctggtttgtttcaagattagcctgtgggatttcttaagagcctaagtagataagcatggattgcctaagggggagtgtctagagagggaaggaataaagagttgagaggggagggaagaaggaaaaagaatgtgggtgatttctaacactgaggtccctagttacagtcttacatctgcatctgctcagtgattataccaggccactaaggtgactgtccctgggtccctcgtgtgcctccttcctcattgtgcctcagtgcttggtgcatcctgcagtttgtctgctgtaaaccttcacatgggccagtcttgcttccaggatggggggtcggtttgcttacctctacatagatgccttacgttcagcgtagtatgcttttggcttgtctcttttatacttctttacaaatttgttcttctccatgttcctattaccttaatttgtttgtcaggaaacacctgaatttcatcttctctgttttgacacactaaagagttctctttttcaagctggtcctggttaagcctgaaacccctgcgatgcactttatgtatttcatgttcattaggtgcctgcctctctcccttgtttactgtgttgggcttaaaatttttgagcatcttagagggcagagaccatgtggtattgatcccatcttttttccaccgctatgaaatcatgctatgcgtatgaaagcattttaatgcaatctgctgaggagagaaatgtcttgtgtgggagaccgttttggcagtagcaaacatgtttggctttagccataagaactgctttctgagtttggaaaaggagtatgtaaatcaaggcccattttaaatggatctttttataatgcagatacctctcatctatctgttttgtaatgatggatttgttttgggggcttaagtggtttgtgcacctgcaggatgtccttccttttctttcaggtcattttttttttctttcacagatagtctcttggatggattaagaaagaattgaagttccagtcaatttatttcatgacaaagaacaagaaaaaaatacagatgtatttggagattataaatattctgattggaaagttgtaaactttggatgtacaggattctgccacaaagtaatttccacacatggccaaaggcaacaaagtgtacacttttgaaagactgagtttggaaaggttgattgtagtgtggaaacccagctgctcctttgagctagctgtgtgtgcccttgagcaagttaacttagcatctttgaacctccaactttatgtccgtaaaatggatacagatgtatttacatgtagccttgtggtgagaattaaatgtgatatatgtaatgtaaggatcctagttgcttgatagtttagtttggcagtggtactgttgactgccagacaggtagacatagcatttatggggcagtgggaatgggcatttttccccgacaaacttactgactttttcatactggaaggtttgggctggtgaacctttaacttttgggtgagagagtgatttttttaagaaaaatgtgttcaagaagaaaatttatctctaacgagaatttttgtttcacatggacttggtgagtttgttagagtctaattttatagtttcccgttcttgacaaaatggggagctctccatggtggtttgcagggactctgacatagtttcaaaacagggcctttaaattttttgtttcttgtggtatctgagttaaaaaatgatcttgtacagagagaaaaacacattaagaagctgtactgcctcttgatggactgcttagtggggggggtgtgtgcgtgtgtgtgtgcaggcacaggcaagagtgcatgtttgtgaagattgacaccagctggtcgcacaagcaacagcagatgccctttttactaccacagttaacttgttttcctctaccacaatactattttgaggaatacagttcctttgccttcatcccaaatggtatatacttgaacaactccattgtcttttaagtaaacacaagataaagcagataatataagactgttagtgtgtgtgggggtgggggtaggggcggtggcggatctgtgtagaattaattataattaacaaagaaatgagaaagttgcagcatacccaaacttttaattgaaagtagattggactagcctagagttgttaatgtcctaaccttttttgaactgtcaggtatgactttcaggctatctgaaggtattttggcatttgctctatcctggtggcagctccagtgtttgaaggtagaactgctgacctatcttttagagaaactacctatatcaataagtgatgagaaccgccttttgttttcattgtggtgctgagcgtgctacactatctcagtcactttctttcaggctggagaacctgctttcaggtagagtctcatcctgtgggttgtagaggaattggtttattttcctactgcacataatttttcctcatcttcctggtcttggatgcaagatatctttgtgtacccggtgtaatacttggcaagaatttagaggatttaatatgctgtttctgttctcaatagtctaagactgaattgtgtgggagttcttaatgttgtctgaaaatgtgatatattaagaacccacagtatcgccaacttaagcagggtcatgccgcattgccagcagattcataattactgggactggaactacaggaaaatagagctctaccagttgcataatcaggggacagatatggctattaaaattaacttgaagggaaaatgccctggtgctgaggacattaaccgctctctctagaattaggctgcttaggtaatatttaccaaatgatcactatttgcagctttgatttcagcagaaaagttatgatttaaactcttctatattagctccatgtatctgtaaagtcctgaaaatcatttagaaactttggggcctttcagtctcaggccagctttattagcatttgggtggaagatgagtcttcgagtgagccatctgttttctgtattatgtgagtgtctaggttgaattctccatccttgtgataatccctggtaatgtcctttgggaagctggtagaaatgctcccagctttcaggaaggctggcttggactgtagtaataggatctcaccagtcctccatctcacaatttgatcttactcattagagggcagcaaggaagacctgtttaacttgacccaccttaacttgagtgtttaaatggaaggacctgctgcatctggcatgctacatttgaggagactcaggctaagtcaggaattaaaatgtggagaaaaacgtgactagagagaactgcatccctctgttctgagattctctcaaaccttttccctgctgtgtggtacccacatggttttgctgtgtatcagatctgagatattaagaaagctcctttgtgaagtctggtgcgagttgctttggtgccagagttgcagtgcacagcctgtctgaacagacacacataatgagtgcccaagaacagtaagtccatctgaagaaatacaatatatttgcaactttattgtgtgtttgagggaggagagagaaggatatcaggaggcaacagggtctttattaaaaacaaaaattttccccctttgtaacgaaaacttgtttttgcaaatcaaattatttgcttttttttgtcgttaaggcatgcagttttatgcaagagctgtgtttggaggaagcgaatctttccattttgctttttaaaagtattgcattattaaacctcaggttgcaagtcttccttgacagagaggaccatagtgacctgtttctgctaactgtgggatttgaaaaagattcacacggcttttattcttttatttcataaaacattactactgctgtaaatggaataatagatacacatcaatcagtgtagtcaccttttattgttgattcaactaccaggtttttacagaattcactctgcattttatttgacttgtacatgaatagtctcagcagacttaattatattagtgaaaaagtactttcaacaaaattatatgctgacatcccataattcatacttaccgatttgtggaacagatttatgtaaatctatcaaattactctagatgacactttttaaaattgagacttcatcttaatggtatttgtagaaatttttcgtatgaacaattttacatgaactatttaaaactcgtatgacttccttatgaaggcagaattactataacatttgagcatcttgtctccacaagttctgtaatccatctggtacaatgtagggacatgaggaacatgtttataagggcaactatctcctaaaccacaggctcctggaaggcagatgctgctgctccttcatttgtttttcattcagtcattcacagaacatttaatgatctgtcttagggtcctccttgtcaggaactatgttctgcttgcccttgctcagcagtctagtgagggagcatccaaatggaccccagacacacataacaaagataacggaataatataagaagctgtgggaggactagtcgagaggagcactgtacagtgtgcactggggatggggcaagttgtggcaggaaatgacttcagagagtctcaaaggatacatgggagttggctagttggagagctgtgttccagacatagagaactgaatgtgcattttagggtgtatgtgtaggagtggtggaagatgagcgaaagtagaagtgagcaaaaaactgacagtgactggaaaccagagtatggttagatttgtgttttaagaagttctcctggacaatgttttggtggaggatggctgtttttggaattaatgggagtctaagcaagggttgtcctattaggatagtgtagcagtgatcagggccagaataatagagaaccaatgctaacgcagacaaggggccgatttagctggtaggactggcagaacgtgatgcgggtgtggcagaacttgggctggaacgtcttgcacatcttcactgttagacttgagctagttccttcaagccttggatcaaatgttacctgcaggatagggcctgctctgaccattgtatttaaacagcagccctgctcctcccctccccactctcaccccctgctgcttttttctccttagctctattttcttctaataccctgtagaatgtgttcctgtcagaatataggctttatgagaaagatctttttctcctttgcattctcagggcctagcaaaaagtatggttcccatagttattgaatgcttattgtagatgagaaatttgtagggtgactcttgttttttttaaatacaaaattttattttccacaattttgtgttgagggtcttgtttaatattggttggataaagttaatatacttttaatcaagaattacggtagtctattgcctttacctttaaacctgagggggtaatttgatttttctgaacattggtagtaatttaaaatagaaaagactaaataaagtgacctttgaatgaaacaggtccagaagattgtgtatttttaattaaaatatgcaattaaaattttaattaaagtagggtattaaaacaatgtaggtggcaggggaatagctgatgctttgaattacacacagtttgggatatattgccatttactgtgtttcccacagtagcactttgccactaaacgggttttcttcctgttttcctctccttgctctgaaccctgctctcagtagtctttggtcctcttcagaggcctctggagtgcttcagctctgtggtatagatcccttgaccatgatttctaccagcctgtttataactgttctccttgtgccaggagcatcttataaactatttttctatctcttgtgaagaagggtttcttttctgtggcatgtatgttagattaaaaagaagcgtgtgaaacaaaaggcattcatacacaacagtgcagcacagaatatagcaaaagttctagaatccctaccaaggccattaaaatcaagactttgggccaggtacggtggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacaggtagcttctgagaatagctgaggacacgtggcattgagcctcttctttatgttcagttaccaggcaaattttttggcatttaaagacaggatttgtttttcttaagggcttttttttttttttttttttttgaagagccttagctttgtcattttggtcagaatagtcttttaatcatgttggtttccataatggttgtacttggaatttaaatgtagcatcttataaaactttttaaagaaatgaatcttagtttggggattatcagtatgcacattctaaattcagagagacttgaaaaataggtttggatgatatggataagtgatgcttggtttccaagccttccctggtggcccatgacttactgatgaatataagagtgggaaaagggtaggtaaggtatttttttttgtaatgtttgccttgctactgcttttatttttaaaaactgtgcgctcatttataaccagaaatatgcactatataaataagatgcaatttatgttgtcataggaatgaataatggcactgaaattcatatatagtaaaactgatatttgtataaaaggtacagaagtttgagatagtaatcaaacaagaaacaacttttgcggtaaaagtgtcagaagtgcctggttacgttattattcaggcatattgggtacaaactagtcctgggcttatacgcaatatgcctgaagtctcagttcaggtataaactagttaattgagtggagtagagcacagcatttgaaagtcctgacttcaagtcctgactttactacttcctccctgcctttttgatttgtagaagctgattgaccttgccaagcttcagatatcatttctaccttgtaggagaagaatctgaataccgaacatggttaatgtgaagctacaattaaacagtaaaataccatgtagctaaaaggtgagaatggggaggcttgcctatcttggtatcatctgcgatacccttaatatattttaaacatccaataaatatttgctgccttgattacagattttcactgtaaagtaatttaaagttctaactcccttttgttatagtgccaacattttaatacaccaacgatggtaggtttaggaatgcagtcttttaatagcagataccccctttcatattattttgcttaggataataatacagttttgcttacctcaaacatattctgagtggcactcatcctaataatgccactaggcaaataagaaactttttataaggaggcaaagtcatttggggataaatatttctgagtataaacaacttaacagatactagatatttgactgactcatatagctagtcatgattgcttgagggtatcaggtggaagacccatttgatggttgggtcttctgatggtggtggtggtgatgatgataatacctttggttaaataaataacatcagtaagtttctcattctttcatttagcaaatgtttccatgcctacagcaggccaggagtaagggttcagaggctagagtgggaaacagctaagtaggaagtaagcaagacaggcttttcactttacccagtgatctaatctcagtaggcactcttgtgccccagacagacctcaggaggccaataaactgtttctttgaagtaataggtaacttgaagattttagaagaaacacatccacgtgtacctaaacaacgcaactgtgaaacagcagtcatccctgcaagacctttcttagacctcccagcagccccgttgtagccccagctaggttctcaccattaaggcagtgatttctcaacatggtggttgtacgttagtcaccaggattttaaaaagctagtaccaatgcttcatgacagactgataaaatcagagcccaaggtgggaggatcgcttgagtccaggagttcaagcatggcccagccaatgtagtgagatctcatctcatatacacatatatatacagacacaaacacacatatatgtatatatatctatctatttttgggagtgggattcggggatcaggtttttttgttttagttttttttttttttttttttaagctttctagatgattccattgcagtcaagtttgagaatgcactggggttagaagctgctaagatgcaggaggaggagtatctatcagtagaaagggcaattagactatgctgatacaattgatttattttgtcatagaatagcagtatgacaaaactatatttgtattgcccttttctttttctgttatatttgtggcatcttttttatttaactttaaatgaatatacttaaaatctttaacagtaagcatgttattttttctcatgttatcttttgactagggtgacgatccactttcatcattaatgaatattttcatcattgcatcagcaacctagttgggtaggaattaccctcgttttagagagaaggaagctgtggttcagagaggtgttaagtagcttcttcaaagttgcacagctaactgcgagccagtaaacaccagagccggtattggaagtctgtctttccactataagctggttccttgagcagattttgttacattcagccaatttaattctactcaatgacaataggactgcaacacattttcataagaggggcacaatgcatgcagtaaacacatgataaattttgaattaatgaaaagctgaatgcttaaaaatacagtggcttcacatgtgactctttactagaactgtaaaataaaacctcaattttagtgtgagatgaaattaacctaattagtttttagctctctattcctttctcttttttaaaaaggaaaaaatacattttgatagaggacatatattagcagtgattatccaaaattctgattgtggtcccaaaatataatcactagttttcatattgggcactgtatttagccttctcttttcgtttatgtggtaacaagtatccacattaggataaccagagtagctgtcctaaaaacccacattgataaccacttgcacctacggtgccccatcaagaaaaaatacctcacttccctatgaaattgatgcaacagtagtacttagtaaaagcatttggaccgtccttgggcatctgggaaatcgtcatttagtttgttttgacttttgtagactaaacttttcttatgccatttttgtcacctgtataatgtttcttgccatttcaaactgagaaacttgcttcattgaaaagttgagaccattgcgattgactttagttatctttgcattccattgatgcaactgcttttgatagctcccattgtctgagatctagggcatcagtgaaccaggagtgagagggctcagatgatggggggagggtggcaacaacaacaaacacttagaagcaacttttactctagactttttttctcctgttatttttgtttatgttctatttcttcttttcctatatgttctcattgtcttcgatgtcatccctgtaagtcttttgtgttcatattttcctgttcttatctagatcataaaaccctctttggagaaatttgattgagtgtatttgaagataagccctcgtctaaaataaacttacatgtatacacgcccacacatggttcttcaccattttagactccgacattattgtacttggtaaaggctgtaaatatgtcagggtacaatttactgaacactgacagattcttggttgatgttttctgtcttcccatttttatggctaaggaaactgaagctgaaaaggtattgcctgttaagccctctccatagcacagagatttatccccacagtttatgaagctgaccttgtcttgctgatggtatactctggctcaggcagggcatggatggtggaatcctttggggatgtgtgttttttttttcctaaacagcactgcttgctgagttctaaaacttgaaaatgtagtagacaggagacataaagacttcatgtatatttctagaattaatagagagttctttttactgttgaggaaatatgctggtgttaatgacaagaccatatgccaaaatgaaagttgatctctgtcaacagtatagaactaatatatgcctttttccccttccttttcattagggcagagcttgggatatggctttgtgaactacattgaccccaaggatgcagagaaagctatcaacaccctgaatggattgagacttcaaaccaaaacaataaaagtatgtttaaagtttttttatatctacttgcggaacagaagtttaaaaaaattaagatttatttgtagttctttcctttcttccttttgggcccatataaacagttacctgggagacatagtggaattttggtgtttgttgcaagatggaagaaactgtttgttcaagagtgctatgtataatcattcatgtattcgcaaagggggacagagcaacaactctcttagataaatgttataggaagcctacggaatcaagtctccttcccttatagagaattacttgccctataacttgaggaaaccttagacttgttcttctataaaggtctgggtagtgaataagcaaggttttgcgagccatgcattctgtcacaacttctcaactctgcctttatagtatgaaagcagtaatagccactacataaacaaatggatgcagccgttatccaataaaactttatttatgggcaatgaaacttgagattgataagatgtttatgtattacaaatattctttttattttttccaagttaaaaaatgtaaaaaccattcttagctcatgggttatacaaaaaggtggcaggctagatgtggtgcttgagttgtagtttgctctagctaattcagcttgctttgaggagactgactggaggaacttacatgacacaggttattttttctgttgtttttctttttaagacgtacagtaaataactttgtacatactttgctgcttttgtgaatctttgaaattcttatgtagattctctcttgagagggagctaatctaattcacagcatagatttcttttcctttagaaaataagagggatgtcgcctctagcaaattcttagttagctgtaccatcaatttgccctctcctgcccagtgcagacattgccagtcaatcatggcactctttctcacagagtctagatgtggctcccaaatatttttttcaaaatagtgttccagacaacttctatcaattgactcaagtttgaacctattttccacccttgatttaagaaaccagctcagactatagcctgaagtggtgaggggaagttagtcaaggctgactgtagtatccatcttgcttagagacttgtgtaaaagatttttgctcatttttttcaggtatctggaaatgaagtgtcatttttgtgctttaaagttgcttttcttagaattaccagttaaggtaatttattagccctgagtggttttgacacatcagtctttatatttattggcccctaagaaaaatgcctaccagccctgtcttatctaaatgaaagtatatagtggttcccaaatatactagggtatgagaggtccaagaattctagatacttcttgagcaagaaactgttctatgaaaagattcaccaatcagaaaatgaactggttactgtatattatcaaaatgtgaagggaaaaatgagatttccaataaagtgtaagacaagtttgttttgaagttttttcagtctgaactgctttttctcgttatctatatttctctgcatactttctgtgtcagagatcttttactagtactattaagtaacaataagtgttctttaaaaagacatccagtgttcagttaccgtcagaccgtgtgctctttatcctacagcagatttttgcaggtttcttttcctcaatttatattgatttccagcgttgctgctaatttgtcctagttctgaggtcctgagttgtagttgggaagaaaatggaataggtggtcaagatggcttgtcccaggaactatccttttctccattctagaaataattacccttatttcattctagtgtgtcagttcttttactaaatatcctcctgcacgaagatccagaagaaggtagaaatgcaggggaaataggtctccacaggagaaatgcccgtggccttcaaggagacagttgatgacagctgcttccttactgttcatcatccagccttttctctttagggcccagctgcttgggctgaatatgtggaagaaagcacagtaaagctttgtggcttttatagtgtgacatcagtttctgattttctgagatgtgggtcagggtaatgggcaaatagcaggctacttctttccccgcccctatttggttcctgtaaaaatatcagataacagctggcatcctcaatttggcccacatttgtctaagaggcaaagcagaccatttcccacaagtatatagcaccccctttgcctgtttgttctttctatgtttatttatttccattagacagattttgtgctcttgtacaatgtcttgagccaagtttttctagtattcacagctttaagaatgttttggaagttgagttaagccttttcatttcctgggatactattccataaataagtctttttccctcgtctaatctatactggtgatggctgtcagcaccactttcttacacagcaccactttactcgtgttactgctcactcaaaactctatggtgtttctctactgttttaccctatcatctggctgagttttgtaggagtgatgccagtgctattgccgttctccactgttctcagactggctctttacttgtaagctgatcttactcccagcgtccatgcatatgcttttgcagctccgactttttggtataccctttcacactcatttttagtttaactgtggtcatctcatcttttggagcccatctaaaggaattctgtccttcagcttctgtctttccaggttgttccagctcctgctgagttcccccttctttgaagtctatattctttacccttgaggaaccacagaagttttggaattacagggggacccatatgtaatttaggcttaagcactgttctctgtccacagtcagagtggagatcttggtggtcatacaatttagccaagaccaggcagttgaagaaagagctgcgactcaaacaaatccttgtcttctgatcgttatatcaaaactcttgccaggacactgtgctttactttagaaaggtacagaagattggttagtatatacaagtgtttgtgtactccaagccacttagaatttagtatgcgtttggtaaaattcctggttattgggatattgaaacagtgaatcaagtgctgtgaaaggtggtttatttagcagtttctcctggggctccctaatagcattagctcagtagggttttgtgcagtagttggtgtgttgaataaatgacagatgttcagtatttccatggtgagtgaagtgaagtccctcaggctctgtgaggacctaaagcatttgttcccaaactttggttgcatcttaatcccaagggaagtgagttagaaatacagtttctgggatccactgtagatctactcgatccctgtccacaggtgagattccgggttctgttttttattatgcttcccaggtaatttatgacagcaagtctaaggcctagcacttgggaatcaccaaagatgtttggcggttctctatacatttggtatttgtgtgtgcaaagttcagtttgtcttctagcattttaccttaataatcctcctgtggttcattctgttaaccaaaatattaatgttttttcttgagcatgctgggcgatcgtttagcattcagagttcaacgtggttcaccagcctttgcttataaaaaaacatggcatagaaattgaaaacaacgtatccgtctcatagtaggatgctgtttgtttaagtagtagcagatacaggttaaagtctcgagatacttgttctcttgtcctaaaggtcactttttttcctggttaaggagatgtcccagaggcataccttgctggtgaaatgacatcatccctgtactgcatgggaggcagctattttgggttaagcctgcccacagtatccccagtgttgacatggtaaataaagtgtgaatattacaaaaatgttttaagattctcattagggaaggtagtgaaaaggtgatatgtgtacagttcaggcatgggggtgggggagtaatctcatggaagtgtcaagttgtatgctggtgagaagaagagaggtttttctccaagatccttcaggtccctaaaggaatccttcctttggtgagttattcatgaagtgagtggttgtacctactgtgttcagtcttcatgctctttctctactcattttatttttaggggtcttaagtattgaaaaaaatctaaatagtatgtggaatttttatggcttaaagccaatacttttgacttgttaggttaacggtgtcagacttaaattcatgattagcaaactaaaatcattcatttccaagaatatgtgtagacttcctccctcctctgcataaagaactctggataggtgattatcacataacacagtgaaatggatacgtggctcccagcatctctctcagcttttccctcctctacaatgggcctaggatgctttatttttcctgaaactggggttgatttatctggaaagaaggagctgttatctcagggaatagaatgttttattgttattggtaagttctgacccctcaaaagaaaaaaaaattctgtctagaattaactaccatagaaaaactgcccgattttggtcttgattaaagaaatattttccttaatcattcagctatagaccaggctaaaatttacctttgcttaaaagttattaattggtatacaatcatgaaatttcttatactgaaataaaccacaatttaaccacatttggaaaattctattataaaaatgagaatattataaatagtattatctattttttgtgttcagtttgagagtgattaagcaaacctaagaaacctgtattctaagctactgtattgccattaactttttgttaaatttatacctttttctaactagcttatcctttcctcattagtaaatgtcatatttatacttttttttttctgttcagcatgagcttgacccttaacataggaatatagaactacatttctgaaatcttactctgtctaaattaccttactaaaatgatttaactggctgcttaatcttggacagagcttttaaccatttaagtttccatttatatcgttaaaataatttattcatcactgagaattttcattacctgctttttaggagaggaaaaaaagcttttcatggtctgctaagttgcatattaagaagaaatgttaactttttaaacaaattcatgtttattgcataaaatgatttgatgaaaagcagcaacctctcctgaagagagaataattttaattgccttcttctttcactcttgaaagtttaatagccactgtaaactttatatggggatttgagtttctagttcaacctccttttgcgacaggattattgggattgggttggtttttctttatcattataatttgttcttttataaaagttaatactggccagaaggaaatattcttagatgctgtgtaaaccagcccccactgtaaagaaggaggagagggtatgcaggcaggaatgtaagtaaagctacgctaagggcttgccacccagtaggtcctctgttaaaatacctgcagcacagttctgtgtttgagacgagtggctctaatagccataatgctgggagttcatgactttagtagggcatggaagttttaaagcagttgataggggaaccatatagaatttgcccaaaaagaaagcaggatgggaggcgagtgtgggaaatgagcctgagttatgcgttatagaagtgtgttctgggtgcgcatgtatgtgaaggcgctgatgttttgttctctaggtgaggaaggggcaccggagggttttgagcagagtagtgttgggattgaccttgagtatttattcggagaggaaggtttgttttgtatttaaacgccacatctttctcagcatttcaacccaccctagtgtttttctggcttgtgtagtttgttatttcctgtgatggtacaaagggtagaaatttataaatcatcgtctacaaagtacccctcatttaaaaacctttaccttgagcagatttggaaaatttagaagtaatagttggaagaacaggcctcaaattaactgacctacttatgagatgttagcctaataactgttatttatccagacaaaaaaaaaattgaaaaagtatatgccaggagtggggtaaaaattgaaacgttgagtaaattgttcctctgccttttaaaaaatacagactgaccgagtacatgttttcctaacttcattgttaacttgtattctggaaatttccacagccacatgtcaagttttaacagtatattacatctgattatcagcacctcttcaatacatttaaataaaatgcttctatctatattgagtcccatttacatagtccttatttgaagtgagaagtcacagatgacttttttattgttatttgtataatgcccttcatgtgttttgtagaatgctctcttgtcagctttaatttttttcatacaaaaagcccagaaatttcttactcatctaatgtggtctagggaatgtgggtaggtagcccaagtaaggtccagagcttgaatgtcctgtcctcaggcctcttgtgttacttctgttccttttagccaactccaaagtgagagttaattggaattctcaaagggcaataactaggcattcttccaatggatttcctttagattttcccacagttgttggagcagaggcagagcctacaaagagggaaggatgaggaacagggttcttggtggcagtgtcccctgcttacttcctgcctgtcagccacacagtggatagtgatggtagaagagtctcaacagttgactgaacccatctttattggaattgatggatcattttgttacctaagcatgctccacaggggtatcatagcccctcatggcagatgcttaaacttatgcaaagtatggtctataccagaaaagcctggctatttcatttctgtaaccagcatggagaatgtcaggttttatgaagacctccattggaattaaaagagtaactgcctccttgtgagtattgcttctgtgtaaggtagggggaaagccacagaagtaataacttgtataggtttaggaaattgttgctgtctgtgtgtgtgtgcacgtgtggaattgaaaggggcatgtggtggggatgtcactgaaacttactgtttatcagaaatttgagtcattgaggcagaacccttataacagctcacaggtctagaatgttaagtgcaaaattggtttccgaataataaggaggctgaggaagagattcaagcaaaccatgtgcatcatgatagaagacactgaaaatagttgaaccacatgttcaaatgtgtttgagtttgatttctaagataacagtgagataagataaattgaaactgatctggatggccaaaaatcttttcttttttttttttaaattattattatgctttaagttttagggtacatgtgcacaatgtgcaggtcagttacatatgtatacatgtgccatgctggtgtgctgcacccattaactggtcattcagcattaggtatatctcctaatgctatccctcccccgtccccacaacagtccccagggtgtgttgttccccttcctgtgtccgtgtgttctcattgttcagttcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataccagaatctacaatgaactcaaacaaatttacaagaagaaaacaaaaatcttttctacctgaacatcacactgctagcccttgttgctttactttcccactgctttttaaggggaatgtggggtagggcttttctttcatttatcacctgggaaaagtggtgctaggtcagtttggcttcagtctgttctaccacatacctggcttgtgaagttaagatgattgtgttaacttcccaagaaggagcccttaattctttgctgtatctacttttgaaacaaatttcataggactattatctttttactgttttgaattcgtgcagaaacagcagtagtctctggtaggcaaatacttaatccctttgatgaaataaagctcaggttaaaagggatttgttcaaaatgaaatagctaataagcatcagaaatgtagtatcatgttggctgatgccgtagcttttgttgttttctttccatttcacattattgatgttaaactgttttgctcagataccactctaaataaaccaactgagagaggccttaatttgggcctttgagtgtctttgtcttgagactttctggaccagatctcttaggtgccagagagtggagctgtctttgcctaggagtgaagaactctgccctcttgcagagtgagcacttgagacagccagacgtacagtttgagaagaaaactggatctggaggtcatacttagcagataagtgagttaacattgattcagttatttcagttgtaatgaacagtaaaattattattatagtagtaacttcctgaaattattttttaggcagctacgcattcttcgacaatgtttttctggtaggttcatgtaagtcgtagatgctagtttaaaggttacagaaatgtgtgttaacattggtctctctttaaatttgcgtagactctttaaaaaagcatggatggtgcattttcttttattttcacttctgccagccattcctatcattacttttagtgtgtgttctcacccgcatgtactacattagaattacttgtggatgttttatttccagaagtgtcttgacatgctgcttttgggcaatgagacagagctgtacagttgacacttgaacaattcgggggctatgggtagcagcccccatatagcaaaaagtctaacttttgactcctcaaaaacctaactactagtagcctactgttgactagaagccttactgataacataaacagttatcacatattttgtatgtttcatgtattacatattatgtgttattacaatataaagtaagctagagaaaagaaaaggttaagagaatcataaggtagacaaaatatatttactgttcattaagtggaagtggatcatcataaggatccttcccccttgtcatgtttatgttgagtaggcagaggaagagggaggggttggtctaaaatcccatattaagtgcacccacacagttcaaacccatattgttccagggtcatctgtattttgaaaacagtacaggaaatctgatacttgcctgcctcctctcccttccttctgtgaagaactcttttgaatgctgcaataggacttggaggtgtaagtcttggatttgtgttctgttcttggtttcttgatcaggtgagctgcaggaagggcaaggaaaaatagaacaagcatgtagtcctggaaactaataattcagaaaaagtttcagtttctagttttggttgttaaatgtctatctagaaatttgtgcttgccttaaccaaataaccatattcatattcctagaaagagtcattgagagaagctcctaacttcatagaatcaagcacagtggcctttttgaagaggctaacccagttgagccacatccagccagtctgggttcttggaaatatctttggatgagtttcatgggctttattttacgtctgcatttttgcatttgcaggtgatttatattcctaaatgctttgctttcaagctacctggcatttgtcttatttagaaactaacgatcagtggatggcaaggaaaagggcttggcatccgtggttgttatgagctatctaggaaaccctaatatgcccagagttttgaggattatttcaaatgcctttacacaagagactgccaacactttaatgtttatcaggatcagtggggtggggtggttgattaaaaatgcagatttctacaccccaaccaggacttactgaatctgattatctgcagagagagactgaggaaattgtatttcaacagccaccacaggtgattcttaagcagatggtggcctgacctgagaaacactgttcagtggatcttaatgatttgcacttgggtaggtctgtggtgcttattttaaaacaagtctacttgtaaaaaataggattttcatttgtcggttacatcaagatatgttgaatggctgggattcactaatgtgtttttaatgaatatagtgctggatttacctaagaaataatgcacgttctcacacacaatttgctcattttcagggcatttgtgtgtcattaaatacttcaacattacaattatgctagcataatttatttgcttctgagggtatttggagaattttcagtatggttctttagggcctatccatttaaaatgggtgtcttggccaggcacagtggttcatacctgtaatcccagcactttgggaggctgaggtgggcagtcagaagttcaggatcagcttggccgccaacatgacgaaaccccatctctactaaaaagtacaaaaattagccgaacatggtggcgggtgcctgtgatcccagctactccggaggctgaggcagggagaattacttgaacttgggaggcggaggttgctgtgagccgagattacaccactgcaccctagcctgggtggatagagggagattctgtctcaaaaaaaaaaggtgaaagggtgtcttatagagattgggagttaagttttgaaagtggcttttgagccaggcgcggtggctcacgcctgtaatcccagcactttgggaggctgaggcgggtggatcacctgaggtccggagtttgagatcagcgtggacaatgtagtgaaaccacgtctctacttaaaatacaaaaaattagctgggtttggtagcaggtgcctgtaaacccagctactggggaggctgaggcaggagaatcccttgaacccgggaggcggaagttgcagtaagctgagatcacaccattatactccaacctgagcaacaagagcaaaactcccatctcaaaaaaaaaaaaaaaaaagtggcttttaaaatttaataaaaatttgtcttatttttatagcctgccaaccaaacccctcttccttccctacccagtgtcttgatatttgagctttctagccagggcctcaataaatgggaatttgctctattataagagcttccacacattttatgctataattttttaaaggaaaaaattttttgctatatgcaaacttaatttagaaacccttttgacctgtaaaccaaatgttgccccaaagctatgtgaaagcagtgcatactcttgccaaaaggcttacagtgttttccccctgctcagagttgcaaaaatgaattaataagaaaccaaggatttttcttcatgttcttcattaagcaatgtctgaggggaattgtaaaatatgcattgtctacagtatatgtatatcctggtgcacaaagtcagatgaactgtgaaggtgaggggtaaaaacacccctctcacctttgtactttgttctttggagtattaaagaacatttatctgccaagtggcaaaggggatactatttggcggtttaattacagccagtgagtgttattgatgctatcagtcagcaagacccagggaaagggcctggtaccaaatcattcagtgtaattaaatatctcaggacgggattctcaaggtgcttctggagatctgaagcaggagaacactttgtcttagaacaaagataaaggtggtagttcccctcctcgctgcccctctttaaatttctgcaggtgttgcatagatggcaatgatatggtctctttattgcgtacagtgaaggttgtccatgttttccttaaaaactctttcttttaaaatcttcacaactgtcacacaaagggttttgggaatacagtaattattttttgttaaagctgttagggggaatatacagctcaggtgtctaatagatacttggagaatgaaggattgtctttgaatgagactattagtcttgcaaatcagttcatttaaaaaaagctttccctatggttattctctaatgtctaatcatgttgtgagagaaatatcttggtagacttaaagtcataaaacaacactcactaatgtttcaggggttatccccttatgtattgaataaatttttcatagttgcataacttatgtcagccccacaaaatatgtgtaggtaaaacttcctttggctctgtggggagggcttttaataacatttctgttattctttttccttgctttctcctttatcatacgtgccttacacaaatttccatctctgcctgttaaatgccataagcaatctgcagtgtttgctgttactgctttttaaatttttaaaaaactggtacagtttctactgattgaggattaccaaagacaggctgcccttgaaagaaagtgagctggcttcctaacttctttgtgtatgtatacctgtatacatacattagatccctgataattgtgtcaaatcagggcccaaaacactaaatcttggatagcgtatggtttacttgtaatgtagatagggcttgcagattgtgttttaaatttaaaacaggtgtttaaatggggattgttgacataaaacatcctttaagaggaagattatttgttaggaatttttctctgggtgtttgaggaatcctatttttaaaatacgttaaagatttagtagaagtagttactttatgttcaagacttcccaccccttagggctttattatattatatggaaccataacaagactaataggcctgtctccaagtttgtaggaaaggtcagtagctttaaaagatgtgcatggtgctcaccttgcccacaaaacaaagggccaggataagcaaatgtaaaagtttttgagaagtatttaattgcaagttgtttttttgttttactgagaccatgtaatcttggctatacagtgttggacagggagtatctgtaattaaatattttataaacattttgagtgcttaatgtgggctagttagctttgctaaatgtttgaacagcattaaaataagacaagaggtagccttgtccttgatgtcattgtgtagtaagggagacagcacttagtttatatgaccattatttggatatatgatgagtaagtgcagaatacaatgaaaatggatatgccacttgctgtctagaggcctctgtgttgatttcagagttgatggtgttttacaagctaggttttattgggcggaaaaagaagaaatgtattacacataagggaatgtctcattcaaaagcacagaggccttcacgtgatgtgtaccttttaggagaagcttacatctgaacaccataaagtatacttattctatcaagtaataaccttctacaaaaatgattggcaggaaaatttgattaaacctagccctgtactttacatttatccccctttagtgaggacctaatttataagagaaacaataggaatgaattttgggtggatcaagtaatttgctcgtagaaacatatttgccttgctctgcaaagatccgtggagacccatgggactcatttaagtatttacaaatggtatcaagatgaagtttctctaagcagtatttagtgtacacacagaggaaaggatcattatattttcattactatatgaagtaggtcaaagaagacttgggtttctgaacattgttgcaaagcagtttttcttctagttatagtacaaagggaaacttaactgtagatggcatttacatttaactttactaccacactgattttgactgttctcctcacctgcgttatgatgggaaactgtctctgtattctccttccatacatttctgtctgataatacttaccaacatttagattgtcattcctctgctcataaaagttttgccctgacattcaaggtctctagactctgccctcaactcactgttctagtgttgtcagtgtcctacagaaatctttattctggctcagctgggctcttcatcattcagtatggaagcctaattctccattgccttggattattctctgcctacatggccctctaaccctgtcattgataaagttttatttggccataaaataaattaataaagtggataaaaatttcttaactatacatttcctttctcatctatttggtggtctgctctctgagggcaacgggatttttgtctttggagagcagcttgcagaatgtttttatttataacctctgcatgaggaagcttctgtctattgcttataagagacagtgaagacctgctctgtgtgctcaaagacgaaaaaagtcacagtttaagtgaaattaaaagttgagattcttggaggtttttcgttttgttttgtttttgttttaatgccatttttaactttgggtgtgtttttcaaaacttgttggtaggtgtcactatacattgaagatgtggtcggatgaaggatatgtaaaggacttaacagcttttttgtttcatacaaaaacaaagtttttttatatatacatatttttaaaattatactttaagttctagggtacatgtgcacaacgtgcaggtttgttatatatgtatacatgtgccatgttggtgtgctgcacccattaactcatcatttacattaggtatatctcctaatgctatccctcccccctcccccaacccgacaacaggccccggtgtgtgatgttccccaccctgtgtccaagtgttctcattgttcacttcccacctatgagtgagaacatgtggtgaaaaacaaagatttaagtaaaggtatcccgttatgtgagattttctacataatgtccacctacccgtctcttgtcttatccacttctccttttcatgtacttctctctgtcagatcatggatgaagaagtgtatgaaagtcctaggatgtttaattcaccaaaattggcttgatgagaaccttttttcttttttcacattaccaaccggtactggttgttttttattctaagacacctgcagtttatttatgccagccagtgtgtagtccttctttagtttaacattctaactcagcattttaatctgttgacagtgtcttaggcatactagacattcagatactacacaaattatatcttaagtacatttttggagataaagttgccatggttatcttgatagtattggcatctgttcgagatgtcattgggtcaagtttcagaatcttgaaagaatactgaagccattgctggagaatgggcttctaacaattgaatgaatatatctgattttctgcaagccaatttagcctgcgttgttttcagtgaagcagcaaaagccaagttatttgggcaaatgccacaacttctaatcatcttgcttgagaggtacttcagaacaacctcctagctgggcgtggtggctcacgcctgtaatcccagcgctttgggaggccgagacgggcggctcacgaggtcaggagatcaagaccattctggctaacactgtgaaaccccgtctctacaaaaatacaacaaaattagccgggcgtggtggcgggcgcctgtgttcccagctactcgggaggctgaggcaggagaatggtgtgaacccgggaggtggagcttgcagtgagctgagatcgtgccactgcactccagagtgagactctgcctcaaaaaagaaaaacctcctgcacaaggccatggaatgtatacgttcaacaggtagtagagtccctacttggtgggtgggactatgtgagataggcatcatataagacttagtttcaaccctccctctagaagtataaaacatagtaatataaaagctttgaatggtaatactgttaacttgggaggaagctttgaggcagtctagttctctggccgtatttaagaaggctcaaaatactgagtactgactagtgagtactgagatttttcttttagtctctcgaatgtattcatagtatatttaatgaaaatgtctaaagtgaaagttttatagtggtacttgagagtgtagcctcttcagtattttttttttaactgggaaatcatattgaatcatcaggtggccgattgcatggtagcttgtaacacatttcacatgcagaaacatacccataaccttcatctcaagatagaagttattccatgaagttcatttatatttctactactgtctatccaaaagaatcgctcattttacgttttactggcttaggttcaacaggtctctacaaaagagaattgaggtagtgagaggtttaatatgtaacagcttgatgggagaaataaaattttggggccttaactgttggcccatttatagatgttgaatgtttgctctctgtatgtcagtaagacagctccttccttatgttccctccatccaggctgcaggcttcccagcacactcatctgctgtcatcttacaaaatatttggaatattcaggaattaactttaataattatcaccatggatttggaagaagcctcatttatatatgtgatttttgaactgtttctgtgttagagtgcatacattgttcttgtgccacgtctcctcctctgtgtcatctttcctgacctcaaagataatagtattccttgagtttttgttccataaattggggatgatgatgctgcataaacttattgggaggagcaattgaattaacatatgttacatatccagaacagtgtctggcacatggtaaacaataagtgttaggagctatcattatctgaattgtttcctatgtatgtatataaaatgatgttatgattaaaacatttatggttcctctgctctttgctaatagttttattgttgcatttaatacttgtaaggtttccatgaggtaagtactgtgattaacatcaaattacaaataaagagatagaagacctaaggaaatgattaactggtaagtaacagagccaagacctggacctagctctgtgtgactccataccatatgtttttactccttaacatgggagggttctggtccaaacattccatcctaacctctagtttcatagtatgctgtgtagtggccagaactttaccagttacagtgtattctcttctgctttgtataatatatttttgaacctggtgctaagctaacacgtgcttgcctcagttgcagcctattcacattacttagtatttataaatattatgtggctaaataaatgcaggctcatttctgaagttaaaagtaagggagttagcattcttaaccactactgacaattttctaatgcagagagctaccggtaggaatagactctttggtggttacgctaaaactcccatctattttttatactactttagtgtaatcaccttctaaagtctgaaaaggctaagtgaaatatacaggattggaaatggaacatggaacattttgattgacaagttcctgcttagacttggaatggctagcctactgccactaccatagtgaatttgatttcactgcctccacctcagatgccatatccactaccattgctcaattgttttattttctgttaagtatctctgcaggtaaaaaatttaagaaatggtaaggtatttatggcctaagttgcatttcaagaatatctttaccatgtatcccatttgcctttaccagtatgagatgtccttgttgaaccaacttcatactagaaccaaggagaaacaacaataaaagggcagaagttatgtaccagttgtactttactaaaaacgagatgcctgtcagggcagcctatttagaccctctttgatacacatggatgcaactgtttgggtagcatttaataaaccacactcagtgcagtgtagtttgtcagaggctgtttaagatgtgtgaaaaaggtggtctaatttgtgaagtctgtagttgatgatcagttgcttgatatacagttcttacagccaaaacactttttatttttctgtggctattcagtagatttattattgtctttaacaatgtcataggatcacttatttttatgacattacttatttattcctaggtcgcctttaagttgaagctaagatcaactgccttgactaatatttaatgatgttgcactaaaacttgaaaattctatgaaaatgagaatctcccctagtgtaaacagccagttgccattctgttttcctgttaattggtttgtaatcttataaaagggagagacactatcaaaaagattctagctattgtaggttggtacgttttaattggtggaaagtactagtctcaggattcttagtttgatttttctcttcaactcccaaataattagatttttttctccaacatctcctaaataattctcaggcattactagtagaagaattataataactgtcctaagacagtttttttgatgtgttttattatttccttatgtgtatacaagaaaatattctatgtagcaaagctaaggttcttattttctaggaatagctcttctgatgtctccttggaaatgtctgattattgtcccagtcactgtcatttcacaggaagattttatgattttgaagactgtgttgcagctaatgatgtaatggaaaatcccgtgatgaagagctaagaccgcgagtcctacacccaactctttttctttgtgtctttggaaaagttgcttcacctttctgtgcctcagtcttcctatttcccagatacaaagaaattggactaaatgatcactgtattttctttttgctccaaaattaagactccccccgccccacagcctcctatcagcaccatattactttgttgaagattgtgtcgcctctggggacttgaatccccaatttgagaaatgaaatttcatttttgaaatgattaatagaattttcattgtagtctgtacacaaagtaccaatgcgtataatgttgggtatatgacaaagattgtggcttctgttagcttttaaacagtatttcagaaataaactctcaatttaatatgtgattataaatcatcttcattacagtgagtgtgtggtagttaccaggatgtacaaagtaggatgatgacaaggtttcttatttcaaggggttaagtcagtcacaagaaagggttaagagataagtacattttggttaagtcagtatttaagaaaacaaggcatataatgcagtgtgggtgcaggtaagaggcacccaactcagactgtagtggagaggactgattagtgttgactttagggactaggtgatacccatgaggtgtctgaaatgactgaaatttagctgattggaaggagggcagcttatttttaacacagagaagtgagagcaggaagcttggaatactaccgaaggttttgtatacttgtatggaagaggtagccagtgctctgaccataaaggaataagaattctaaaatttatctgaaagtcttagggagccctttaggtaatttaagttgaggatgacattatcaaatatattccgtggtatctctgaacttctcacttgaattaaagcaattgtttagtcttaaaacattcaacaaatccagtcacgataaaatttaaggttctgtgtgtattttccactgatagttttctaaatcctatattttggaatatccgttaaagataactgccctaacctttaataccttttataaaatttcctgtttggatgtgattatttcttttagctctaactttgctggagctaatacttaatttcttattgttatcttaggcttattcattttcaacccattgtgaaatatgcccttccttattgaaaacttaatattggactgtgatacatgtatgccttgatgtgtgtttgagacttgttcctggtaggagtttgaatttagaagcagatcaaagtacacatcttccttttgggtgaattttgaggtctctggcctgagttgtggttagagatcccccttcttctgtgtactatacttctgagctcattttggaaggtccgatgtagccacctgtccaaatatccatgatgctgtcacaagacctttgctactgcttacttagagcctagagctaacttttattgagttatagtgtcatttttcagatagtcccacgaagactccatctttaaaaaatatgaacagcaattaactgtccgtttaaataggcataactgtgacctttcagctggagagattgaaaggagctttttgaaaaaagtctaaagtggcaagtgtctaattttcaggtttaatgtttgtagtcctgggtcagtaattgacaagtgataaaagttgttcagtggtgatcttagcagtgggtgacttctcaaatgtttttagtttaaaaaagagggaacttctttgttcatttatagaccttatcactttaatctattggtattaatgtccactgtcactgatctttccattgatgaatcagagaaacgagagcagttgtgtgtttggacgaaagcatttagagggacttctgatagtgatgcactgggattttaaacattgctatgtacatttaataaagtactaattcataagatggttttgtttctttgtataattttgatcaacttgtgtttgatagcccactcttagtgtatgtgttactcatctttgtatgtttaatgtatcattagttttagctgctgatgaagaaatgagcttttaattacaagtaatacactatatttcaaacggttccattttcaagacataattcaataaatatattctatctttattttgtctagtctagtcttgtttgtgaagaacagtttgagaagccatgggccatttacttacctgtagtagcaagtacttactgcctccccgtccctccccttccctcatataatctcagtattgcttgtctttgtttattatatcactcgtagcttttgtgagaaattccagaataaacctgagttttaaattgctatctttggagtagattggtgttcagtgttgtactccctgtatcatctttaaatatttaaattgcagactctctggctgcctcttaaattagatccttcacttagtagttttgacatttcataaccttgcttctcatgcattaaatattcacctgtttaagtggcagtgaaaatttaaaatccaaactcatatattaatccagcaaatggaaaatggagaacagattgcagtggagaaagaggctattttgacctcagtaggacatatgctggaagtccattgttttgaagcatttctaaatagaatttgtcatttaaagcgaactcttttgggccttcaagggagtttagtcttgtagaaccaaaaagatacttaacactttctgaaaatagcccctgtatgattctgtaggtgcatatgaaggcacctgtaagatctaaatccacaggaaaaaaaaaaaatcggaatggagaaggttgctggtaatggtcagatacaaaatttagtttggtaactgatttgatctccagagtgtgagtccttaggtaactgatctccagagtgtgagtccttatcccactatcagccttcttcccacttaggtctaaatacattttctatttataatctttttagatgaaagaagaaatgttttccaggaagggaggattttgatgacagcgatatccttgatagtggaagggaaaggaagctgttttaattccaagaacagtaaataaagggataggggtaggaccttgagccttggtctgggaggaaggagaaggcaattaccctttcttacacctttatttcctgaaagtgaacgaaaatggcattgcttactcctgagaattagaaagtaacaaaaattaatttaaaaattctaatgatgatgtgtagtttctttggttaattgtaattagtggccacttctcttttcttagaaaaaattactcttaaaaatattaatggagccgggcgtggtggctcatgcctgtaatcccagcactttgggaggccgaggtgggctgatcacctgaggtcaggcattcgagaccaggctgaccaacatggtgaaaccctgtctctaaaaaatacaaaaaaagccagtgtggtggtacatgcctgtaatcccagctacttggaaggctgaggcaggagaatagcttgaacccgggaggcagaggttacagtgagccgagatcacccactgcactccagcctgagcaacagagtgagactccgtctcaaaataataaaaagtggaataacttttaactaatttctagcaacatcctgttttctgtctgtggccagtttctctgtgtatgcctttaagaaacagccaggattcatttaatttttcccaactcagaacaagtgaactgaaacactcacttaccatagtattattgaaggaaaactggatgaggagaccaggacacagaaagagaaagatcagagtttgaacccagaattcaacactagttgtgtataaccttaggcatgttatttaccttgtctgtgcctgtttccccagctataaaatactaatatgtatgctgcctacctcatggggttgttgtgaggcacagacaaaatattgtagtttgtgaaaatgccttgtaaatggtgaagtctcataatgccctaaatgtaagtttaacattaaacattgttaccgacgtaagtttatatataatctaatcactcctgtcctgcctgtggtagtggaaaatggttctttgacaatgtcactgaaagatactgtttttgagaaggtttgtcttggagcctttttaatgtggctgggaactaaagatacaatataaactgaagagtggacattggggaaaaaaaaaatcacataactgacctaggtatgttttcaaagcctttatataagcattaaatataaacccattttcctaaatatattttaggatgacttttaagacacaccacctacactcatctgaattgcacaaagcagtgaatgtcactgcatgagtaaattgttctagaacactgtaatggacccaggtttctctctactttaaggggctgggcatttacctaaattttcagatgcatgtagaggtaaataatatttataatgtcacatagattaggctctgaagcttttcatgtggattagaaattatttaattattcctaatagccatataaagaaggtagaattgtggtaataggcttgaagaacttagttctaagttcacagaactggttatgaattaaacctagttttgagcccaggcacaccgattagctgttacctttaaccacatttccactgcctcctgtgacacttgatctcatgcagagcctgtcacctgctgctggttgcttgatcagtcattggaagttagcctccttggagaatgtgtagatgcctgccctggagcccatgggacatggctgttcataatgggagtacttcagtcacatgatctggaacagagtaacagctgacttgttgggtgctccctcctgtggaaaaaaaagccatagaatcctagatagggatgcacgtcccagctggtgaggtttcaccttttctggataattgagaatcttacacgagaaaagaaattaagttttcattgattcatattactgaatgcatatataattcattggccttgtttcatcagtttatagcaatcccaagatttgattccatctaagttacattaatcacttgaaattggccacttgttcttcacttacatttaagttccccagtcttcattgttcttaagtatttaggcatagagaaaacaaatagcgtatgaatagttatgtatgttttctccaccactattccaaattccttgtttcttctgtagaacaggacagtgctaatataacttccaaacatagcctttggaacaacaggtatattttcacttgttaatgagcaaacggtttgaataaagaagagtattaaatgttaacaccattggggcaggggtgtgaaagataacgaggtctttataaagtagtataaaatgtggcttatatttttttctggaaagccaagaaaaagtggcaacagagagctgtgggcacaattcaaattatggggaaaatgtttggtgcttcatactaaaagttatttaagtattagtgtaaattgggaaagtttgttgttaactggattaaaggtgggtaccaataataaaatgagcaggcagtagttatcactttacctcagcaaatcaatcccagacacattgaccatttttagtaataatctgaggatggcgtatattgtgaaatttctgtcccttgaagtaggctagtccagaatattacagctaaaccaaagggaatgcgatcaggaatagctcatgagactaaatgttggcaaagataggttataggcagagagtcatcaattacaattggggcaggagatctggatgacttgaactgacccttaaatgctctggttcagtaagccgttgtggatctgcatgatcaatggggtattattggatgggctttactcaccaaatgtgttagcatctatcacatgtcaggcactcactaggcattgaggatacagtgatgaccaagaatgatgtggtttcttccctcacagagtttacatgaggaatgatgattataaacaaatacatgcagacctattttgtctttcgtccttgtgggatttggtataccgtatctcaaagacatgaaactttttgaaagtacatacagtggcaggcaaagttaattatagggacttaagaccttttgaaaatcaaggttaaaaagacctgtggatgagaagacaacagacaaaggataatgagggcttgttcacacattcaaatttctgggaatttatggacaatcatacagcatatatcaaaagagcatacttactgataagggtgaatttttttttagaaatgtagcactaccacccacacagatgtgagaggctagaaaacaaaaatgttccatgaatttggaatctttaagcttagaatgattgggcctaaatccctattctagagcaggtgttcccaacccctggccatggacccataccagtccgtggcctgttaggaaccagtgcacacagccagaggtgagcagcaggtgagccagcattattgcccaagctccacctcctgtccgattagctgcagcattagattctcatcagggcacaaaccctattttgaactgcacatgcaaggaatctagattgtgcagtttttatgagaatctaatgcatcccccaccatggtccatggaaaaattgtcttccacaaaaccagtccctggtaccaaaaaggttggggaccactgctctaggggattggccccacagaagacagcctattattgtgaacagtactgtgctgtatgcaccactggtctgttttaagaactttaaattttagtgaattaaaactggactaaaggtgggtacaaatgataaaatgagcaggcagttgttgaatcactatacctccgcaaattgatcccagacccattgaccatttttagtaataatctggaggatgggatatattgtgaaatttctgtcccttgcagtaggctagtccagcatattacagatactcttccctgtccacctaggggagagggaatgggaatactactacccatttgtctagaattttcctggaaatgaataaagcagttagcacctgacttgcttgaacttcagtgttctatgctgttcatgggaaagttaccgaggcagtttttgagtttctaaagggaggtgggtgagtgagcatgcatatacatttaattttattttccttttccaggtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggtaagtagacagccactccggacagtctttccctgtctctgactagcagattgtgaaatattctgtctttccatgtagcagtcttgcttctagaacatatcaaaggtatatgtgggccagaaaatgcaattttctgctggaattgttcataaatatgcatggataaaaatagattgtggagtatagtgagcgtgcttgagtcatttccaccctgaaggtgcaggattgaagcctgtttcatggcttgtaataaatttatagatgctataatcttcatttccaagccactgtgtgataaaagcccccatcctgcttatagagtactaataaacaacctttcttttgtcaaaaagcgaagtttaatgcagcggtatgcagctagttctccaagggaggattacactacatccacactggtaattgctgttcaggctgttttccaggttcatgctgtgctgtatgggcatatgtaagagtttgaaattttgaatgttaaaaatttattttattcctaatatcactgttagcccaactgaaatgggaagactaaaatgttcattaaaactcttgaatgtaagggagttgttctgccaaatcttagttaacaaagctatagcaatatagatttgattatgaattttaaaaataaaatacagatacaattttctattataaaagcaatacttggccaggcacagtggctcatgcctataatccaagcactttgggaggccaaggagggcggatcacctgaggctgggagttcaagaccagcgtgaccaacatagagaagccccatctctactaaaaatacaaaattagctgggtgtgatggcgcatgcctgtaatcccaggtactcaggaggctgaggcaggagaatcacttgaaccccagaggcggaggtcacggtgagctgagatcatgccattgcactccagcctgggcaatgggcaacaagagcaaaactccatttcaaaaaataagtaaaaaataaaatgaaagcaatacttgttctttaggaaacagttaaaaaatagagaaacattgtgaggaggaaatattagctgtagtaccatagactgaagcagccacatgaagatttgtgaggttgtttttgtttgtttttttaaggtagcttttctcctcactgtttgtttctctccccgccacccgtataataataataccttggaggcatgttgtatattacaatgtctaattcttttaaagcagtgacttcagaagaaaattgagccagatttttcattcatcaagtgaagatccatttagttgatctgaatctaatcagaggagcccatattacctgcctctgtgttgttaattggcttcataggaagcaccacctttagagttctgagtagagagagctagcactacatgcatgcctgggagaatagcctacagattttgctgtcatgagactatttagtcaagtgagagtatataaaatacagcctccttaattgtgttagttaattcataatacttatacattgccaccctgtgttgttatcacatagactaataatggtgttaaatagaaatccaggcctagaaataaagatgaatttgttcaaagcaacaaaaatattttttatttcatttgtgctttctaattcattcattctgagatcttgtgaattgagagtaggtttcacctatgacacaaagtgcgtctcatcttttacctgctagtccatcacaggtggacctagcttgttttagtcagcggttctcaagtatgtcccgcacctgcagtatcagcagtcttctggaaccctgctaaaaatgcaaattattgggcttcattcagaacctactgaataaatctctgagggtgagccacaggttgttcttaggtatgcttaagtaggaggaccaccgatttaggtgactctagctgtgtagaggctgttttttttttttttttttttttttttttttgctaatctgatgcttttctaatggaacagctaaattctagaggttattaattcttaataggcgctagtagataagtgaaaggatttgctatcatttcactatttattcttcatacttaaggctttcaaagtgaacttactcaatttacctgaaatgaaaaatgaaaccctgcaattttcttattcagccatcaggtggtaataatgtgcaatgcatgctctttaaatagaaaaggtaaagtgataggggctgtcttagatacgcatatgtggaaaaaatgctttgtctacattagaaaattcttagtcattgaccttacacagtattaattttaaagcaagtagaccttctttctttttttttttttaagctcctccaagtatgatggtccagtgctcatttacttgccaaaaaaaatttccctgccactgcttatctcatgatgaccagctgtggtcaccccactagcctgttcacgctaattaaatggaataagctgggtttccctctacaatttttcataacctggaaaggttcttggctatcctttcccatttgtgtctttcacactggggagaatgtggggcagggagtgatcttctgtagtcaggagtgatgctgctgaggtcagaaagctttgatgctttacttctagaaatttatttatttttaaaatctacgtcttttctttttctccatataatatttttctgtaataaaatatagctagtcagaagcacaagagagcttcagagaactggaagagcattttcaggcatttttttcctaaaggacctatatcctatgcaatattattaagctgaatatattatttaaaatttcaaccgaaatgtctttctaccacagtgtatgtatttttagcatagctttgtagcatttttagcaaattcttctttctgttctccttgtttcaaggacaggaactactgtgtccctcatttctgagctgcttatccaatagcacaaattgaaaaatggaactccggtacactattgacattaaaagagtgtacgggagggaggtgggagagagagaaaacatggacatgcttgtgttttcttgtcttagctgattggaatgcatgtgataatgggtactcagattatgtaagtgacacgaatttttctaaaaatgcaaaattgtgattctaaactgaatggctagtaagtaaaggggaaagtttcctcctggtgtgattttgtgggaaatgttatatgtaggtgaaaacatgttcttgagaaggaaaaattaatgtgtcctttcttctctccttcccttctccttctgttccctcttttccaaatctttactcaaatctaccataggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggtaagtctggtttggttcttgtgcccagctactaaactgaaagagaatactcaggtttactgtccagtacttttattgacaggatctctggtttgcttttgtcagtgttgttggttttattactattaatttttcatctccatgggcacagagagaatctacttgaggaatagtgtcttttgctaatattgaaggtggggaccaaaggacagtaacctacagcagtgattcttaaccaagggtgatttttgcctcccagggaacatttggcaatgtctagaggtattcatgttggcacaacctgtgggggtgctactagcatgtaatgctagaggtcggggatgctgctaagctcctacagtgtacagcatagccccagcaaccagaagttacctggtccaaagcaccaataatgctgtggttgagaaattctaatctgtagctttctggggttatctgaattgtttccagggcttcagatttccttttttttttttcttaaaggattttattctcatgtgtcaatttttaggtcaagctgtttctgttacttcactttatagtatgtgcaccattaagggtatataacctatgtgactacgtgaagtttctacaaatgagttcctctcttccttttcaaaattgtttacaaacaggttggcagactttctctgtacagtaccagatagtaaatatttaactttatgggttatggtcactgttgcatctgtcttgtttttgtttttaaacaacctgttaaaaatgtaaaagccattcttagcttatagcccatacagcaacaggtgggaggcagtctccatttggcctgtcggttgtaatttactgacctctctgtagttcatagaatgaccgtggctttagcccaaagaagacactctatctcactgacaggtgtacatatgctaactgtttaagttttattctgatcctgggataacaaaccaggagtcattcaaaaaatctctaatctgcatgtgagaagaacagtgactttaagaagttaagcagagcagagagtttttggtttcataagcaagtcatgcagtttttattttccaggacatttttaaatatcctttttggccatatggtacactatacccagaatgctatctaaccccacactgatttttaaaaattatttccaagtgcatatcaattttatttatttcattcatgggacagaatagttaattaccaaaaatataatcacaaatataacctaataagatcaggagttatgttttctagcttaaatctatgcatttatttttttcattggaatatttgcagtgctgaagagagtggagataaaatcagttaaaaatagctccttttaaaaaaatactaaattatgttgcttgagatatgagaaggaaatttgttatgaatgccacattaaatttcaacttaagttggcctttgccgtgggagaagaggtggtactgtcaaaagcattgagccttgtacttcatgctctgctgtgaggaaaaggcattggtattaaaaaaaaaaaaaaaaaaaaaaaaaaaaaaaaaaaaaaaacctttgccacctttgacttcccatggtagtggtgatcagactagtgtgggagatgcgtggggctgcctgatgcttgcctttgtggagaaagaagtctcacaaagaaagccctttttcagctctgcacataggtttcctctgtgacatcttaagtgaataatatatgtataaatatacttttttaaattgcaaacgtaggatgaacaagcctgaaggaattttacaggtatttcctaggcagcttgtccagttaatttcagagctctttggggccttgaaaatgatctcgagtttagatagaacaaagttcttcataatgtattggttgatttttaacattgtgaagttataaaatgtttgctgttagtggaaagctatattagctactttttttttccagattgaagcaatgattttgtttgatagttattaagtaaaacaaagttcttggaatcaagattgaattcttaggaagattgagaagacaggatttgggagagtgcctgattattgaaatggcaaggcttgtaggtgactcaggtgctaggttgttgatgggtgtcagcccttaggtttacctagcctccatccctgcaggctctgtgctttttatttttggttgagtaaagctttacaggatgttcttatggtcaaatttaattatctttttctggcccattctgtgtttttatcttttagtaccatatgttatcattaacttgaaaattctttttccttcactcctatagaaagacattttggaagaagagaataagagattgtcagttgtaagggaaacttggtttcagaaaatgggagaaattgttattctctcttcagatttttaactgttgtcccattcaccccatttctcattcctcccatgatccctgtccagataataaaatatgaacgagttagtgtgctcagagatagtgtttgatctagattgggtgtgttggaagaaatcagatttcaggtttaacctgatgtttgatgcttttctttaatacagtatattgaacctggttgtcattatcttgatttccgccccactcccccttcttctttcacctgataaagaaacttgaattaagggcttgcttgttttgttggtattttgctgttttctgtagttcgagtctaaatcatcacacagatatattttgtccctgatatttgtgttttaatgctcttgccttgagtttttgtcacctttcagcagacatgtagaaaatttctcactgtatttttatgttctcatagtaccttgggagttgagagagattgagcaatataagttatatgtattatggtcaagaatacttttaataatcataaagtatgagccatatcttttatggtcaaaaagcttaaaaatccatgtaataagggttaagtttaaaggtgggtttgtgaggtttatggcttagtcaatctatgaataatcagagaattgttgtaatatgagcactgctggtctaatacgcttatttaattgactgcagttttcaaaataggacaagccttatttatttggatggatggtgtaattcaagccccttaagtatattcttgggacatgatatcagaattaaactttaagccaaattttttcatgttcttttctgtgaaacagctataattttattgaatatgatctagtgtaatgacctgtgtgcctgcttctatgagcctttatgcattttttaaaaagccttttaaatgagcacttgagttgcctttaaggcatgacgtactggttgcattatcacaatttccttttggaagaaaccggtatcaatccccttgaatacttttcctctttcttagaggacagatgataccatctaattgaataaggcagtaaggcagtaagaagatgatcttgttgtagataatttccaagcagttctcggttggcgctttggagagattttgataatcattatttgtgggattccgagtatattttcttacccatcaataacttatcttcctatttttatttctgactttaatcgggttcacatttccccttacttacatgtaggccttcccatagtccatcagctaatttttttagaaattaggcaggtactttatttttattttctacttatgaacacctagctttaaaataggaatgatctgatacatggttctgttcaaaattttgacaggttataattggagctttggtcctgttgatagaaaaatgtttatacacatctctctcctatgtgcctttttcataaattacatatgtacatgggcgtgtgctattcattaaattataaactctaatcaaacataaaaaaggataaagatgagacaatctgtattaaatgtcttgctaattactatactggttggcttcattttccatgtacctaatatcttaataaatgtcttttaaagcaagaccataaaataatttcagatatctcatctgacttcatgtgatgcatgttggattatcttgtgtctaaccttataatgtagcttgtactaagagtaggagaaataatcggctctccctttccttatttacttgtatttcccttactggtaccattctttactctgatttacatttgtagtaatctttttttaagttactttttctttaaatggaggtcattttaattaaagcaggttatccagtctaatcctccatatctgcttgctgtgttatttgtaaaatggattttgttcaggctaaagagcaggagagagtgccactcgccgcctctccccttcgatgattgctcagtcttcccccagggaggcaggtgatacacaggactgagaaggtactgggttcagtgcatctattaaatataagtaaaaaatactttattttaaatacatatttattttatattttattttaaatatatatttaatggatactttaatatttaccttccatatgtactacgttatcatccacacccctccctgagatattctggaggcagctagcttgctctccatttaaaaattgacttccatttataaatgaccataaataaaagatggctgggcgtggtggctcactcctgtaatcccagcactttgggaggccaaggcgggtggatcacgaggtcaggagatcgagaccatcatggctaaatggtgaaaccccgtctctactaaaaatacaaaaaaaattagccggacgtggtggttgggtgcctgtagtcccagctactcgagaggctggggccagagaatggtgtgaacccgggaggcagagtttgcagtgagccgagatcacgccactgcactccagcctgggtgacagagcgagacttcgtctcaaaaataaataaataaaataaaaagatgtccttgagcagtggacagacccagcagacatatttctaggggcttgttgtagtagtccttgtgtttgagctgctgcactattttctcttacaactgcctgtgttacagtttgccaactgctactggatttggagtgaatggtgcccatgtagagcacccgttgccttttctgagctcccatgggaaacatgaatctatggcaccgagaaagctaggaaatacttctgggctcagatgcatacagtcagggggcttcagcagtgcctgggcactgttttctaggttccatgcttctccctacactcgttggtgatggaggagaagaaagattagagtggataacttggcttagttccaaaggaccaatttttttctaaaatgagagagaagtgaaggaatcagtgaagatcatggtatcatgtaaaacttcacagatagggtaaaaaagatgccctatcataatttggagggtcctcggagatcctgttataaaaaattcgaaacctcctgtctggggatgccagagatggaagtgagggagatggaggatggaaaacgaaatgtttctccctcactgcatgtacagtcatgcatcacataacgtttcagttaatcacatgtacgaccgtggtaccataatatagtagactgcaaaaaattcctattgtctagtgatatcatagtcatcctaatattgtgcaatgcattaccttttctatgtttagatatggttaaatacacaatacttagcattgtgttagaattacctacagtattcagtacagtgacatgttatacaggtttgtagactgggagccatagcccataccatataactaggtgtgtggtaggctattaccatctaggtttgtataagtgcattctatgatcgtacaacaacgagatcacctagtgacacattttcagaacatatccccattgttaaaaaaggcctgacggtaattcacttcaggggcagatttggtttctaccctgtttgaaaattctgaaaactcatctgtctctgggccgtatgcttggtgtcctgagtgggtggtagcaaagcatgacctgtccctacatggatgcaattaatgggcatagatgatgtaacttttgagtgaattgataaggtgcctctgcattctgggtcttctagcactttggttggagacctcagtatgcggttctcttctacaggtagcatatgccaaatgcattctgtgttgatcattccagcaatttgataaaattgtattgttactttatgattggtggtgctaatatgtgtttgtctttattgctggtagttgtgatccttattcttgactataaaggcatggcatctttgactgtactcacctctgcaaaaaataaaaccccacatctttttacttatgtgcagacaaggtcatccaaccaatcctcttactagttttcattctggactaagttgaccataattttggtaacctcattgtctttatttggtcatcacatatttattataaactatcagtgaccctggcttgtgctcagtggtgcaatgagagggtggtgggtcaaggcacgcacacacacacacgcaccacgcacacagagacacactcacacacgaagatcttttgtcattgtgatctgttctgtttccttacactttgcataagctcagttcttctcatctttacaaaacagaattttcagtggagactgagggcagggatgtgggaggctatatatttccccattctgaaagaccagatgagatgtgttttggcttttacaaaactaaaaggtgttggcttttgcatgtatactttagcgtgacttgatgccacaggttaggtgataaggctgagacttttcaaacttacctttcacgggtgttaaagaaaaaattctcacccccacccccagtcccagagggacaaccctgggatgtctttggagagtgttgagcattgtagcagttgagggtggttgtggactatgtattaagttatgcctcctcctcagaacacataattagttggtaagcactgtggaaatttgggacattagagtggtgttttgaaactgataaagaagagtcaaatgctgtaaaactaatatttgatataggaaaaatgtagaaggttttaaagagtacttacacctccacccccacccctatttactttctataaacattttaagtgaggctcagattggcttgttttgtttcctacctggcctttgaaaactgagtaggacgacacttcctgtagcgtaatttgaatacagcatccagatcaggatctgaactcttggctttgttgcacactggagtgatggatttttcttttttccttctctagacctcagctgagcacatttgagaaatgggagggttagcttgggttgtccataaggttttttctacctgtaattatacctccttgattctaaaagatgaaagcccttcaaagttgggaaatgaaaggaaaatgtatagaattctgtaacctgcagagtttgagtatcaatgccataatttactagccctgtggtcttgagcaagccacttaaaccctgtgtgccttaggtatctgcaggcaccaacagagttgtgaaaatcaaaagtagtataaagaacatgtagctatacattgatcactttgaagctacctgatgagaaccctaaagttaactatcccagagctttcgcacttcctctctgaaaggtatcctcagatgaccgtcactgtgtcccatgtactgacccttgtagagagaaaccattcattggaagaactgtcctgtggcagtcggtgcccattagcttaaaaacgtaaaaagacccagcattctgagtcttcacatataatcagtgtacagatatcccctcggaagatggcagtaatgagcccaactttcttgaacatcaaggggaaaaattaaaaactgaagtttgctaaatgtgtgttttgcaggttggacaatctgctcaatatggcttatggagtaaagaggtaatgatagaggttcatgatactcataatccctttccacagttgattggtttctttgattttgggagtgctattcacacccctcataagtttttgttgggttttattttgcatgtgcaacctaatgaaaagctgctctttgaagcacaattgactcaagaaatttttataccaccggatgccacctggtcttttaaaaacccatcatttgtttcgtattgcgttacgacgttacagcatgtttacgtatgtgttgatcccttcccctgccaatcctgcttaattcatgaagccagttctaaatatatttctttgctattgtggatgatattcagtacagtgaataatggtcatttcataacttattaatatctcagtagtctagcatgtcactgcaaagccacacacagaccttggtcaaaacatgaaatagtttatatatttgttgggggaggagagttactaaaattcttggggatggaaaaggtatacgttcattgctataaccaacctctgtttttattttttgtgtgtatgtgtgtatttcctattctgtttagcaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattat

SEQ ID NO: 136 - DNA, 3658 bp, Homo sapiens
atgataagatacaagttatttattgttccttaaaaatcagattagttcattgatttttcaagacatgtatagagtggatttttgtttgctggtttgctttatatgggaacacaattaggagatgaaaggctgaccctttattgcgcatgtgtgtataagtgactgggtattttgacactatatatttaccagcccatgaagatgtatagatatgttgcatacgtataggtttatatgtttgcaaatatgtgaactaattttcatttttaaaaattcatattggtctagatagtaattcatatctttatttagcacgtcattgtggccattgtcctgaggagtggattacatattccaacagttgttactacattggtaaggaaagaagaacttgggaagagagtttgctggcctgtacttcgaagaactccagtctgctttctatagataatgaagaagaaatggtaagatgtaaatgttttaaacactttatgaaaagcttctttcggtcgataatatatttgtagaaatcatccatatgtgtgggtatatacatttagcttatatgttttcaagtttatgtagtatttaattgattgacttaataatgttttaaaattcatatactgctaatgtacttttgattattttcagtttttgcttttcatggaaaaccatgcttctagaaatgctttcaatccacaatacattttgctatctaattttatcgggcatgatgtgatctggtcatgcagattgatcacaaagtgaatgaactcctgtgatacaagtcagatcatgaaataaaagtttccagctctagtagttccacccctgtgtatgccctcatcacttatcctgactcctctccaaaacactgtcttgacttttaatgttataaataacgtttacctgcttttgaatttatataaagggaatcatacactgtgaatttcatgtctgtgtttttcactcctatctgatatttatgcaattcctccatattattgcggttatctgtcgtttattactgttcactgctgtagtatgtacaaagaacactaagaatccattcaatcctgtgtctctggatggggaagtgagtctcatgccctcagggacaaagaggaccctgggtggtgcactggtagtcattgggttcctttgctgatcctcctcacccacatccactctggtgtctcttggtatgagaaggaagtacttcctctggctgtattggtagcaagtctcctggtagatcatccttgccagtggtaccagccttgcctgttgttgcggaggggactccccttcaatacagaacaggagtgagctttgctgggcctcctcctattgccaggttgggtgtagggaaacagcaggcctaggtcaccttcttctgtcgtgtggaggacttaacatgctcgctcggacacttggttgatccctgatgctagggtcccagacaatttcatctttctctttccacctttcagagttctccattgcttttgtctttcattaatcccagagtttatagttgtttttagtagggagtagcagagagagacgagtctacaccacctggtcaggatcactgttattccaccaaaaccaaatcagataaaaaagtgagggcttatctagttaaagaatggtgtggtacccagaaaacccaatatgtagcttccatgtcatttatttctgaatcacaacctctaatttctcttctaaatctccaactctgagaaatatagcacaaaaatagtttgatttagtcacagtatctggaggaatgaatgcacagtatcaggagacttatttaaatccttactgtgtttattcagtcaattggggtaactattataatgcaagaattaaaacttctttattaacatgagaagaataaaagtactaagtataaacattgacgggttcatttatatcaaaattataaacatttatgaaagtttttggcactgcaaatagtggttttcaaatttaatatattgtttttgtaatgttttcataattattatttaagtgaaaattctttcttttcttttagaaatttctgtccatcatttcaccatcctcatggattggtgtgtttcgtaacagcagtcatcatccatgggtgacaatgaatggtttggctttcaaacatgagtaagttgttttgtatggcgctatataacaatatatatataaaggataaattcagaagaataatatgaataaatctatgtggaatcatagagatgaagaaagatgtggaaagttagtgaaatgctgacataaatattttacaatagaccatagtagtccatatatttcaaccgctcattggtcagctagtaaccttcttgattatcaggtgtccaatctttggcttctgtgggccacattggaagaagaagagtcttgggccacacataaaatacactaacactaacgatagctgacgagcaaaaaaaagaaaaaaaaaatcacagaatgttttaagaaagtttacgtatatgtattgggccgcatttgaagctgtcctgggtcacatgcggcccgtgggcagcgagttggacaagctcgagctggactatcagggaattgcagtgcttgtttttattaaaaagccacacttactttttttcttaagaatatcctcaaagcacaagagtagtgctgttggcatattgctataattttgttattagtagttattgttgtcaatctcttattgtgcctaatttataaattaaattttatcacagttatgaatgtgtagagaaaacataatctctctataggttctgcactatctgccgtttcaggcatccactggaatcttgaaacatatccctcgtggatgaagggggactactctgttgagtgttcagaataatgactcttactaatattatgaaaaatttaattacccttttccatgaaattattttcttacagtacatggaaaatgctttcgtctcatgaatcatttgcttaaaatgtaacagaatatggatttttctccattacaggataaaagactcagataatgctgaacttaactgtgcagtgctacaagtaaatcgacttaaatcagcccagtgtggatcttcaataatatatcattgtaagcataagctttagaggtaaagcgtttgcatttgcagtgcatcagataaattgtatatttcttaaaatagaaatatattatgattgcataaatcttaaaatgaattatgttatttgctctaataagaaaattctaaatcaattattgaaacaggatacacacaattactaaagtacagacatcctagcatttgtgtcgggctcattttgctcaacatggtatttgtggttttcagcctttctaaaagttgcatgttatgtgagtcagcttataggaagtaccaagaacagtcaaacccatggagacagaaagtagaatagtggttgccaatgtctgagggaggttgaaataggagatgacctctaactgatagaacgttactttgtgtcgtgatgaaaactttctaaatttcagtagtggtgatggttgtaactctgcgaatatactaaacatcattgatttttaatcattttaagtgcatgaaatgtatgctttgtacacgacacttcaataaagctatcc

SEQ ID NO: 137 - DNA, 7588 bp, Homo sapiens
atgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatggtgagaccttggcaaagggaggcggggactggctgtctatttcacttgaaagacactattctgagtgctagtggcaaaacaaaagaaatagaaataggggaaccagacagcacaaatgaagcaacctgacaaccaagccatacccctgtacaaaagagaatacacttatactaaatagcagtgctaagacaattcagtggggagtgggttggtacagaagaagactttccaggagaggtaagtttcattccaggtcttgagagataagtgggcatgggttgggggtatgcaggatggagacattctgggacagaggcttgccacaaaggagccagtcattttcacaggtcacctgtcgatgtaggggacagctgggaaatgtcacgtgtctgagatgaaggggtcatgtgtcagggagcagtaagagatgagttcggagaagtttaggagggaatacttcaaagggagggagatttaagtttagcttctaaagtctgtttcaggagaatggtgggttgaagccctgcacttactcactgtcccagaagaggatgagctctctttttccacttgaactactcttgcgtctacagcctggtcttgtgttttggtgtttattctcagagctgaatgcggcacttgttctggtcagttcttcctggagtacaaggaccccctggtggcagggcagatatccttcctagggtaacatgagcctgactaccaccaagcctaggacactgggcttcctgtttcataagcacttccttgcaatgcccaaaggaaaaaaaaaaaggctgcctccctgactctaagaaatattcatttcagatggaattatctagctgattttcagctccctttagtcttaggatctagtattcagaacatgcttacattaccccagggcttctgatgtcttaatcccagctggaaggtactgagccagcacttgacctcccttcctgtcagcaaagtcctcttccatctggagaagggaggactcattaacgaccactggcaaagggctttgaagtggagcctgctgagatagaaccgcaccatcaaagcgctgagaagaacagagtcgtcaccctctccctctcattcctttctcccctgtgctcagggaacagatcagtcattgagcaagatgttaacaagctgggcagccctctgagtgagagaggcaccagccccagagggcaatttgggagttgacagtcgggtgggcaaggcaaagaggcatctgtctggcacctttagtttgaagtgcctgacaccatcatgtacagcctaaactcttttttattaaaatctctctttctttggggtctttttattcccaaggtggggattgaggggtcctctaagacgtctttttttttttttttgagacagagtctcgctctgtcacccaggccggagtgcagtggcatgatctcagctcactgcaaactccgcctcctgggttcacgccattctcctgcctcagcctcttgagtagctgcgactacaggcgcctgccaccacgctcggccaactttttatatttttagtagagacggggtttcaccgtgttagccaggacggtcttgatctcctgacctcgtgatctgcctgcctcggcctcccaaagtgctgggattacaggcatgagccaccgcgcccagccaagacatcttgaagatgttgcaagctgcagacgtttgacatttccttgtggctgtctatcatcacaccagcagttaccactacttacctgccacacactctgaatccaggagcagtcacatcagaaatgtcacacgtatgctgtgcttcatccaagtttgaccctgaaactgtgacagcaaagaacagctgtcatgggaaagaatctattagcacctacccatacaatcagagaaagttgggatggaaaaggcttcatcacaaccttttatcatcgttctgccttcatgcagaaccacatctgccactcaaatgggaggtggaccacctcttccagacgcttgtcagaaaataaaattagtgcagtttcctaaggtcccgcaaacaaattctctgttcaaacaacccccaaattttcggtgtctactcccaaatcaattcttgtgcaatttaagtccaagccccgtgactaggtatcacttagtctctctcagccttctttttagacaaaataatgctttattttccttaaagtagtgaattaatatatgtaaagtgctttgtctagggcctggcatagaatttaaaaaccaatgatagctattattattagcctttcttctcattgccactttaaagttgacaggcagtttttgttgttgttttggggaaaaagagacacagagaaggtaaagccatctctcaaagtcctccagatgatgtagattagaatcctgacctaaaggacctagagccaggcatctccgactgagaatggtgaggaatatctctctgatgcagaccactagcaggaaaacagctccccaagctcagccccctctcctacagcaaacgtgagggacatctccctgcaaaccagtcagggacttggggatggggggtgttggaggtgggattgaaacaagcttctgagagaggagcttaaagaagaacaggagctcaggggcgcacaggggaatcagatgtggtcctctcctcgccacttccctcttccatcagtatctccctcagtttttccagcctggcaagaacacagctcagaatgttattcagaagctttgggattcagtggagcagggcgggtacaccagtaggaatttggaaagacttatgtcagtatttaatttgggctagaaaaatgtcctccagtgcctccacgcagaagcctgtcctattcatgggcttggggaagacgggggggtgctcacagtacccagtatgtggctagagtccatatacactgtgtgtctagctccccacaggtatgtcccacatttacctatccacagctgggatctggaattttagcaggcagtctgagggctccaggctgggaaagaatctatcacggagcctgcagctccatcctaagtagggctggaaatgatacttaagctgagccactttgcttcttctcctcaccccactgctctgcttgtacacagataacatagacccagccccggtctaggctctgcccccaacctgctcactcagaggccacttaatctagtccttgggaccagaaaggaaacatccaaaagtattccagaaattctaccccaccaggagtgttttccaaagacgagtatttcccagtttccgctacttttctcagtgtctaattttctttaggcctagattttctgtgttatgcctgcaatacaagttaatttgctgcaacctcacctcatcttatcttggtcagtgcttaacagagactgaaaaccattgaaaatgctaatttaaaaacacttttttcatcagcctctttaagctctccatgctgtctttcttggaactgtcttcttcatacctataacctctcccaaggggagccctcatggtcacacctaagaatagagttagaaaagcaccccctgcccccactcctcgtgcctggccccagactgacgcacctcctgaccactgctgcaagccgatggatgcctctggtacaacagcaagccccagctctgggtctacccaagtattacagctgctagggatgtgtccatggacaatcctaccctcaagacccaatgggtaacttcattcaaaccccctttgcagagaatgacaacaggagcaagtttcctgaaagcctcattcaccatggtaaagacagccctacgaggcttcctcagctttcaatggtgacttttgccatctctcctgaagttttagctgagttcttggcttttcctttcaagttactgacccagtagactggagacagagtggttgatttgtcaaagaggacaaccagagggacaacagggttaatagcaacagaaagatttatgctaataccatccaagcagaactattgtctctactagaattctgcggtttaggggaaaatcttaggagacttcttttcaggtttaaaaaagggagtagattgtaatcatattaaatgcaggaggcagggaaattatttatttgacttttgaggtccctagcagccccagtgctctatgagtccccagcttcctttaaactcagagccttgctcactgctctggcagtatttagaatggagacgtgcaacccactcaaagccctggcacacaaagacacttgtctctcggcccaggctttctctctttaatttcctgccactttttctatctgtaaagtattaagtccctccatttccccagtcttctttctcacagcaattcagcaaagccctccctctccaaaaacaatcaagtatttcaaggtgtctacggttggtctttggctaccctctgcttcctactgctgcccacagctgcccacctgcccccctatcctgctaaaaaaaaaaaaatgtcccagagggaaggacgcttaagaacattcctgggcctgcagagtaaagttcaggttggtggttaggaggtgagctgcagacgcaggcacagtcctcactctgtccctagttctgcccctagtggcgccagtaagtatgactccaatcctggaaaacatctgccctccatccccaacttccacccctttatctaagctgcttcacaaaggctaatctcactgtggcttcaggttcgtaatctgggcttctctccctgacccgtgctcctcttgtccccacagagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatct

SEQ ID NO: 138 - DNA, 6540 bp, Homo sapiens
gccggagctggagccggcgccagcggctggagcagcaagggagtcagggccagggccagagagccggagagaggagcccccgaccgagagcccaggtgagcccacccttcctccccagcccagccccagcccagcccagcttggcccagtctccataacaacatctcctggagcccgcagagagatcccagccctgcccaatcccttcaccaccacaagcccctgcctatctcggggacccccaagaactgggagacttgtggctggaaggcagagacccccctcccccagcccagaccctccctcacatatccagaaaggcacacactgtggggaggtagatacccagccagagaaaggtcccacttctgagggaggtacaggaactgtcacaccctcctggaaacggacacacgacatggggggacagacacggagggtggggcactcagacacaccaatgcacactcactcggggaagcatgacatgggatcagacagcctcaccctgagatctgtacagacacagatagatggactgaccggccatgaactctggccggcatacccctgcctgcttcagcccgaggcttggtaccactgctgggggaaggtggcatgcgtgcatcccacgggcagcatggagggagccacgactccccaaaaatcctgtcgctaagagacggtgccagtgctgccaagaagtgtgaaaacaggggaggtggggagggatgtgaggcttgtcacagttagagctcctgccaggagcctgaaggagctttcagcagagccctggtcctgcctcccagcccaccaccactccttttccatcagctagccagaaggggaatgggggtagggagtggatagggatagcccagcaggggactttccaacctgtctcctgcccactgcagactccacttctgagacccatcctcttcagaactccagaggcctctccaccccctgccccacccccttgccctagtttagctccctcgtgccaagactgagtgcagcgctggcacaacaccagtcgggaaatagcagaaggtgctgaggcggcagaaagtgtagatcaatcgatggcctaggagccaagactgccaggaacatccccaccccaatccttcagccctctccagccccatccacgcatacctaggccagcagcacagggcttctgagcaggagtgggaggctcaggtcctctgccctcccctgctcagaactctggtgaagctgaggaagcaggaggtccgtgaggccccagggtctagggaaggaggttaaggggtggggcccagggaccctagaggatagacccctctgctggcaggtgttccctttccagagtccaggccacctgctctgtccccacagtgacatgtcggaccctgagatgggatgggtgcctgagcccccaaccatgacgctgggggcctctcgggtggagctgcgggtgtcctgccatggcctcctggaccgggacacactcaccaaaccccacccctgcgtgctgctcaagctctactctgatgagcagtgggtggaggtgagagcagctcaggtttctccttaactaacctgggttaagcttgggaaagagggaggctgggtgggagcagtgaaagccttgcagggaaatgtgtggactctgcggcgccttctcgaggccgcttgggtaccctggagatggtgtcccagagggtcctgagattgacccagaggcagtggggttgctcccaaaggcctcatgatagcccggaggactgagagtccagtgggcaggcagcaccccaagctcagggatcagcttaggaagagaagagctggttgctggggacgtgggggcccaagaagagctggcatgactagggcagtccaggacagggaaaagtatcctcggttcccagacagccctcgcctcccttcaaccactaccacaggtagagcgcacagaggtgcttcgctcctgttccagccctgtcttctcccgggtgctggcccttgagtatttttttgaggagaagcagcccctgcagttccacgtgttcgatgccgaggacggagccaccagcccccgaaatgataccttcctcggctctacggagtgcaccttgggccaggtctgcattcccggcctccccggctaccctaccctacctccatcagctttgcctctggaagccaaaaagagagaaaacatgagctctagagctagttcaacccagccttggctcccatctctgccattcactagctgtgcagcctcaggaaagatacttaacctctctgagtcttagttttcctatctaaaaaatggaggagtggtcagagtgcttccctcttcagactattgtaaaaattgagcccaaccctagcccaactcaaagtgccaacccttgcagacactcagagcatttattattccatcccttgtacgtggccaaggcagatggggatgtcacagctgggtctccctccacctccatccccagattgtgtcacaaaccaaggtcactaagccattattgctgaagaatgggaagactgcgggcaagtccaccatcacggtaggcaagatcacctgtactcacccttggtccaggtattcaatgcccctgcatggacacctatggtgacatcatgcccaggaccacccccacctaagggaaaggggatggggtggcccttgtggtaaggttaggggagtcctgccacttgtatcccccttgcagatcgtggccgaggaggtatcaggcacaaacgactatgtgcaactcaccttcagagcctacaagctggacaacaaggttggaaccccagagtccaggcccccaactcccctgtcactcctaggcctcccactcaagacagatcccaggagcccaggcctgctctcttcccagtgggagcccatcccccaccctccttgcagctctcaccaacctcaagggccctttctcctgtatcttcaggatctgttcagcaagtctgaccctttcatggaaatctataagaccaacgaggaccaaagtgatcagctggtctggagaactgaggttggtgcctggggctatggggatgaagggagggagagtaaagtaagaagacacagacaggagctgaccagccacctggtgcctctccaaggtggtgaagaacaacctgaaccccagctgggagccgttccgcctgtccctgcattccctatgcagctgtgatgttcaccgacctctcaaggtgaagtcccagccaagccagcacagcctacttagagcaaccaatctgctatctaagacctttcccctgcatgtggcaagcctccctcctctcccccaagtgataatcacatcccactgtgggataaataataggtcacagctcaatgttaaacttcccacatgtgtgcattttatcagtggccaaagtccctagcagactgagccaaagaacaaagttcagcaggtggcctctccgggcaggctgaggatgtctgtttgggcatggagactctaaggcccaagtccccctactccaagtccccgagtccccctactcaccgtgaataccgcagagcatctccaacctgaccccacccctccccctgccttctcagttcctggtgtatgactatgactccagtgggaagcatgacttcatcggcgagttcaccagcactttccaggagatgcaggaagggacggcaaaccctgggcaggaggtgccacaaataccccacccccagaatcccacccagatccctgggagaatcctgagggtgatgctgaagagaccaccataggtgataggaagtggagagggtggaaagcacctgggctcagctgaaggacggaaccatgggggtcttgctctgggaggctctgctggaagggagaaagaggggtcacctgatggacttgtgaccctgagcttgtggggtggggtctagatgcagtgggactgtatcaaccccaagtatcgggacaagaagaagaattacaagagctcagggacggtagtgctggcccagtgcacggtaaatttcacttcctgcttcaagccttgccccagcccctgcccctaccacactctcaggttcaacccttcccttgtttcaaagaccagtttctctgcttctgggaactggaaaccacccccaactgcaacccaaaaaactctggctcccccatgttccccacagaagccctacccaagctccctcctcaaaggaccaccccatcccctcgccttacccctctccctacctccaggtggagaaggtgcacaccttcctggattacatcatgggtggctgccagatcagcttcacggtaaagactcagagggagggcacacaggcaagagggaggggctgagtccatagtgaaaggaaggagcccagaatctccactgccccaacttgggctgctcatgagccttcgcattgtcagcttatgcacccccacatcattatgtggctacctgtagcctccccaccactcatcttagtcctccctacagatcccagctctggcctaggcaatctggtggctctcatggttgcagcatgaccttcttcccacccccacccaggtggccattgacttcaccgcctccaatggggacccgaggagcagccagtccctgcactgcctcagtccccgacagcccaaccactacctgcaggccctgcgtgcagtgggaggcatctgccaggactatgacaggtaggagagagtggggcgggagggaacaggcagggaggccttgcccaacggattccacagctttttcttctccccagtgataagcggttcccagcttttggctttggggctcgaatcccccccaacttcgaggtaggctagatgcgagggaaagaaggagatggggggcgtgtcagtcaggcagaaaaggcaggccctcactgctcccgccttgccctcacaggtgtcccatgactttgctatcaactttgacccggaaaatcctgaatgtgaaggtaaaaggggagattttcacctgccccgcctccccgcagacacactccacacaggagcacagactccactccccagggcccagcttcctgtcccttccacccatcccaggcctgtctttatcaggtgaggcttccagggccgaggcccagcatctgcacccaactctccctgccaagggaccatccaactctcccactgcttaatgaaggaactcgaggggagggcagtcctcagacctggaagcatttccttgctttaaggagtgtcaggagggggccctgctcatttctgccagcttcacaacttctcttcactcacagagatctcaggggtcatcgcctcctaccgtcgttgcctgccccagatccagctctacggccccaccaatgtggcccccatcatcaaccgtgtggctgagccggcccagcgggagcagagcaccggccaagccacggtaggaagacatggcgggcaaacaggagctgtcccatgtgtctttaagtggtgccagggccagggtctgcaccttggtggaaacggtgtcaacgcccttgcacacaaagccaacccttccaccctctctgcttgccctcagaagtactcggtgctgctggtgctcactgacggtgtggtgagcgacatggctgagactcgcactgctatcgtgcgtgcctcccgcctgcccatgtccatcatcatcgtaggcgtgggcaatgctgacttctctgacatgcggctgctggatggcgacgacggccccttgcgctgcccccgaggggtgcctgcagcccgagacattgtccagttcgtgcccttccgagacttcaaggatgtgagtcccccgggccccttccggctgaaggactcctcagcttctcatccccccaaatctgaccttcgtcttccaccatttgatgtcctgctaaggacgcgggagcccagctggccaccctgaagccccacttctccctcagatgaccctgcctcccctactcttcctctcacccctaaccacatcactgtccccaccctaggctgccccctctgcactcgccaagtgtgtcctggctgaggtgccacggcaggtggtggagtactacgccagccagggcatcagccctggggctcccaggccctgcacactggctacgactcccagccctagcccgtgactgcctccctccggaccgacactccctcagcctctcagtgagtcctggggcttccaaaggagtggacacagggggtgcaaagtggggcttggtagagcccaactaggctgggtgtagtgtagaagagagtgcttatgactctcccaccccctcccaggtgcctgtcctgaccctcgtgactccagtgaccaatgcctccacctcttggaccaggtgtgccccctgggttctggacgtgagtggtgggtcctgctcctatctctccaaaccccatacccttcaatgctgtggcccctcagtgacttccttgggtgatcctgactttctagccattaataaagagaactgctcctagc

SEQ ID NO: 139 - DNA, 61878 bp, Homo sapiens
tcccgggatgttagaggcgctcagggtggcagcagagcagacgccgggctgcgcgctgggagctgcggtctccggccatggcccccgctccgccccccgccgcctccttctcgccctccgaggtccagcggcgcctggcggccggcgcgtgctgggtccgccgcggggcccgcctctacgacctctccagcttcgtgcggcaccacccggggggcgagcagctgctgcgggccagggcgggccaggacatcagcgccgacctggacgggccgccgcacaggcactcggccaacgcgcgccgctggctggagcagtactacgtgggagagctccgcggggagcagcaggtacagccgggccggggccccccaccccaacccaggcctccgtcagccttccactcccgggcgagccccgttcacttgccctctagcaggacccaaggtgacagcttctgccctcccttccctcgctttccctctcttctctccaggcaacaggtcactgtcgtcccctccaacccctccttcctctctccaggaacttgctcttcctttccacccttaccgcctggcccgcctccgtgccagctctcccatttccccagcacccctccttccagcgtgttccttctgcagcccctgccctccgacaacctggattcccgtttctgtccccagccccccatacgcctcggctttccttcctcttcacttatcggcctctccctctttgcaaccactctccgtttctgtttggataatgggctcaacctgttcccacctccccatcccacctcacttctgcttcaaagaggcacagatcagtaactcttctcactagcttgggtttcctggtgccgccctggccttgcctgggccatgtctggggtggactgtgtcctccaacctctcagaccttcccttatattcttgtcctacacgctggcttgggactccaaaagagtgaaatgaaaggcatgagccagttttgccaaggaaaagggaccagcactttggaccagactgtgtgctgagctgcacgcttctgtgcagtaccagctcccgatggtatttaagtccttaactcaacctggggcaggttttgttattcccatttcaggatatggaatctgaggctcagggaggctctgattaatgcgcctaaggtcaaatagctaaatagtgggaaagccacatgtatctgactccaaaatcaatgctggctccatcccaaaagtcttcgggtggaggagacagacctagtccacaggattccaggtaggctcaggccagaggcaaagcgactctcttgatgttccccaggcctggctctgggactggtatggggccatcatgcttagatatacagtagttcccccttgtccaaggggatacatttcaagaccctcagtggatccttaaaaccacagatagtaccgaatcctatatatgctatgttttttcccatatatgcatatctatgataaagttaaatttataaattaagaacaataggaagagattaacaacaacaataatagaatagttacaacaatatactgtaataagagctatttgtatgtggtccctttctctcaaaacatcttatagtactgtactcactcttcttgtgataatgtaagatgataacatgaggccaggcaaagtggctgacatctgtaatcctagcactttgggaggccgaggtaagaggatcgctcgagcccaggagttcaagaccagcctgggcaacatagggagaccttgtgtctacaaaaaataccaaaattagccgggtgtggtggcatgtggctataattctagctacttgggaggctaaggtgggaggatcacctgagaggtggaggctgcagtgagccatgatcatgccactgcactccagcctgagcaacagagtgagagctcacctcaaaaaaaaaaagataataagatgcctacatgatgggttggagtgaggtgaatgacaggtgtggtgatgtggcattggctactattgaaaagtaatttaaaacttataaattatttctggaattttccatttaattatgtttttggacccaggttgaccgtgggttactgaaaccatggaaagtgaaaccgtggataagggggactcctgaaaaccaacaattgtcccctgcttctaactcttgctttcaagatgagcccagcaactactcttagatctttggttgaaaggacttagcacccactgtttcaggtggcttttcattgggtcatcctgcctaatttctccatcatttattcagtcatggaactggttccttaatgggttgacagcactgtgctgggtgtggggagatatcaatgaacaaaacgaattcggttcctgtcttcatggagctaatgggataatggggaaggagagggaacacacagatcacatgatagttgcttaattaatggtgtatcagagtacggatctagaggggaggagcatagagagccttcttgagaaagcgacattgacactgagagctgattgataggctgggcttagccaggtggcatgtagcaggaagaatattttgggcaaagggaacagcacgtgtgaaggctctggcaggaagagcttgacatagtaaaagactgcaaataaaaccaacgtggccagaggctgatgggcaaagacagggatgtggggggaggccaaaagtcggccggggccacatcacacggggcttcgtaggctgtggtcaggatttgggacttgactctaacaaaaatgggaagccaggtgagcccgggaggtggaggttgcagtgagccaagatcacgccactgcacttcagcctgggcaatagagcaagactccatcttaaaaaaaaaaaaaaaaggaagccagggaagaggttcaggcagggttcatggtcagatttgcatctttagaagaggacgctggctgcagtttcaaggaggaacagagacagcctaagtgggtgtgaggagatcaggcaggatgctgctgcatggctgccactgcagtggctgtgaccatggggggaagggggatgaattcgggagagtctctagacaatatgctgggactcagcattgtgtggtgagggcccagtttaatctgagaggttggtgtttggtgtcggctcatgctgaagggtttagaagaagatataagaaaaactgagtgcaggaggccaggcacggtggctcatacctgtaatcccaggaatttgggagggtaaggcgggtggatcacttgaggtcaggggtttgagaccagtctggccaacatggtgaaacgctgtccctactaaaaatacaaaaaattagccgggtgtggttgtgcactgggtgtggtggtgccctcccagctgcttgggaggctgaggcaggctgatcacttgaggtcaggagttcgacatcagcctgggcaacacggtaaaatcttatctctgctaaaaatacaaaaattagctgggcgtggtggtgcatgcctgtaatcccagctgctcgggaggctgaggtaagagaatcgtttgaacccaggaggcagaagttgcagtgagctgagatcgcaccactgcattccagtctgggtgacaggtaagattttgtcacaaaaaaatagaaaaggaaaaagaaaagaaaagaaaaactgagtgcaggaaataagagaggttgagactgacaggtttgcggtggctcatgggcccgccctgtgttgtcactgtatcctctagaaaggagccttagggtgtggctcgtcctcgcaacaccatcctgagtatgcttacagccacccctggccagctgccctggatggtcccacctcccagctctgctaaccacctagcaccatggtttgccttgtctgatgcttagagagggacccagggacccagtctcacatgtgcttctgacctgtatgctcatctgttgcctaagagcccgagggcgggccatgctgcagacatccttacttctgggccccaacctgagcatgtggaacaaaactcaaaacaatgcatctgcagacgcatagcccaaacttgacaatggtcacactagcccagccctccactgggctgccagcttctgccttcagagttctaacctaagaactagtacagggttgtctttaaattgagagagaggaaggctgggcacagtggctcatgcttataattccagcactttgggaggccaaggtgggtggatcacttgagcccaggagttcgagaccagcctgggcaacatggtgaaaccccgtctctacaaaaaattagctgggtgtggtggctcgtgcctgcagtcccagctactcaggaggctgaggtgagaggatcactggagcccaggaggcggaagttgcagtgagccagatcacaccactgtactctccagcctgggtgacagagcaagaccctgtctcaaaaacaaacaaacaaacaaaaaacttgtgggagaggttgtcaaaggagaaatctgggggtgggatatcctttcaaagagatgcctggctggagacaatttctgttcttctccctagctaagcccttctagcaagcctcaagctgccttttgcacttccctcctctcctgctggaccagggatgctgacacccttgtggttagagccccctgtctctggaggagcaggaggcttttgctggggaaggggagtgccatgaaccagctctgttgtttggggctcgtttctgaatggtgcccctcctagggccctgtcctgctggtttagcccttggatgggagcatcctggcccttcccccagggagaaggcctggacccgtttgttccccctgcaccccactttgctgcaccctctgtaggtacacacattcacactcacacgaaggcacattcacaaaacaagtccaacttgtttgagccaacatgctgcctgccacggccttggacatggtgaagccaagctgcccaccttgagcgagtgacagagccgtggctgagcagggaaggagctcagggcggtggggtcaagagcctcaccccaagctcaggcgagagcagtgctctgccagctgcagccacatgttagcagagtatgaagtccacttattgagctgcgaccggcatttttcacaaaagaaatagacaaggaaaggactttaggtctaaacctccttcccaggctatattactgtgtttcccagactctgggcatccatgaatcaccaccccaggtttttttccccccagtttggtgtactatactctggttactcttcagattgtataagtctttcgccttttaccaatttggtgtaccacttgaactgtcataatgtaatatttatctttaaattgacccactttatttttccatgtactcatgcttggcgataataacagtaaaatcaaagcttttacgtgcactttaaagggaatgggggccaggcacggtggctcatgcctgtaatccaggcactttgggaggctgaggtgggcaggtcgctagagcccaggagtttgagaccagcctgggcaacatggtgaaaaactatctctacaagaaaaaattacaaaaattagccaggcatggtggcatgcacctgtggtcccagctacttgggaggctgaggtgggaggatcacctgagcctgggaagttgagcctgcaataagctgtgatcatgccactgcactgcagcctgagtgacagaggagaccccgtctcaataaataaataaagtgaatatggaactggggtttttcctgagccccaagcctgccacccagagcgatgataactgccagagggtggctcatactcccccatgccccaccaatcctggagaggtcctaccgttggcagatatctgactatgccagctgaccatgccctctgcttgagaagactttagggagaaggcaagcctgactcgtcagccactagtgttggggtaaccttgatgtgtgaaggtctcgatgccatgttttaattccacagggcttgtctgtctcagcatggctgagaagtccacagattcagccacacatgggtctgtaagactttgggctctggccattcagagcttaagggcttgaataattaaatggggagggacaataaggaggagatctaagtgcagaaagacttggagtttccaccctacccaggaccgggaacatcttgagctcagcccatcttggaaagccggtctgataaaaactgatgcttggggaatttgctgaactgccgccaccttctgagcagagtagagccgagaagtcgacttactggaggggttgagatcacttggcctctaagggggcatcccaggggagcctgcctgagcaatcaacagtcactgccctctaccacctgcaggggcttctacactctggcctgctgtggtgccagtcgagtctcacctggaggacgaagctagggccagctggtggggcatccagggcccaggtcactgcagttccatggccaccccagggtcagcacaagctccaggagtgctctctggtgtcaccccacaattcagtgaataaagaggctttgagacccagaattgggaagagggtcaaaaattaggattctctggaggaaataaaaagaaacaaacaggattcctagaaatacatgagagtaattgtctttggaagtattcccgggaaataacccagactgatgcttcggcaacagcattcatcatcttcgcttattttttttcttatgacacatgctcctcattggtctgtatgtagtcttcatttatttagacaggtgataagcatcccatgcgctctgaaacccaccacatcacagaaacagcccttgctggcgttaccaggaccttcgccttcctccacccggtggtcagtgctcaccttaccttgcatggcctggcagcaactggtgacaccattgatcacccttcctcccctccagtacactttcttcacctggctgctggatgccatacccttttagttttccacctgaattcatttttgattgcttctctggcaaattatcacaaactcggtggcttaaagcaacacacatttactctcttacagttccaaagtaaaaaatgaatctgcagggaagcattccttctggatgctctaggggagattcttttttcctgccttttccagctactggaggctgcctgcattccttggctcttggcccagccagcaatctcatcatgccagcctctgcctctgttgctgcgtctcctcctacgactgatgctcctacatccatcttccacttagaagtacactcggggtcacactggacccacctagatgatccaggataatctcatctcaagatctttcacttaatgacatctgcagagtcccttttgaaaagtcaggtagcatattcacagattgtggctcacacaccatccagaccccggttgtgacttctcagtctccattgttagtttctctcacttctcatttcccagaaaggtgcacaaagtttaaacatacagctcagtgatttttttttttatgagtctccctctgtcaccaggctagagtgcaatggcacaatctcggctcactgcaacctccgcctcccaggttcaagcaattctcctgcctcggcctcccaagtagctgggattacaggcacacaccaccacgcccagctaatttttgtatttttagtagagacggggtttcactatgttggccaggatgatcttgatctcttaacctcgcgatttgcctgcctcagcctcccaaagtgttgggattacaggcgtgagccaccatgcccggccaattttttttttttaacctaggtaaacatctctgttgccaccacccagatcgagacctagaactcttccagcacctagcacaggctcctgcctcctcccaggcaacagcgcctcccagaggcagccactgttctaatctctatccccataggatagttttgtgaatccctcatgtttatatgggcatcatgcactctgttgatggctgctttcactcagtattatgtctggggtattattgatgtttttcttactcttcacagtaatcgtttccattggctactctgtcctagagaatccataggcagagggagaaaatggggagtaactggagcaagaagagccaatggcttggaccacctgttgatcttcaggagcccccccccttagttttccttctggaacattcccctcacttctgccctagtttggctagagcctcgctacactcactattgtcgcagtctcttgggcaggtcttcctctgttccccattgtctctgaacctttctgaagagaacttgatcatgttatggcagggctcctaagtattcaatggctccctattgccatatcccttaagtccagcttgaatcctctttcttccacagagattctccttacctcctcacctatatctgcttttttccccttcactcagactctcatagctctttacctgaacctatcttacagcattcataacttttttttttttttattgagacagagtcttgctgtgttcccccggccccaggctagagtgcagtggcacgatctcagctcactgtaacctctgcctcccaggttcaagtgattctcctgcctcagcatcccgagtagctgggattacaggtgcccaccactatgcccagctaatttttgtatttttactagagacagggtttcaccatgtttgccaggctgatcttgaactcctgacctcacctgcctcggcctcccaaagtgctgggatcacaggtgtgagccaccacacccagcagataacattctttcttatttaacatatttccactgtggctcttgtcttccctattgttttgtctactaatctgtaaactccccaaggactggacttgtctagttcacctggatttctctagcacacacaggcaccactggtacataccaataggtactaataaatatttgaatgctctgggtatgggctcatacctgtaatcacagcactttgggaggccaaggcagaaagagagcttgagaccaggagttcaaggccagcctgggcagcatagtgagaccttaggtctacaaaaaaattttccaacatagccaggcgtggtcatgtgtctgtagtcccagctatttgggagattgcttgagcccaggaggtcaaggctgcagtgagccgtgactgcaccatttgtactccagtctgggcagcagagtgagaccctgtctcaaaaaaatgaatgaatgaataaataaatgtttgaataagtggatgaatgagttgcttggaaaactgaggtacgtgcataattgaaaaggaaatattagcatatgcaagatactttaagaatgaaacatagccgggcacggtggctcatgcctgtaatcccagcactttgggaggccaaggcaggcggattacctgaggtcaggagtccgagaccagcctggccaacatggtgaaacctcgtctctactaaaaatacaaaaattagccaggtgtggtggcgcatgcctataatcccagctacttgggaggctgaggcaggagagtcgcttgaacccaggaggcggaggttgcagtgagccaagatcgcgccattgcactccagcctgggggacaagagcgagactttgtatcaaaaaaaaaaaaaagattaagaaaaatctcttttctgtgtcttgttaaaaggttgggagttgatggaaaggatggagaaccatcaagcaagtcactcatttctgcctttgtcctcggttctttgcagccggagagagttagcaaaacctctcccttagcaggctcttacagtctacccgtcccatgagtctccttcaggggttagaagtgaagttaaccatagaaaatctcaatcaagacccacattgctctcagggttaagacccccccagtcctcatgtagctataagtacctgggtgacactcataggtatgtcccaggttgcctgggtttctagtcctgtttactctttctggtgtcttttcatgcaaaattctctaaagcacatagactcagaacagtggttctcaatcttctctaattgctcctattctttttttttttttaaacttctaagttcagcaatacatgtgcaggtttgttaaataggtaaactcatgtcatgggggtttgtagtacagattattttgtcacccaggtgttaagtctagtacccattagttatgtttcctgctcctctccctcctcctatcctgcaccctcgggtggaggcctcaggtatctgttgtttccatctttgtgtccataaattctcatcatttagctcccacttataagtgagaacatgtggtatttggtttctgttcctgacttagtttgctaaggataatggcttccagctccatccatattccctcaagggacatgatctcgttcttttttgtggctgtatagtattccatggtgtatatgtaccacattttctttatccagtctaccattgatgggcgtttgggttgatttcatgtctttgctgttgtgaacagtgctgcaatgaacatacatgtacatgtgtctttgtgatggaatgatttatattcctctgggtatatacccagtaactggattgctgggtgacatggtattgtaaggtgggcagaagactctaatgaccactttccccacctgctctttctctctgatggaaaaagagctcagccacaacaacaaaattcgagaacaacaaacttgatgctagcaacactcataaagcttataactgagaaatatgaacttccaactcagtactttatattgtgaaacactgcctccaaaacactattatccaaataacttcagtttcttaccttgatggtatattgcaaagtatttaaacagcaataccaggcaagcaaatttgaaggtggtgggatttgctttaacatatttgaagtctgatgcatagaaagtatttttaaaatcctgttacagtaaaactagtagccaccaatttcattcatgaaagtatgtcattatatacttagagtgaaccatgcaacctgcaataaacttgcttgaaaattacctaagtaaattagttgtaatttctcctttaagagggggagtagaattctagttctctgtgttctcttgtgcccagtaggacctttccagtgttgcttagcattgaatgatgttcagattacctaatgagaaatggaattagagtttttagggatctctagaaatggctggttttagtttataaattccaggccgggcacggtggcgcacgcctgtaatcccggcactttgggaagctgaggaaggcggatcgcttgaggccaggagttcaagaacagcctggccaacatggtgagacctcgtctctactaaaaatacaaaaactagccgggtgtggtggtgcgtgcctgtaatcccagttactcggaaggctgagatacgagaattgcttgaacctgggaggctgaggttgcagtgaatggaaatcacgccactgcactccagcctgggtaacagaatgagactctgtctcaaaaaaaacaaaaaaaaattccaaacgttaataacttataataacccacttaggtacttgtacatagcccctagtcttaggtaataacagaaatctatgaaatggcatcgtttactcacaaagatcaaagaaagacctcaaattttaaagtcagtttgatcaaggcctacactttgggaccctgttgtggaggaataaggagcacctcgctggactgaataaatccagcttccatgatcctgtgttgcccccaaacagggaaaaggacagatcagcttggtttcatggttgctttctcttgtgccaggcaaggtcttctggaaacaaccataatgacttctgctggttggagacaaggtgccataaaaaattcagttgttccttagacccaagtagaagagtccttgaatcctaataaaaggccacttttttaagtttttctactctaggccgggtgcagtggctcatgcctgtaatcccagaactttgggatgctgaggtgggtggatcacaaggtcaggagttcaagaccagcctgaccaatatggtgaaaccccatctctactaaaaatacaaaaattagctgggtgtgatggcatgcacctgtagtcccagttaatcgggaggctgaagcaggaaaattcttgaaccagggaggcggaggttgcagtgagccaagatcgtgccactgcactccagcctaggtgacagagtgagactccatcttgaaaaaaagttactctattctaaatgaagaccaatatttcatagacataggacaaggggttgggagagggaaattgattatctttaaaaaagaaactgaaaaggacttaaagttcgcagtgttgcactgatttttagttgagcaaataatgagtcaagtcgtgttggttttgtgcacatgtgtggtttttccaaaaaaattgtatgggccgggcacggtggctcacgcctgtaatcccaacactttgggaggccgaggcgggtggatcacgaggtcaggaaatcgagaccaccctggctaatacggtgaaaccccgtctctactaaaaatccaaaaaaattagccagacttgatggtgggcacctgcagtcccacctactcaggcggctgaggcaggagaatcacttgaacctgggaggtggaggttgcagtgagccgagatcacgccactgcactccagcctgggtgacagtgagaccctgtctcaaaaaaaaaattgtgtggaagcacaatgtgacatgccataaactccaatttgaacattcacagcttactcctaaatgagtcatcttattaacaagtgtatttaagggctaagggtctctcttcatcctttaacaggtctatctcttttgaaaggcttcttccttcattcattgcccctttttcaatactggcctccttatttggcaatggagttgtgagtcaaacagttctccactgctttcagtgacttcatgaagttttctattttttttctgcatggatgtttatcttactttgcattttgatacattgcatattgttggatgatagcaccctctaaccatcaaagagagaacactttgcctagatgggcagggcaaagttggggtaggaggtggtcagtatttgagcaagggccaaatttattaaacaactgactcataaatatctacatgatttttgctgtcttttgcaacttgaatcttcaggaacgcagataaagaacagttggataacgatgatccctgtagagctaatagtaacacaccttaagtgtatatagtgatctacgtttttctttctttctttctttctttctttctttttttttgagacagagtcttgctctgttgcctaggctggagtgcagtggcgtgatctcaggtcactacaacctctgcctccctgatccaagcgattctccagtctcagcctcccgagtagctgggattacaggtgtatgccgccatgcccggctaatttttgtatttttagtagagacagggttttaccatgttggccaggctggtctcgaactcctgacctcagggtgatctgctcgccttggcttcccaaagtgctgggattacaggcatgaaccaccgcgcccgaccctatctacatttttcaaagtatttttccatagactttttttcccttccaacttttattttaactttaggggtacacgtgcaggatgtgcaggtttgttacacaggtaaacgtgtgccatggtggtttgctgcccaggtcatcccatcacctagatgttaagcccagcatccattctctgtctttcctgatgctctccctcctcccaccccgccccatagatttctacttgaactcttaaagtgggtggagtagatgtaggaacctgtatttcagagagatcctgcaatatgggtctccaagtgcccagtattttcaatgcatactcattagggacaaatcttagacatgagattaagccgaggggtaccaaatacatttctttcagatctaggagggatgaggtaccatccaaggtcacctctgatccttctgactgggctgaagtcaggcctctgaagacagaaggagaaggatccttaggcggaagctgtttgctttctagacttcataaacttgtcttctaggatgacgtgaggcaatgagtatactcatgtgatggggatttcctggggggagcaggcatgccttcctctgacgtgtcattgactccctgcacgctcagttactgatcaatcagcggatcactccagcttcctggcagctgccctttcatggggtgagggagtgtgggtcagagtgtaagctgggatgatgtgttggcttgaaaagctttacctgccatcacaggcgcttaggaaatgcctggttgctgcagttgtatcccaaagtctttaatttagacaattttagtttagccagtctagagaatacttcctttatgagcattagggcctgcaaaacaccccaaatacatgggaaacctgaaataataatgatttgtggctcccagcatgctccctcgggggcctggtgtcctggaggctggtctgacttgcccggaggtcactggtgtgtggctcagctgcagcggcagcgtagtgggtgtccaggggagtggacaagcaattctcctgtcatttgcaactttcttcaggaactcagataaagaacacttggataacgatgatccctgtagagggatttcatctgtaccatcacacatggaagaggagttgctaggtcaggaaaggcagctgctaagctaaggttcttgtccctttgtccttgcatgcctaaggaggggctgtccaggacaaggtaactttgtagatcctcacctccttcctaaaaaaacttgccatggggttgcaatgtgccatgtccatcagtgctccagcagacaccaggagaggaagaggggacccctaggaggtggctgctgcttctcctgtccaagatgcaagtcctgtccaggtgaaatagggcaggcgaggccctggctgcactgccagacagtatcccataggcagacagagcctcaggccagcacctcgccttccagccagcatggctgtgactccctaagcagcctgatccaggattgctgttacctctggagtgtcttgctagcagaggtgaccttcccggggaaagtaagggaattttaaatgctccttctatctaggtttctcttgtttagaaaacaaggaagtacatgtgggtgacacaggtgtgctcaacaaacaggtttaagaagggtctttagtgggaagaatggaaaaaggagtgggaaactcttacttcctccaccactcttgatctcacccacaaaggtgagttcaccttgcaccctgagtgggttggagctgatcccagccaatcagccgatggcatgttgctacctcatagccaggaaaagcccatctcagcagtaagacctagggccttccacatcagaccttctctacggcagtggctggtctgacttgggaaaatggaggaagatagatgtgtcatgaatgaaacgtgtgtagtatgttggtgcacatttaaagacattgaagactgacatcgaagttcccttatagaaataaatgaatcctggagttctaattgctggtcccacctaagtatcttctccttcaggataagagtataaagaatgtcccagactagatgtcatgagtctagacccgtgttaagggagaacctgccaggtgcaacagagtgggacgtgacctgataaggcaggggaccaaggtgactcatgaactttagtgcagagccaggcagccatgatgagagcatagtttgtaggcagctacctggctttgagccttgcatgcagccaagatcccaaggccttcaggaggattcccctggaatgttctagatacaggaagcggtacctgctgaaagggctgggaaggagatttttcctggactgtttcaaatccactgtgtcctagacacttgcatttttttaaattattttttaatattttgtagagatggggttcttgctctgtggcccaggctagtctcgagctcctggcctcaagtgatctgcacacctcagcctcccaaagtgctgggattacaggtgtgagccaccgtcctggcctagaaactctcattctaatcgacattaattaatactctctaatggcatttcgttaggattgatgtcaaagttttatcacattctgcagtattctgtttgttcagggaatggataggatagttgaataaaattagagtagattttttctatcataataattacatattaatatagttcataaaaatttaaatagttaagacgaacgtgcaaaaaagaattgtttccagccgggcacggtggctcatgactgtaatcccagcattttaggaggccgaggcaggcggatcacgaggtcaggagttcgagaccagtctggccaacatagtgaaaccctgactctactaaaaatacaaaaaattagccgggtgtggtggtgtgcgcctataatcccagctactcaggaggctgaggcaggagaattgcttgaacccaggaggcggaggttgcaatgagccaagatcacaccattgcactccagcccgggcgacagtccgagactccgtctcaaaaaaaaaaaaaaaaaaaaagaattgtttccctctcactctagtccctctataaataccatcattttttgtgtaatctcacagagattctacccatatacatgcgtatatatatatttaaagacaggctctcactctatcacccagactggagtatagtggtgctatctcagctcactgcagccttgacctccccggctcaggtgatcctcccaccttagcctcccaaatagctgggactacaggcacaagccaccactcccagctagtctttgtattttttttgtagagacagggttttgccatgttgcccaggctggtctcaaactcctgggctgaaacaatccacccacctcagcctcccaaagtgccaggattacaggcatgtgccacgacgcccagccacacatatagtattatctttttatttctcacataaaggaatcatatgaggcagactgcttgacaacttgctgtctttttcacccaatgacatattttgtacctctttccatatcagcaatataattttactccattctttttaacagctgttcctattgatgcttttatctattacgtcagtgtcacaagaagcattcttacacaatccctttgcatatatatgcaaatcaaccataatacagagtcctggatttggaatttctggatccaaataatacacatcttatattttaatagatagtgccaaattgcccccaaaacagttgtaccaattttaactccctccaaaaacgtgtgagaatgcctgtttctccacactttcaccaattctgtgtgttagcagtcttttcaatcattgtcaatggatgaaaaaattgctccctgtttaaattcttatttatatgaaggataagggaggttctgagtctttccatgtttctgaactttttgcacgtttttagtaaactgccttttcatgtcctttatccatctttctattgatagttgtctttttcttactgatttataatctctccttagaggtaaagggtattagcctgttttttggcatctgtgttactatttttcttccacttttcatttgccttttgccttgcttaatgttttttttttcaacgcaaaacctttaaatttccttgtagtaaaagacaccggttttattcttagaaggttctgcccctactttaagattttatacataaaaacaaaatatttcagtttcctactaataattgtatgcttagtgtttttcttgtgtttgtttttgcttaaatattttgcttccctggaattttttttggagggatggggtgtaaggaaaaaaataggtattattttaggtttatatttttccaaattactaaccagttttcccagtagatttattgaatgatctatctttttccactgattttttttaaaaaacctactcttttcacatatcagtcatttacatatatagttatttaggtctgtttttggactatattctataccaatgaaatcactactgttttattaggttttagccatttgcgtttttcctccttgcattcccttgcagccaagactctgctccgctagagaaagaaaaggaacaggaggtgggagtgattctggagcctgtcaccagccttggcgaacacagtcaagtttgactttcaaaggctagggctgccgggcttgccctgggccctgaggtcatgtggctggagcagataagaagccactttggagaaacccttgcaagcggcagcccccagcagcatgtgtgtggcccacagtggttgtccgtccaagcagtgatggaatagtagtgatttcagccaggggatgcgggcatggggaggggtgtggaaggagcaggtagctgcagcttgtcctggaactcagcattcaggtgggtcctgcttattcttcctgctttgtgttcacagcctgtggttagaggggaggcctgcaggccagattccacgtgtgcgtggatgaccaaggctaggacggcagaggggcagccatgattgctagggggaacatggcacctctactggaaagccacttgaatctcaaactttactctccctctggccgagggaactggacatgtattccgcatctcctcctcgttcctttcatcagaattgcatgaggagcatattaaaatagattcctgggactttctggggagatggaactggtctgtatcttgatttgggcattggctgtaaggaggcatatcgttgtcagactatacccttacggttgatttttttttaactatatgaaaattacgcttagtagggggaaaagagagccaaataaatttaacaccagctttatagtcactcctaagcaggtgacctcacatttgcaagagttagtgctggtatacacaagccttataaagactgctttggaaagaaaaagtagaatgtgaatggtgaaatccaggttagaggggatgcaggtgctcctggtgagattctcccagtttgctgtatgtttgaaattttcctaacaaaatgttggacaaaatactaagtagttaccctgtggaaatcattcacagacgtgttcttaaagaatgagtagaaaaataaaataacagcacatgaatggttatatgcagcaaaggatcacatttccagtgatattatgttggccatcacaaagcaccgtacacaggatggcttaaaacaacagaaatgcactttgggaggccgaggcgggtggatcacctgaggtcgggagtttgagaccagtctgaccaacatggcgaaaccccgtctctactaaaaatacaaaaattagctgggtgtggtagcacatgcgtgtagtcccagctactctggaggctgaagtgggagaatcacttaaatctgtgaggtggaggttgcagtgagccgagatggcatcactgcattccagcctgggtgacagagcaagactccatccccacccaccaacaccccccagccctgccaaaaaaaaaaacacaaatgtattctctcacacttctagaggctggacagcggacatcaagatttcaacagggttggttccctctagaggctgcgaggaagaatccacttcaagcccctctccgggcttctaggggggctgctgtcctttggtgtttcttggcttgtagttgtatcgcttccatctctgcctccatctttatgggtgttcttcccatacgggtggctctatgtcaatgtctcctcagtcccctcttaggaggatgctagtcatactgaagttagaacccaccctaatctagcatgacctcatcttacattgattacatcaaagatcctatttctgaccaggggtggtggctcaggcatgtaatcccagcactttgggaggccgaggcaggagggtcacttgagcccagaagtttgagaccaacctgggcaacatagggagaccctgtctctataaaaaatacaaaaattacccggatgtggtggcgtgcacctgtagtctcagctactcaggaggctaaggtgggaggatcacttgagcccaggagtcagaggtctcagtgagctgagatcacgtcaatgcattccagcctgtgtgacagagccagaccctgtctcaaaaataaataaataaataaaaatcctgtttccaaataaagtcacattcacaagctctgggcggacatgagttggcagggggaattggaggaggaacactattcctcccagtaaattttttttgttttttgttttttgttttttgttcttgagatggagtcttgctctgtcacctaggctggagtgcagtggcccaatcttggctcactgcaacctccacctcccaggctcaagtagttctcctgcctcagcctcccacatagctgggactacaggcacgtgccaccacacctggctaatttttgtatttttagtagagacagggttttgccatattggccagtctggtcttgaactcccgacctcaagtgatccactcaccttggcctcccaaagtgctgcaattacaggcgtgagccactgtgcctggccccaatacagttattattaaacaacttctgccactcaaacaacctagatgaaagtgaatatgaatgctcattggagaactatggtctattgaagaaaaatgactccaagacagagagttcaatgtcgaagactcatgtgaaaagtttgatgcttcacttgagtgaaaaaaatccgtgtgtaactaaagaattaatgtgcgtagattatatttttaaaagattataaggccaccctccaaacctacaaaatgtaaatctctggagtcaagacctcagaaatctgtattttttgtaaataccctttgtgactccggagcaccatgaagtttgttgtaacccattgtcctagaaggataaggacagaagaaaaatggagatggggaaattggaggtgctgggtgtggcttggcaggcagtgcttatggggttatttatttattttgagctggagtctcgctctgtcacccaggctggagtacagaggtgcaatcttagctcactgcaacctccaactcctgggttcaagcgattctcccacctcagcctcccaagtagctggaattattacaggtgcgtgccaccacacccagctatttttagtagagacggggttcactatgttggccaggctggtcttaaactcctgacctcatgatccatccgcctcggactcccaaagtgctgggaggcatgagccacctcgccctgctgttcgtggggttattaaagaagccacatcctcaagctcttgtcgtggtgcgtagcgtttggtgcggagcagttgagctgtggacactgaccgggcagcccatgctcttgccctctgagacagaggagggagtctaggatctggagcctaagactgtgctctagttctggctctgtatctaactggcggtgtgactttgggcaagttaatcaacctctctgagcagtgtgttcctcacgccctgcctcccctgcaggattctgtgtggctacagtgagataatatgagagctgtggaacaggacgcagggatcacacccacacaggagggcaaggagtcccttcagctccagcttctgctaaccaggggtgggtctctgctaggtggtgagggacgggtgttttcagaacctgagctgctgtgtgcttggaccctcctgggcaggactgtgcacccctggaggagccggagaatgtgacattctggtctctctgagtcatccctccaggcctggccagggagatctgcgatggcctcccgccttcactccatcttcacctggacaggtgcagcactatacccaggacacttaccctggtcagggaaggacagtccccaaaggtgaggctggccaaggccccagtttgtcttgggggctcacggggctgcctcctgctccccaccatcccttcctccattcagccgcaaatatgctaatatttcctctgtgccaggcaccctgcttggtgctggggacaaaaagacacctggctgagacactcatggggattacctcagaggagtgagacagacatgataattacaggtggcagcaagtgatgcaatagaatagaaacattctgtatggaccaataccctgggtcagaaacattccaggcagagggaacagcaggtgcaaaggccctgaggcatgacaggaccgagaggagactctggcattgctggagcatggggagggatggagtctggtgggggctgaagtggaaggaggtgggcaagagccctacttggtggggctcatgggtcatggccagggatttagattttatgctgagaaccaagggcggccactggaggattttaagcagaagactgacagattttctctacatttgatcagttagctctggctgccatgtggagggcagattgggcttggggggagtcaagagtggaagcagcaagagagttaagaggccattgctattgtccaggtggcagatgggggtggcctggattggtgactgtgaggatggagagaatttgaaattgtcgtggacatggaaccattagaacttgctgatgcattggatgtcagcagcgagggaaaggaagaagttgaggatgacaccaaggttttggcttgagcaactgggcgatttgatttatggaaatgattaatactggggtgggtgtccatgtttgggataggactatcaaagctcaccggggccaggtttgagatgccagggaaacatcagtagagattttgaatactgattgaatatgtgagtccagagctgagctgtccaaggtgggaaccaccagccatattagacagcacacatatagaacatttccatcactggacaaaatcctgccgggtggcactggtctagagctgtgtcccagcccagcaccataggcatttctctctgggataatggcacccaatctgatggtgctgtctacgaagctgctgtccgtgtgtcatttgcaaatggctctttcttgccctctctgcttgatcacaccagaatgtgtattcagtgctgtcccttacctgtggccatgtcaggcaggcactgacctcccagaaagacaatttaccctgtggtcatttaaggaagtcacttcctggggctgaagcatcattatggtgacgagtgtaacacatagaatggaggctatacccaccaggcgtcaccagttgtcatgaattctaggactcactgcgtagactttgctaattgaagaaatgtgtgatggggccaggcgcagtggctcaaagttataaacccagcactttgggaggccaaggcgggtgggtcgcctgaggtcaggagttcaagaccagcctgggcaacatagtgaaatcccatctctactaaaaatacaaaaaattagtcaggcatggtggtgcatgcctataatcccagctactcgggaggctgaggcaggaggatcgcttgaacccgggaggcagaggttgcagtgagccgagattgagccactacactctggcctgggtgacagagcgagactctgtctcaaaaaacaaacaaaaagaaatgtacagtgggaccaggcacagtagctcatgcctgtaatcccagaagtttgggaggctgaggtagaaggatcccctgaggccaggagtttgagaccagcctgggcaagatagcatgacctcatctctaaaaaaaaataaacagattagccggccattgtggcatgtgcctatagtcctaactactcaggaggctgaggtagaaggattgcttgagcccaggaactcgaggctgaggttgcagtgagccatgattgcaccactgcactccagcctgctgacagagcgagaccctgtctcttaaacacacacacacacacacacacacacacagtgaaaaaaaagaggacataggcctgaatccaatggacttgtcttctagaacacaccatgccacctgagacaagtcagccaatctttctaagcataaacatccttaactgcacagggaggagattgcatggccaggcatggggagagggaattgcttgaatcagcaaaaagaagtaggaggtatgagggagggtgttgttgttgttgctgctcttgttgtttgggttttttaaataaaacagttcagtgactattattgtttttcgtagtataatcatttgccattttgtaaacagtggcaagaacaatatttttctttcttaaattattagataataaaagacgcatttcaaaatattgtttctggaataatggcatatgaggttgtttgtaaatcaatagtcttgattctccttttaaaaatagcaaaatacaggataattcttagattggagtgttgtgcaatagatctgaaatttgttttattatactagttgggtcagtgaggagataatatattttaggtgtcgtacgtgtattttccttgtggaatgcacatcctgtaaacctacttgaggtggcttgaggtctcagtcttgagagactacggtccagaagtggtctcagcaagtctgcaaaaggacatgttttaaggaactcatgtcctgtgagctgttgatgctgctcattggagttgaaactcagatcctcccattttacccgtgcagcaagaggcaggattttgtaaggaaagacccagaagggaagcctccaaaagcccctcttgtttaccctgacaagctctggccgcgtcccttccagctgtgctcccagcacggagactttccctgggggcctctccagatccccaagtccagcattcactggaaaaacccacgtgtctccctgactcagtgcattcttggaaactttgccctaatccgaggttagaggctggagggctaaggatcccggtggctgccaacagtcagtggcaacatttggtaaagaatggagttagtggcttgaaaacccacagggggtatcctagcgagtggtaatttcattttttcaaaccactggccccttttcctacgtcctgggttgcctgcccacctgtgctggcttaggcttccggtgtcgaggttgctggcaatggcatcagagggagttcacttcacgagcagaagcaatgctgggtccgtggtgaatagagtcaacgccccagggcccaagactgtctttttgttctccacacacctgagctggagagttggtcacagctcaggcacaggtttcctgctggttttctttcctcctttcctcttgctcccgtgaataccaggacggtggcctgcagggcccatcgccttgcaatgactgcggggagggcgaggggtgggtgggcttcgggggttctgaggcttctcacttgccagatatggtttcttaggccaccacaggcatccagagctcagctcctggccggtcctgactcctggattggatctagaaaggcagagggcagcttattaaagatggaagcaagcggatccgctgccttcatttcagccgaaagcttttaccaaaaacaaccagctcgaaggggactgctccctgggggccgcagaggtgggcttgttaatgcaaaaggctcctccccaagaaaggctcttgctgcagatacagataacggcttggaacagccttggcaccatcatctccctctggggcctgccccttcctagctgccaggggccatgtgccacccaggggcgctgcgacacctggaccccccaccttccccctgggcctccatggggtgggggcagctggacccaaggcccgaggcaaccattccctttcagaaaaagggttttcaggcaaaatccaggctatgggataaaaggccatctgtccgtcccgcggtgcccagccccagctttcccgaacaacatgcctttatgccggcgcccccgcccccagcccccgcccgccgcacactgcctcctttcacgcggcctctatggtggacttgtttgtttgtggtgcagagcgcagactttctgttgttcttctctgttctctcccccgtgcgccgtccaagcaaaccctctctagggaggacagggtctgggaccctggaggaagctgggggcttggggacctcccagagagtcctccacgaggggagaaaggaggctactgtgaggaaccttcccgggaacagccctcggagtgggctgctgtgtgctccccccgcccgtccagcaatcacttgagagatcttgaataagtcattcgggccgcctgtgcctcagtttcccccgtgtgtggaatgcctcctgccagtctctcagggagagttgtgtccgccccagtgagacgccgccacatgtgcgcctcggtgaaggtgcttgtggtggagatggcagggctgttccagctgccacgtggggggtgggggaagtgcagaatagaacaaggtttgcactaaagagggcggcgtttgcttcactgctccacgcgcagcgtttccatgtagcgaaaactgcgaagtgacctctcaggccctaaagaaggggaacaaggccgcccctggctgcagatgggcagcagtgggctaggaacggacctatttgaatgcctgtcctatttgaatgcctgtccccccggggccatctgtgtggcctgcccctgcgggctgggtggcaaggctgtgctgactgaaagagcctggtttctgccgcgtcctcagcataggatgaggggcagactcctggctccacggctcctcggatgcctccctcggttgtcccctcttctggttggattccctctcctttggtggcggtcttgatcccagatgaaactgattagctgattcaggccttgttacaggttttctaggctgctgtaacaaactgtcacaaagtgggtggttgaacaacagaaatgtattgtctcgcagctctggaggccagaagtctgagagcaaggtgttggcagggttggttccttctgaggacattgaggggcagtccttccagccctcccctgagctgctgggggctgccagctgctcttgaccatccttggcttggagaggcattgctcccatctctccttccatcttcacacgtgtgtgtctgtgtccaaatcaccccttttataaggcccaccgtaatgatctcatcttaactacatctgcaatgaccctgtttccaaagaaggtcacattctgagacactgggggttagaacttcagcatagagttctttgtgaggactggcatagctcaacccacaacctctacactgggaagcgagaccctggaggtaacgcccttggtgcatggcctgagactctactgtgattccttacccctcacagattttgtcacttttctttctttctttctttctttcttatttatttatttatttattttgaggtggagtcttgctctgtcacccaggctggagtgcagtggcgagatctcggctcactgcagcctccatttcctgggttcaagcaattctcctgcctcagcctcccaagtagctgagattacaggtgcctgccaccatgcctggctaatttttgtatttttagtagagatgaggttttgtcatgtttcccaggctggtctcaaactcctgacctcaggtgatccacctgcctctgcctcccaaagtgctgggataacaggcatgaaccgccatgcctggctaattttatcacctttctagacataaggggaggagaaccgggaaaaaccaggtccaacccccacttctgctccctgacccgctgcttcctctagaaaccagtccccacctgaggttgcccttcatcagaccttgctgggactctggtccctctggtgcctacctgccctgaccccacctgggccttggtacaactggccctgaatgcctgccccatgaagctatatagcccaggctccccattggaattccctgttctgggaattgacagagagaagaaaacccctgctctcgtctgtctctgctcatccttctcagtggacagggcatcccagggagcaggaggcctgcagcttgcctgggagtttcaaactggcaaaccaagggccacatttatattcatatgtgttggttcggcccacatcatttgttttaaatgcaagtcaaattttaaaatctggagattttacataaaaatatatttttccagcttttcatagaaatcagggccaggcgcagtggcttatgcctgtaatcctagcaccttaggaagccaaggtaggaggatcacctgaggccaggatttcgaggctaggaggttgagactaacctgggccacatagcgagacccccttttctaccaaaaaaaaaataataataataataataattgagcccaggagttcaaggctgcagcaagccatgatcacaccactccactccagcctgggcaacgaagtgagaccctgtgtcaaaagaaaagaaaaagagaaaagaaaagaaatctgaaggtctgacaacccttggtccccatcctcctatgacttggacctaagtcagagctgccctcttgtaacagggtgtggcccctctatttcactgtagtctgcttcattccctgcagcctccttgatacgaagatgcagtgacaggccaggcactgtggctcatgcctgtaatcccaaggaggccgaggcgggcagattgcctgagttcacgagttcaaaaccagcctgggcaacacggtgaaaccccgtctctgctaaaaatacaaaaaattagccaggcatgttggtgcatgcctgtagtcccaactactcaggaggctgaggcaggagaattgcttgaactcaggacacagaggctgcagtgagacaagatggtgccactgcattctagccagggctacagagcaagactctgtctcaaaaaaaaaaaaaaaaaaaaaaaatccattgacagtgactcgataccatccttgtggcttggactgaccagagaggaaataacgcctggtgatgagccaggaattggcgttgtgctgggagcagtgagggttggtacttctgtctcaaaggcttctctcctgtgtggccttggactgtggctggaaggctctaaggaggttgaagtgccctccctaccctccattgcccggcacgtccagtggctcttggctgggaatgagcagtgcctgctgaccccgtctccttggcagagcaccttggccattgcttgtgcccatccttttctctccaagtagacgtgggctatggaaggctcttttcctgcctgccctccccacgcatcggtggcctctccaggcctggggcagggggttggggagggctctcagagtcgacccaggccacccacctgctcgctaatggatcactcagcaagtattggcagggccaagcctgtgctggggactagggagtgagcagttagcaagattgagtggggtctctagtgcacggtgcttatgggctagcttggaatacaatcaacaggtaaatgcggtatcaggagagccaggtgcccccttgccactcaacagccctggagctgaacacaagagtgtcaagctgtctcttctgcctaccttcccaaggcagagaggcctggagggactgggatgagggcttctgtcctcagcaccagactgttgccctgggacagtctcgttcgcctcagggtacaagaaagcaatcacctgacacagatgggttggacaccccctgtcaagccacactcatcaacacttgtgctgatcactcctgtgaaagccagtgtgggtctaactacaaaattgttcacttcccttaccaaatactgaaacctacccagttcaaaggcatcaccagccaggcgtggtggttcacacctgtaatcccagaactctcggagactaaggtgagcagattgcttgagcttaggagtttgagaccagcctgggcaacatagcaagaccccgtctctataaaaaataaaaaatttggtggacatggtggtgcacacctatagtcccagctatttgggaggctgaggtgggaggatcacttgaacgtgggagttcaagagcagcctgagcaatagatcaagaccccatctctacaaaaaaattaaaaattagctgggcatgatggtgaacacccatcatcccagctacttgggaggctgaggtgtgaggattgcttgagcccaggaggttgaggctgcagtgagccaagatcatgccactgccctccagcctgggtaacagactgagaccttgtttcaaaaaaaaaaaaaaaaaaaggcatcatctggaataatttccaaatactggaaaaaagaaagcacacatatcttcatttgaggcactttttggtttttaaagtgtttaaaaaccaccctttggcttgcttccaggaccaggagaaccttttaaataatgaatgtgaaagtttccaagaaactttctaaaagccttttaaagctggggttgtaccctagttcccaggaatgacctctacacactcctgattcatggatggtgttcgcctgtggaattcaagggtgagctggctcaactataaaataaacaccggggcgggagtctggaaaacgtggcccagatcaacgtgtgtggcatgcgtgcggcacagctgctcctggcaggacccagttcctggagtcctggcgtgccccaggtgggaatgggagaccttcttcagaagggtctttgtcttagctgtgtgtagggagggtttttagacctagaatctcacaactagacttgagaaaatcgattaatgaacaatgcaccggaggacgtgtccctgtacctaggagtattcctgctactgacaccgcgtgacgctggctctggttttccttggagtctcctcccatgttggaggtgtgtcccatcttgtgataagaacctgggcttctgccaaggaggggtgtggtcccaatgaagccacccaggaaagcaccttgcttagtcagtctggggcttatttgccagaagcatatcagtcctgacattgctccctggggtggccctaggacccgagagcagaagcaggaaggaggatagaaagaggccatgccgacccccttcccctttgtccctcttttcctcagcctccatagagagggtgccccctcttccagcccttgactggtgctggtccatgattcagaggaattctggagagagaatccctggcccctctgtgcgggggatggagccgctcgaggcatgacccactgcccttccccctgtctcccaggagcaggacagaaatccacagagcagggactcctccggtttcttcatgtcactcaggatacttccagttgaatgaagctttcaatgtgctgtttctatttagccagcatctctctaagaaacaggatttttgtaatttttgaagtagaaccttagaaccaggacatggtgaacatttgatttacttcctgttacagatagatcatcgagccccacatcaaccagcttgagccaaaagaacaattatgtgtagttaatgctcataaaaacagaatgttgttgtaattgttctgcattcataaatactgtaaaatagaggtcgggcatggtgcctcacaccagtaatcgtagcactttgggaggcagaggcaggaggatcacttgagcacaggagttcaagaccagactggacaacatagtgagagaccctatatctataaaaagaaaataattaaaaaataataaaatagaaccttttttggtaaatgtcagtataaagttgccaactgccttccttggaaagaactgccttttatcctgaaaacacatacttcctatatatttggtattgaaatttcctcttgtttatgaaatgttgctgatagtaaattaaaaaaaaaatttttttttgagacaaggtcttactctgtggcccaggctggagtgctgtggcacaatcatagctcactcatagcctcaacctcctgggctcaaatgatcctcctccctcagcctcctgagtagctaggactgcaagcgcacactaccaccacacctggcttttttattttttctttgatagagacagggtcttgctttgttgcccaggctggtctcgaactcctggccttaagcaatcctcccacctcagcctcccaaagtgctgggattgcaggcatcggctaccgtgcctgcctttgaaatatttttatttggcaaaataaaacgctggcaatctcataccagtcttatatacttttcattctgctcgtgcctgtcctatgtactcggccgaagggcactgagaatctatgatctaggttgttggagttttgatccttttatctgggcactgtcctatccagcccagagtgcaagatgcatgttttgtgtcctggcccaccccctcaggcagacagccgtatttccccaccacgtggcagggtgggcagatgcacccactccatttgtttcacatccccaaggagtgtgagtcctgcagagcttcagggcttcgcccccacagccaggcccaccacatggcaggagtcttggaagacgttggctgcttgcagagacccagcattgaaacacgacccactggggaaatgtgggtggagcatctggtatttgcaagacccgtgctaggcgtgggtctggaaacaggaaacagaaatccacaaggtccctgcctgttggaacctatcacaccactggagtattttgaggttaaacagaattggaacaggattattgagctgctgtcacgggaagagggaggacatttatattggatatttaaggcatttccatgtatgatgtgctataaaatctactcttctttgtactcaagacagcatgatacacacacacacacatacacacacacacatacacacatacacacacatacacacacacacacacacacacacacacatatatatatatatatatatatatatatatatatatttaatcaggtgttggcccagcacggtggctcacacctgtaatccgagcactttgggaggctgaggtgggcagatcacctgaggtcaggagttcaagaccagtctgggcaacatggccaaaccccatctctactgaaaatacaaaaattagctgggtgtggtcatgtgcacctgtagtcccagctacttgggaggctgaggtgggaggatggcctaggcccagaagacagaggtggcatgggctgttgcaccccagcctgggtgacagagcaagagtctgtctcaaaataataaacaaaaaaattcagatattagcttgatgatacagactaaatatgctgagacacacagactaagaaaggaccacaaaagccgacttttacttgggttacgtgtgggttttcccataaaatgccaaaatagtcactgtcaccatcaggttctcttgggtccgtttggaaacaaaaatgtacaagtcatgacagtagcctcttggccgccggccaatgcccagcttccagctccctgccatggccaccagcaccatggcttccttcagtcacaaggacacagagaaggcaagcgctctctctgcccctccttcggggcagcatgggtttcacttacgtgccagcctgctgtctctggcctcaccctccgtgacgtcagagctggctggggctgtgtgcttttcccagcacatcccgtttccctctgactttacctctttgtgagttcgatttaaccttgagcccacttgggcactgctctgccaatcccaccccacgtgtggctgctgactggcactcgggtgttgctgcagggacagcctccctcgctccctgctgcctttctttcttgtgggtatgtggccctagaagccacagcctgtgactcatcagtgtggccctgtgagccccaccaggtgccctgggcgctaccctgggactccctttgcctggcacctgccagggacctgaaggagaaccggcagggacccctttcccggagggctcccactaagcaagcttctttccctgcagtctctccactggctcacttcctctcccagatctttctgcctcttttatttatgcagaaattttattattattattattattattattattattattattattattattattttgagatggagtcttgctctgtcgtccaggctggagtgccaggctggatctcggctcactgcaacctctacctcccgggttcaagcgattcttctgcctcagcctcctgagtagctgggattacaggggcgcaccaccacgcctggtaaactttttttgtatttttagtagagacaggttttcaccatgttggccaggctggtctcaaactcctgacctcgggcgatccacccatcttgacctcccaaagtgctgggattacaggtgtgagccactgcgcccggctggaaattatttttttaagggaaatgtaaaatacagagaataacaatgctcacatcagggtctctctgttttccaaagtacccagcgtccttgatctccaccaccctgccccacccacggggctctcaccactcctggctgcctcttctcggggcagctcggggctctgccctcttccctcacccactgtgtataatcctcttgtatcttctccttccagggctccatggagaacgagcctgtagcccttgaggaaactcagaagacagatcctgctatggaaccacggttcaaagtggtggattgggacaaggtacctggcataggatggagtggggtgatgactgggggctggcgggaatgaggagaggaagagggtgtgtggagccaaagctgggagtgggcatgacgtgtgcccaggggagaaggggaaggagaagcaggtgtccacagcccagaggcatgacctgggacagcaaactccggcaggggtgtgggggtgcctcactggtggaaagttcagaaaaatagcagacaagttctgagcatggaaccagatcccagacacccctggagaagaagaattctcccgccaggacccctgaagctgagaaggggctgtgacaggcttggcaggcccagacatgcccattttgaccagggcacaaggtagagctgcccctggcacctgcagccatgtggaagcgacattggccagtgcagggcacaggagactgctgagtccagcaggagacagcgctgaagccatcctccgtgtttgggaggagtcagagatgcctgcagtcttaggataagcctcttttggcatcaagaggccagtgccttgctatggctgagcagaccccatagactggtgagatgagccctggaggagctgagcggtcacggtggaaaaggagtcactcagcggcaggggagaagcagctttgcctggaggggtcactggagggggtcactggagggggtcactggagggagctgggcttggtgccatttccttccagcttaggaacagacacaaatgtgcatgtccataaacccctaccctgcatgccctctgcctagtttgggcctcaaagacacagaaacaaatgggacaggcccctccctgcgagagctcacagcctggtgcaggggacagtaacccctccccaccaccgccataaagagttattaccccaggaggtggcatgggatgctcgcccaaggaacacaggtgagcagagtggggtggggaccccacaaagctgactgtctgctgggcccccttggccctgacactgggaacacagagatcccacctgtcgcatgagatcacagccgcctctgggagaacccatccgcccacagcacagacgcctcaggatccaaccagagaggccgaaggaagttgtgctgtgccatgtcccctcctgagaggtgcagaacccagggcaagatggaggccagccagaggaaaggctgcccggccatgcagccggcgagctgggacctggtttccgaacctcaacccccagcttgggccctgggcactggcagggtcaggacctcagtctggaacagggggagatcggaggggaatggggagagtttggggactgatgaggggaccaaagggtgagctacagtgtgtcctggctcagggtcctgtcctgagtggccagtggatggtactggaaggagctgcagagagaggcatctgtgagcttggcttagggcttgaattctgaaaagagctgaccgggactgaacaaatgtggcagccatcagggtgatgtgacatgaacaaaactgtcctggagggaggagctggggtctgaggctggctggggacgggagatccagcccacattgccagctctgtggtcagctcctcccagtctccccgagctgtggttcagggctgaccccggccccatcactgcaggaggcaaggggaggattaacccaggctgtgccaccgtcacctatgctgtcaccacgaccacacccaaggggacgaggggcccctcctcccccatggactgctccctgcctggctccgggccagctgtccaagcagcctgactcaccttccccacctctctctcattctctctctacacactcactcttcctccccttcctcctgtgtctctgggctgagacggaagggcgagggctgggccctgggaggatgtggaggcctactctggacggagcccccacctgcccgggtgtgcatgggaaccccttcagcgccccagaaaatcagcacagggagcagggcttcccaggagggcagagggtgcttttctgcttttttcttttcttttcacttttgactttccaaaaaagggtgctgctgctgcctcgttcacctcacgggcaatcccagctccgttagtgggaacagagaggctgggggagcccgcggtgctccaacctgagccctctctctgttgctgacccaggcagcgggggctggggtaggtcttttggatcgggacatggaggagctgggaaagaggccatgaaggtggcagctttgtctcagccgagggtccccaggcctggggtgggtttgcacacctgcccctggggcagaagggcttgctggtgttaactcttctggctttacctccaagctcagtactgtgattgctgccaaagactggagtcctggcctcccggggcccagtttccctggccctagaaggtggggacagagtgggaaggtgtgtgtgagaaggggtgagtgagaatgctgggaagagtgagaggacaacaggccaggggagccagggcagagttagaaggatctgaaaagacaggaagaagggccaggaagcaaaccctggtgccccgctctgctcagaggtgagggatggtcttacttttgggctctgtgtggaattttaccagaacagtttctaaatcatcccttcagtcacccagccaggcagggtccaggcttccttatgggacaagaagccaggttgtggattctcaccctccacatccctccctgtttctagaacacagccaggtgaggtggccagagctgcccaccactctcagctcctggacacacgtgtccccctggtccagcagcctctttttgccacttcgccatgtccttttcggagccctcccttgggagccctctccaccctttccacccgggggaccagcctccctttggggagggggcaagaacaggtgtgatttgaggggtttgcagaagttcgctgcccagatgctcagcagcggagttagccctgaattcacatctcttgtactgagccctcactgtgtgccagccgctttcaatgtattattggttatctgctttaatcctgctgacagcacgagggataaggattataattatcctgatttaactgataaggaagagcttaaatctcccgcccaaagtcacctctgggcacactagcagcccagatagcggcccctcccctccacaaggtcctggaaccttcccaccccaacagctgaccatgaataagaccctgaggccggtgagtaggagagggagtggcagagggagggaggaggctgagcagataccagcagtgtctcccaagccagccacatcctcttccccatccttcctcaggctaagccagatgctggcataaccagctgctggggctggccaatgggtgtgatcagcctcttccctcaagggacagatagacgcatccagcaggcatccccaaactccctgtccctgccccctgcctgacataacacagaccaccagggtccccagggcctggaaaggctattgaagttggccatagtgttttgcccatttaggacccccagatcagtcactgagaactcaggaagatagcatccagatcagagaaagggcccttttggccaacacactctcggggggaccagccttggcactgtgggcactggcctggctctcctctaggcaccctgcctgcctagtcgccttgggtccccttgggcctcctttctctctataatccctcccagccagagtaggggtctggagggcccaacatccaaagggcctccccaaggctgtccatactgggcttagagtccctgagtctcctctctgcctgcctccttgctcagagctcctggcccctcttcagaggagctcagcggtgctcaaaaaataccccaaggcagaaagcaggcaggtgggctgggcactgccctctgcttccgtgggtcttagaggacaccctgggagggcagtggacagggcaggctgggaggcaagagatgccacagtgttccagtatgatgcagaaagctattccctctatcttttttatttttttagagacaggttctcactctgttacccaggctggagtacagtggcaagattgcagctcactgcagcctcaacctcccaggcttgagccatcctcccacctcagcttcctaattagctgggactacaggtgcataccaccatgcctggctaattttcttaaatttttttgtagagatagggtcttgctatgttgtccaggctggtctcaaactcccagcctcagtgatcctcccaccttggcctcccaaggtgctgggattgcaaccctgcatcttattattgcgtaggattatctggaggatctagtggaatgtactaaaggatatcagaaagtgtgctgcaagggaaagaccaccctacctggttttggggtggggcccctgggcaggctcccttcgctcgtcttcagccctaagggcagaggtcatgcctgctttctgccagcgctcaagctgtctttcatctctccctgtgtctctggcatttttgctccctatccactctccgctgcctgaatcctcgtggggtgagcctgaggccacctccctgtcctcacatcccctgggtgacgggagggtcatagggctcagggggaggaggcaggtgatccggaaccacctctgtggacttcagcttgtcccagttagaccgcgcaggacgggcctgcagccactccggcaacgccaccaagagccccacctcactgcccccactgaccgctgctggctgtgaggaatcacagccgttgtgctgaggaagtcacagccatgggatcccaatctggctgacaggaggcctcctggccgagcctgggctgtgagtggggcactcgagtccaggccctgccacagcatatgcagccgaacatctgaccctgtcttctcatctgtcaaaagaggtcatcatcggccccaactcccagaattaaggctcatgaaggataggggatgtgaggcctgagccccagctgaccagcgaccaggttgcagacaaccggcccccactcctctcccgcagccccggctgcctggaagcctgtctccacctctgctcagaaagctgccctggggcaatatgcctgagtttgggtggacatttctttaaacaattgccttagctcatcgctgtgggggtgagcagtgctgctgacactgagcagctaccctgcccccgccgcctgcccccgctcaccacatttgccaccttagggagaagcagattctgggcacacccttccccaggaaagcgtcctatgccacctggccctgtgctgcccaggaggaggggtcctggggagggggaggaggaaaacagggaaggcccccttctaccggggcaccatgcccttccgcccaccctctgggcagcaggctgccctttccccctgccgtgctgctgtgggccacattcctggcatagcctgggagaagccctccccttctctctaaggcagggaccgagcaggctgggggaggggcatggaccccacacagtcggcacaaggtgctttggccgaatccactcccccttgcatctgcttcctgggccccggcccgttggtcgggtctttgaatcaccaaaaaatccctccaccccaatgagctgctcattccagagcagtttcgggcataaccgtgctgtcgcccatgcaggccagcttcctctggacggccctgagtgctggacatgcctctctagcgtcgggttccactgctgtaaaaggggacttgttactgtagggggagccgtgggagcccccagatgcctgggaagtggaggcatcatcagtgtggcctgatctccccttctcccccacccgagccacgtacatagcccacagacccatgccttccctctgtcccccgagccttgggacataagaagtaaatggggcccggaccaggaacgagctggaaggaagagacccactaatgtggtgggagtaggagaggggtcttcggtcaggtagaagagggtgggtggaagggcgtggtgcccaggtagaagggggccttccctgctttcctcctctgcctccccaggacccctcctcccaggcaatacagggccaggtggcataggacgctttcctggggaagggtgtgtccagaatctgctccccaaggtggcaaatgtggtgagcgggggcaggcgggggacggggcagctgctcagtgtcagcagcgctgcccacccccatggcaatgagctaaggcaattgtttggtcaggtagagcaggaagcgaaatgtgtcttgcatcgcttcccatctcattggatcccaagccgtcatcgtctgctgtcctcccatctcaaaacccggtcccgccaactgccatgttggaaacgaccagcaagtgagaggcctggaacctctcagcacccagctgagcctttctccttcagtgctcacgactggaagatgattaagaaaggacaccctatcagtgcatgtaccacctaaatcaaggtcaagtgcacagggtgccagtcccagctcttgggaaactgtgtggaggctgctacaagctgggggaagggggagggaggcttccacttcaggcccaaccaatcctatctcaagagccgcttgacctctcaggcctcaatatcctcatctataaattgggtcgggggtcggcgggcctgaatttctgtgcttatctggaaggctcacggggcttcccctggaatagcgagactgaggccccagtcatagaactataggtgttggcctttgatgactgaggcgggtgttcacagaagggagagcgaggcctccctgggattcctccagggtggtccttcagccccagagtgaagtgggcaccttccctgggcacccaggtgggcttcctcgtggagacacagcgtaggctagatacagagctcgggtgtgaggccctccacggccccagacaggcaagaggcagcttgggactgactctcaagcacaagtccaccatgtgtacaggtggcagtgcttgcgggtctacccagggagtaactgaaatcaggtcaatccaatgacatcaaatgacagacccctgtgctggggctctgttcccaccacacctgtaaacacatcttccacggtctagctccggtttccacgacagttctgtgcttttgttctgtttcctgtacatccaggtgtgagatctaggctgaagtccctgcttatagcttacctagacatttcttcttgtggttcaactgaattcaacgtatgaatcctatgccattttcagctggggacagtggttcacacctgtaatcccagcactttgggaggccgaggcaagatcacctgaagccaggagttcaagaccagtctggtcaacatggtgaaaccccatctctactaataatacaaaaaaattagccaggcatggtggtgcatgcctgtagtcccagctactcaggaggctgaggcaggagaatcacttcaaccggagaagtggaggttgcagtgagccgagatcacaccactgcactccagcctgggtgacagagtgagactcaatcttaaaaaaaaaagaaaaagaaaaagaaaaagaatcctatgccattttctacttgcttcacaaaataaagacaaaatagatcaatagattaaaatttgcccaaaccactgctaggctgagagaggggccccctggccacatccctgtgctatagctggaaaagatcatagttcaagatcgctcagtctgtgtaaagtgcacaagtgaatcacaggatagcagtatctgtcatgtgtaacatgcaaaagtgggacatagaaaaaccaggggcgctggccaggcacagtggctcatgctcataagcccagcactttgggaggctgaggcgggaggatcacttgagcccaggagctcgagaccagcctacacaacatagtgatacttcgtctctaaaaacaaacaaacaaacaaaaaacaattagctgggcatggtggcgtgagcctatagtcccagctactcgggaagctgaggtgggagaattgcttgagcttaggaggttggtgctgcagtgagccacagccatgccaccgcactctcacttgggcaacagagcaagtccctgtctcaaaaagaaaaagaaaggaccaggggattcatttgagagagatggtcgtaagctacagatgtgtattattatctttacagcaacaactgcaaggaaaataccaaaagcatagctaaaaagtcaatagaggagatagtatggaatattgttaaatatttcatacaaacaagacaaaggaagaacagaggagacaaatagaaaatagcagccatgtgtggtggcgcccacctgtagtcctagctactcagaaggctgaggcgggaggattatttgatcttcagaggtcaaggctgtagcgagccaagattgggccactgcactcccacttgggtgacagagcaagccctgtctcaaaaaaagaaggaaagaatgagaaaagaaaaccagaggagacctactccaacattaaatgtaaatagatttaatgcttcaattgaaaggcagagatggccgggtgtggtggctcatgcctgtaatcccagcactttgggaggtggaagcgggtagaatcacctgaggtcaggagttcaagaccatcatggccaacatggtgaaatcccatctctactaaaaatacaaaaaaaaaaaaaaaagccagacgtggtggtgggcgcctataatcccagctactcaggaggctgaggcagcgagaatcgcttgaacccaggagacggaggttacgatgagccgagatggcaaaaagagtgaaactccttctcaaaaaaaaaaaaaaaatggcagagattgtctgactagattaaaaaggaagacccaactatattctgtctgcaagagatgcaccttaaatgtaaagacatacacaggttgaaagtaaaagtatgggaaaacagggatcctgcgcacagcaagcttcaggaaaccagtgtgattctattaatacccaagcggacttcgggagaaggagtatttccagggcccaagatggctctttcccagtggtaaaggggccaactcatcaaggagacataactgggcgaccttgggcagattactcagcctcggtttccccaactgcaaaatgacaatagttagaatacacgcctagttaggggtatggcgaggatcaagtgactgaacctgtgtcaggtgtttagaaccatgcttgacacataaccagggctccatggggattagctctgagtgctactgtagctgggacaaagccttacattctcgccttgaccctggcccaacttcttctaaggtggggctctgcagactgccgcaagataaggtgtaaacacaggccaccagctggttcctccagttctttttcctgatggtggtggtagcggttgtggtggtgcagggtgtgtgtgtgtgtgtgtttacagacctagggcagaggactggagggaatgagacagcacacttccaatgactccacttgctgctagactcaagggctgaggtcaaggagactggggtaaggaagggagcagcgactaggtggagtttggatgattgcttgatttagttagtgccagggcgggatagctccaggctgacttggatcatcttccagcctgagaagcaggaagtgaaccccccaacccccacccctgccacaggaaggcagccagtacctgggacctgccaagttcacatggcagaagccacagcttcctttgggcccttcaccctggtcacaggcacagagagaaacccagtggccttgcctgcttgctcccaggacccccacccccctgctcccaggctgtgatgggcgagaccagctccacctccagagcagctggggggcatgtaagggctagttcctggaagacccgctgtggctgcaggctttggtggagaggcctgtacaaggatgagattgcagccagggccaggggaaggaggtttctggaatcactgatggctgtttcgtccaggcttgcaagctcttccacgtgcagcccttgctcctctcccctcctctccctgcctgtggttcccctacttcccacctgcagtggctgcctgactccccgtgctgaagattggctgagcatccaccgagacaccctcatcctcactccgattgtgtgtggcagattggggcccaccagcatcacagatgagggcactgaggggctccgggaggaaaagatgcacgtccaggatctcacagctggtcaaaggcacagccaggctctaatggtgttcccctgactccaggttcattgttctttcctggattcggtccagattaacccagcactggcttgtcagaaatcctcaagggcttctagttgcctggagctgaaacctgcaaacttttctgagcttgcatccctatgagtgaaactttctgcacacactctccattatgtgtccatttaaattatttctaaagtatttgcatgtgttaatgtactctcacagtctgtgcattagaaaacattcaaatgccgtgtaaaggtgagataaagcctgcgtagtggcacgctcctgtagtctgagctacccaagaggctgaggcaggaggatcgcttgagcccaggagttcaagtccagcctgagcaacacagcaagacccacctcttaataaaacaaataagaggccgggtgtggtggcttacgcccataatcccagcactttgggaggccgaggcgggcagatcacgaggatcgggagattgagactatcttagccaacatggtgaaaccccttgtctactaaaatacaaaaaattagcgggcgaggtggcatgtgcctgtaatcccagctacttgggaggctgaggcaggggaatcacttgaacccgggaggcggaggttgcagtgagctgagatcgtgccactgcactccagcctggtgacagagcaagactctgtctcaaaaaaaaaaaaaaaaaaaaaaaaatcaagaccatcctggccaacatgatgaaaccccgtctctactaaaaatacaaaaatcagctgggcgtggtggtgcgtgcctgtagtcccagctactcaggaggctgaggcaggagaatcacttgaacccaggaggcggaggttgcagtgagctgagatcatgccactgcactccagcctggcgacagaacgagactctgtctcaaaaaaaaaaaaaaaaaaaaagaaagagataaatatattacaaacacaaataaatagaaataatagcaatagaaatagggtcgttaatattttctccctgcctctggggattagcctgtgagtaccgatggagtacacgtacatccttgccttggagacaacaggcctggagaataagcaactcctggatgtggtacagggtgttctatcatctaagccttcagcagcttttttcctgctgcccacagagcactgttaaggtgccagaaaggccacaaccatattcaactttacatctgtgcccacactccctgtcatcctttcctctctcccccttgtcaaatcccccatgttgatgaactccaaaccaaaacccagatcctctgcaaagccctcctcgcctaccgtgacccgggcatttgtaccagccattctgcctctggatctcagcctgctttgtatctccactaaactatcctgcttggcatgccacatctcattgagcacttaatgcaggtaccgttattatttttttatttttgaagagacggagtctcgaactattgcccaggctggtctcaaactactggcctcaagcagttatcctgcctcagcctcccaaaatgcagggtttacaggcatgagctactgcaaccaacaattacttccattttatagctggggaaactgaggctcagagaggttaagtaattttccagaaatcacacagtaaatggcaaatggatttgtacccaggcctgacttccgagtctaactgtaagcactaagctacatgaaacaaggttggcctctttcattcctgttgattcttcccagcacctagcatagaaataaatatatatataaaaaataaattgctgaataaatgattgaatgaattaattacccaggccaacaccaagaagcctggggaaaagagcccacttcattcctgatacaaaatgtattacctcctgtacctcaagagtcctgagcaagactttaaacttcagatgtggctgaatctggatgctcagatatcatcactgagattctgtctctctagctcttggtttggccatcttctgtgctggtggcatcttcaggcaggctctgctagtaaatccaggctcatgccctgccgatttagcacctccaacagaaagagggatcatctgatggctcatcacaccagcttaggtcgcaaacctttaccggatcctattgctgtggctgggggctgggatgagcagcttggtcagttcttgatcactgaagcaggagggtgggtggccccacacagatcacaggagctgaggtaggagcaggggattgggatgctgtaacgaggaaatgggagaacgaatatgggaagacgtgaatatcaaacgtccacttggcttcatctcttgcaggacctggtggactggcgaaagcctctcctgtggcaggtgggccacttgggagagaagtacgatgagtgggttcaccagccggtgaccaggcccatccgcctcttccactcagacctcattgagggcctctctaagactgtctggtgagctcttccctgagcctgtggcaggctgtccctctcttctgacggtgccaatcagatatggaaagggagggggcaattgagtccctccccagagcccaggtctatgctgtaaagctgtcagggagggaggaacatgccatgggaataattcatccctatgcatggttttgtccactgggtgggtcacaacccagcatgtagccagaaactacattgaatgccacctctggtctattccagactcttatgaggagtttcttgcccacgatgcgcatgggaacaattttgcctgcaattagctcctctgccacaagaggtcagcatctgaccagttgcatagagtcagtagccctggggacacagttcttttctgccagtaactcatctcagagacaggaggcagatggactcacagcctctctcctcttttctcttccccactccctgtaccagtgtccctttgaccccaggtctccataggcattctgcatatgctttggtgtcatcttgtccccaatccagttgagttatgtgtctctaagaaagctggaccctgccgggcatggtggctcacgcctgtaatcccaacactttgggaggccaaggtgggtggatcacctgaggtcaggagttcgagaccagcctgacaacatggtgaaaccccatctctactaaaaatacaaaattagctgggtgtggtggcacatgcctgtaatcccagctacttgggaggctgaggcagaagagtcacttgaaccccagaggcagaggttgcagtgagccgaaatcacgccattgcactccagcctgggcaacaagagtgaaactccgtctcaaaaaaaaaaagaaagctgtactctgtcaagctcctgtgcatgtatctctctcaccctgatggccttcctgcaggtacagtgtccccatcatctgggtgcccctggtgctgtatctcagctggtcctactaccgaacctttgcccagggcaacgtccgactcttcacgtcatttacaacaggtaatgccagtttctttcctgacttgccctgaggatcctagagggaggagacctcagtgctttccctggcccagagtttctgagagcacagaaccccaaactacatcacagacatttttggtgaagcctctctgtagaaatagtcttccaaagaagaattttgtctgactcccatctaccccccaaatggatacaaaacccaacaacacatcagcagaaactaaatggaatcatcgggtggcatagcaataaaaaaagagagagagagagattgagtgcctctcattgagtgtcacaccaaaagacacatgatgtgggattctttgctaagaaactaaatgaaatcacttcatcgggtgacacagctgagagctagactcggactggcctatgaacccagcacagattagcagagaacttgggagagaaagatctgggagtgtcctagagtgtgtccaaggcaaaggctcaggcagcagacccccagactgggagtaatggcccactaacctctatgggacacttgccatgtgcggggccacgtgttctcccaggaccgcctcatttacccctcccagcagccccataagaagggtcctgtcattatccccttttagagctgaggaaatggagcctcagagatatcaagggagtagctgaaaggcgtgtggctaggatgtggataccaggtgcgccccagcttctagctggggggcagaggatgaaaagacaggctgatatggggcagtgtctaaagagcctatgagactggggtttaggatgactgtgggtttaagtatagccgctgggacagccagccccacaagcatcttgcctaccttgggcctccaggtacatgccacctgccctgtggtctgtctgtcctggctctgagcttcctgagctgccctcactctgccaggggaagctcttttccctgcactctgcaagtcaagtgcctgaatggttgacatgagaggggccatggtcacggcatcaggaacttcatttatccacctgacccaggatgagtctggtgagcgagctgcaggaagttcccccaaatccagcccagagctcctcccggtcaccgagggttactgcaggcatccctcgagccatggttgccctgttctgctcacgctgaatagctcaggcacagcacggagcttgttgctcagaaggcctgctcgctgaatcacccactgtccgcccggcactcccctaacaatcacaaacagtggcagggccgccagggctggcagccggagggggaaggggatgctgaagctttggcccaggtccctccgccggattcctccagagatgccactcagtaccagctccggccggatgggcagacaggggtgatgctggggtgagggggcgggcagaggcttgacctataggagaggtctttcctgcatggcagggaggatgatttgagggctctatcagccacacggccttggcagagagctaaaatgtgcctgtcttataaaggtccagtgtagagggttagtaagcctgtgaccatgatgccagtgatgggggcatgagagataacgtctccacgtgcctccctcagcccccagcttgtcatgcaaggcacaagccacaggcagagaaaataagagcccacaaagcaaggcaaggggagactcggcgggatcctagtgcagctgctggacaaaggacgcactggaatcaatacagaagagtcagggtgccaagaagcagtggaagctgaacgcagacaccagttcaaggctgacattcctagatgcgcacatgaaaatgctttcaaaagctgaggagacgggggaaagggggcggcgctgcatactcaggatggctccagagcagcttctgagagcacgttagagcgagtggcatccctgagaggaggggaggcaggcttccagtggggtggtgtgcggggcccggcagaggccaggaccttagtctgcgccggagagtgctcccgtacgtccagtcctttccttaccaacaagagagctaaggccaggcacggtggctcacgcctgtaatcccagcactttgggaggccgaggtgggtggatcacctgaggtcaggagtttgagaccagcctggccaacatggtgaaacccagtctctactaaaaatataaaaattagccaggcatgatggtgtgtgcctgtaatctcagctacttggaaggctgaggcaggagaatcgtttgaacccaggaggcagaggttgcagtgagccaggatcatgccactgcactctagcctggatgacagagtgagattccgtctcaaaaaaagaaaatataatattaatattattatataatacaatgtatatactcatcatataatcagatactctgttacctccatcctaactacacccctccaagatgggtagggtgtttccctgaggaaactgtaacacctaggcggtgctgagccaggatttgaatccaggtctgcaaatccaatgcctgtgctctctgcacttcaccggaatgaccttatggaccccagaggtatcagggtttctctggaagcagggtctctcaccaaccagaccagcccagctaagactccatgggagaggggtcacttgaacctgactcctttggtaatatgtggatgtcagtaaccacagcctcccaggaaggaaacccaagaggaggtgggcgggaagaaggaggaagacggttggcctcatttgggaggtgttcacggtggggactgtggacaaccacatggagctgtccagtagggcgtggccacccagggtggagttggtgtagagcttcggtcgtcagcatgtgggagaggaagggattgagctgagaggcagagggtccaggtttggaccctggggacaaagggcagagtttccaagatggagcctgagcagggagatccagggaagaggagaaaagccaagtgtggcggcaggcagaagggggagctatggattccaaccttattgctcccggatcctttgagaatttgagaaactgtggacacagtacagagaaaaaatgcccataggtgtacaatttgatatattagcaagttcacagacactctgcaatccaacgtagtaccctcggatattcataagcctcaggttaaacgcctaggcagctgcagattgaagaagagagtagagctaatgtcatatgccacagccagcttagaggtggactaaaaaatatgcttagatttggcaagaaagacatcatgaatagcctttgaagttctggtggtttggggcagaagacagatttttttttttttttttttttttgagatggagtttcactcttattgcccatgctggagtgcaatggcacgatcttggctcaccacaacctctgcctctcgggttcaagcgattctcctgcctcagcctcccaggtaactgggattacaggcatgcaccaccatgaccggctaatttttgtatttttagagacggaagtttctccatgttggtcaggctggtctcgaactcctgacctcagctgatccgcccacctcagcctcccaaagtgctgcaattacaggcatgagccactgcatccggcccagaagacagatttttaaggacttgacaagccaatgggaagtggcaaagtggagccatgagtccaacctacgttttcttttctttttttctttttgagacagggtcttgctctgtcatccaggctggagtgcaatggtgcaatcacagctcactgcaggcttgaactgctgggctcaagtgatccccctgcctcagcctcctcagtagctgggactataggcatgagccaccatgcccagctaatttttttactttttgttgaggcggggtctcactgtgttgcccaggctggcctcaaactcctgggctcaaacgatcctcccacctcagcctctcaaagtgctgggattacaggcatgagcccccatgttcagcctagcctgactttttaggagccttgatgatgaaggggctgagtccatgatgggaaagtcttgcctacctcagaaagatgagcagaagagccaggagaaaaggagagactgaaggagcccagaggagtcccttgggagggagggtgggaggaggcggctgagggctttgcactgccgagcagggggagcctggcaagtcatggactttgggcctccacgtcctcaatcatgcaggcaatgcagggcttcccttgtaaggctgtggtgagatgaaataggaagtaatccatggaaggcccttgggcggtgcctggcacacaggaatcagtcaggacacatctgccgttactgttgctctgatcatccagcgcccgcgtgccggtgcacacctcttccctgagaagcaaggaggatgcgccagggtaccggcagaatgtggtgtgcttggaagttgggggaagtatgtggaggggatagttcctccccaaccccagggcctctcttctctgtgaagtaggaagctgggtggaaggagaggcagtaaaggggagtagagcgtgttcaagggcagtggggagggagctgaacttgaagatgcacagggatcatccatcaggctgtgtctagggtcttgcagaggttaaaggtgccagacccacagctgtgtgagtctccatgctcagcagcttgggtatggggtacaaaggcaggttcctgcgctgacccaggggtgagggttcatgggtgcaggtgagggagatggagtaagggttaaaagagaacggctaggccaagcatgatggctcactcctgtaatcccagccctttgggaggccaaggtgggtggatcatttgaggtcaggagctcaagaccagcctgaccaacatgttgaaactctgtctctactaaaaatacaaaaattagttgggcatggtggcgcacacctataatcccagctacccgggaggctgaggcaggagaatcacttgaacccgtgaggtggaggctgcagtgagccgagatcgtcccattgcactccagcctgggtgacaagagcgaaactctgcctcacaaaaaaaaaagagagagagaatggctagctttggaaaacagtctggctattcttcaaaaggttaaacatagagttatgatatgaaccaacagtaccactcctgggcttgtacccaagagaaaggacaacatcttttcacactgaaacctctacacgaatgtgcatagcagcactattcacaatagccaagagctacaaacagcccaggtgtccctcaactgatggatggatgaataaagtttgaatatcattcagtcttaaaaaggaatggagttgtaatacatgttacaacatgggtgaatgttgaacatattcggtaagagaagccggtcataaaagaccatatgtcatatgattcaattgacgtgaaatgtccagaataggcaaatccaacaaagaggaagtagacctgtagcttcctagggttgggagggtctgagaagaaatggggagtggctgctaatgggtacaggggcttggcggggaagtgataaaaatgttgtaaaattgactggggtgacggtttaacaactttgtgagtgtactaaaaagcactgaattatatattttatttggatgaattatatggatgtgaattagatttagataaagccgttaagaagagagaagatatggccaaagctatggtttgtagagaaaagaaacaaagataagaggatgaggatgggctgggcacggtggctcatatctgtaatcccagcactttgggaggctgaggagggcagatcacttgaggtcaggatttcaagaccagcctggataatatggtgaaaccccctctctactaaaaatataaaaattagccaggtgtggtggcacacacctgtaatcccggctactcaggagactgaggcaggagaatcacttgaacccgggaggtggaggttgcagtgagctgagatcacaccactgcactccagcctaggcaacagagcaagactctatctcacaaaaaaaaaaaaaaaaaaaaaaaaaaaaaaaggatgaggatgaatatatggagcaaacaggaatgagagctgaaatctccatgaggtcaaagaatgaatgaggtggaggaaagagctgaaagccgctaggactgcaggctgtctccggagggtggtgggaagcatgtgcttgaagatggtgccctgtctccagtcttctcctctccacctaggctgatcatcttcagtgttttcacatcttcctcctgtgctatgatttcaggtcttgtctgttgagatctcggtgcttgttttttcttgtccttcctgccccatggtccctggtgggtcacacttcccatcattaacaccctggaggccaggcacagtggctcccttctgttatctcagcactttgggaggccaaggcgagagaattgcttgagtctgggagtttgagaccagcctgggcaacatagcaagatctcgtctctacaaaaaaaataaaaataaaaaataaatttaaaattagctgggtgcggtggcatgcacctgtggtcccagctacttgagaagctgaggtggaaggatcgcttgagcccaggaagggaaggctgcagtaagctgtaatcacaccactgccctccagcactccagcactccagtcttccaacctgggcgacacagagataccttgtctcaagataataataacaacgccctggctcaggagtgtcgccttctcttctccaatgtccttggggcaaggtcacccttccaggtaaaggcccagccccagccacagccactcctcccacagcctctgtaaggaggatgtcaggcctccagccagtggcccatcactcctgtaaaggacttcccagacccagaccagagtcctacagcctccttcccattttgactcaaggaccccagcagtatggcctggccctgtagctgtccaacagagggcagcagctcccgagctgatggggatggtgaggcagggacacctggagctaccaggctgctatgcaccggtcctcacctcgctctccctgccaccctgcagagtacacggtggcagtgcccaagtccatgttccccgggctcttcatgctggggacattcctctggagcctcatcgagtacctcatccaccgcttcctgttccacatgaagccccccagcgacagctattacctcatcatgctgcacttcgtcatgcacggccagcaccacaaggtgagcggggcggggtcccagcccggacctagcatgtgcagcccgagagggcccggcagccagccgcagcttcaggtgctgcggagcctcctgggagtctggctgtgggttgggagggacgggacgtttgatgtgactcacggggcaactgggttgggcatccgaacctaagccaggcggggacagcgtgggtgtgcagcatcaagctgaccccaggccctctgcacccttgtttacgcatcacctttaatcctcaaaacaactcattcattcgttcattcattcagcaaatgcccagtgagtgcctcctgtgtgcgagacactgttctagacatcattgaacaaaacaacaaaaagccttgcgctcctggagcttgtgctgaaaacagccccatggttctccccgttccacagagcaggagactgaggcctaggaggactaaggaacttgccccaggtcacacttggcacagccaggatgtcgtaccccattctggggattccagagtctgcgctctcaatcacccttcccctgaggcccttcaaggactccacgacagtcccagaagctggcccgagaagataggtctgcccaaaggaagctacctcccctgtaccccccgctgcttctctgtccctgcattgtgctgtccttggcccatcccaggctgttccccagcccgtctccacactctgttctctgctgggcataaatcagagaaaatatggcagatatgatactttcgggacaccagtttagaccctgatgtcgctgatactgaacgtgggtttcaccttggtttcccagcagcaacttaatccggttcatctcgatgagccgattcggggtttgatcggccgcctgggacagttctcaggttggttggctgtggtcctcccggctctccccagagttgatctgcatcctagggggctttcctaggggccagtatcagggtgggtgcccagtcctgggccaacctgtctctcaggtatgctctcagaggtagcgcagcccaggcctggcctgtgtcctccagcctcacctggcctctgctctgcagagctcactgcatctgcttctgtgtcccttgccctgtttgtgaagccttttcagatccactgccctgtccgctatctttcccatccacaggggacaccagaaccttctgggaacctgctcaggccattctggggccccaggggctgtctcaggctccctcttttgagacacttccaccccagtctgtccagtcccctgctgccacaccatgaggacccgaggagactgtatggcctgtagccacgtgggctccaatcaggaacgtgttctcagatccccagacctatccatctaaggatcctgatccagctgtgacccggatctggcccataccagctcacaagagcacccatgcacatcctttcctgtttctgttccagtgacgccacctcagcgcttgaaagcgccagggcagttttcacactgcaggaattggcaaacactaccaatcagggctctccctccctccctttatttccccctccctcattccccagctctctcccttcctccttttcctgagagctggttttccagcacatcactggtcctgttgttcctggtctgaagggagggaggcccacgccagcatctcattgtgtcactgtcacctgctttctctctctctcctccagcccagagaggctgcaggattctcttctcagactcctcaccaagccatagctaagatctcacctctatgccaggcccttggcttctgaagctcgagggccacggtgaagcggtgttctctggttcactgtggcgacacccccttggaacaaaaaaggcctcctgtttggacatgggggtggggaggacacctctagtgacacttccgggtcatcccgccacagaggctgcattaacctcagttgccctcagtgccttgctctcccagacaacatcaggcctcagtctaggtgccctgtctccagaatgcccctctagccaggggcacggcatttagggatgggatacctgtctagcacctgacaaattccagagtcacagtggcctctataagatgggctctgagccgccagcacaccccacccatcctgcccatcctgcccatcccgcccatcccatgttcctttgcaatctgccaggtcccttcctggctcacaaatgggaagtaagacagtctctccagatcttccagacgtggtggcccgccctccccaaagccaccaaaggtgccaagcctacgcagtggaatgtctgggccgctgtgcccctgtcctctgcagggagtggccagggtttggccagctgccggggcccctggctgcctcctgatgcccaagcctctccatctgcaggcacccttcgacggctcccgcctggtcttcccccctgtgccagcctccctggtgatcggcgtcttctacttgtgcatgcagctcatcctgcccgaggcagtagggggcactgtgtttgcggggggcctcctgggctacgtcctctatgacatgacccattactacctgcactttggctcgccgcacaagggctcctacctgtacagcctgaaggcccaccacgtcaagcaccactttgcacatcagaagtcaggtgaggatgggcctgtgcttcccagccccctatgtgtgttcattgatttatttgccaactaccatcgagctcctgggaacggcaaggcactgttccatgtacggggcatatacagagggttccctctactctcttccctggtgcagacagctgtgcagagacaggcaaggacatcaataaatggcaaagatttcaaactgtgataaatgccataaagaaaataaaggggctgggtgtggtggctcacacctgtaatcccagccgaggggattgggaagccgaggcaggtagatcacttgaggtcaggagtttgggaccagcctggccaacatggtgaaacctgtctccactagaaatacaaaaattagcggggtgtggttgtgcccacctataatctcagctacttgggaggctgaggcatgagaatagcttgaatccaggaggcagaagctacagtgagctaagattgcaccactgcactccagcctgggcaacagagcaaggctctgtctataaaaaaaaaaaaaaaaagaagaagaagaagaaagtaaagcaaggtgatggaatatcacataggtgggggagggtccagcgatttccactgacatattatgtgggccacatatgtgattttaaattttctagtggccacactaagacatgaaaataaacagatgaaaagaattttaataacatttacttaacataagcaaattattatttcaacatgtaatcaacattaaaaaatcattaatggctgagcgcagtggctcaggcctataatcccagcactataggaggcggaggcaggggattgcttgaagccaggagttccagaccagtctgggaaacatagcaagaccttgtctctacataaaaaagttttaattatccatgtgtggtgatatgcacctgtaatctcagctacctagaaggctgaggcaagaggatcatttgagcccaggagtttgaggcagcaatgagctatgatcatgccactgcaccccagcctgggtgacagagtgagaccctttttgtaaagtctctttaaaaaaaaataattagcaactcttatactaagtctttgaaatctaaggtgtattttgtacttacagcacatctcaattcagatactaaagtttcattagaaatactagatccatatctagattttataaaatttgcaaacagtagttcacataggtaagttgctccaaacatgcttaaacattttccggtaacacacttgaggaggccgagacgggcagatcacctgaggtcaggagttcaagaccagcctggccaacatgttgaaaccccctctctactaaaaacacaaaaaattagctggatatggtggtgcgcgcctgtaatcccagctactcaggaggctgaggaaggagaatctcttggacccaggaggcggagcttgcagtgagccaagatcacaccagtgcactccagcctgagcaacaagaacgaaactccatctcaaaaaaaaaaaaaaaaaaattccagtaactcaatcaagcatcagtttttacattgacatgttaattcatcagaattaaatgaagttagaaattcagtttctctggagctctagccacatttctagtgctcagtagccatgtgtggctaagggctagttggacagcaaagagattaaatggtccaggtgtcattgcagaggtgccattagagctaagaccctaatgaagagaaatcagcatctggcgtcccaagagcgactggtgcaaagccctgaggcaggaatgaacttgggccccaaggaaggggaaggagatggaggtggggggtgggagggggccacgtagcctagaaacgaaggccagataaggaattagggtttattccagcttcatgctggggacaataaaagacacaggttccccacccttgacttctgccagaatggcctcgggagttgggaaggccaaggggacagatattgacattgtctccacctcttatccctaccctggcacccttcccaagccagcgcacgcctgctccttcaatgcctcatcttctccccgtttgtctccctctctaggatttggtatcagcactaaattgtgggattactgtttccacaccctcactccagagaaaccccacctgaagacgcagtgacaactcccaccccctccgtcctgccctcagcccggccctggccccttcccgacccccacccgccattcagaccccattaagaaggttggcttggccaggcaggatgggctgtgtccggccctgcagcctagtggaaggtgctgagggggccctgaggcaggaccgccctcctgacccctggtaggagggtcacatccacttggtggccaggtggcccttggtgacccacttcttcctggagcgtccctgcctagagctcagcccacaggactgcttcaggccgtggccacaggtagcagccgcaaggggaaatgaagaaaactgagccctcgtggccacctgtgtcacccttgtgccttagcctcatgggctgcctaggagctgcctgcacggcacagctcgctttcacagtcagaagtgggtctgtgggatctgtggtccctgtcctccctgctgtcccttctggggaggctttggtggctctgaggtggacaaagagctctcgcaagaagagacagcgtgatgcctcccacagtccaccccagaccctggggcagcccctctggccctgccagctgcctgcgtcgttgggcccagggtggctggcaggagtcccagctgcttgctttaggacctggcagcttttcttgccgtccctcccctgcctccagaatcacagcccttctccccaagggaggctgaggaggcttctccaccagtggcagccccaccccgtccctggccattcttggcctccaccccgctcaggcccctactcgggcgctcccagaaggagccacctctcagtgcctcacctccccctgcctcccagcctccgcagatgaggttcctgccccttcctcctcgtaaccaaaaccctcactgctcccaggacggtcttatttataaaccagatacatgttcttagtctggtcccagaccaaggagctggtcagacggccctttctaatcctacatgttgagcttatgtaaaaaatgttgtttcctcctgtttttggttcctttcttacccacaaaccattactacttgaaacttaaaaaactcgccaagtgtaaaggctaaagagaagcagtttgacggaccttgtgatttgtactgtttgctgcggagctatttaaagattttggaataaatatacaaaactacggttgtgaaataaaaacttaaattgtatattttgaaaaataaaacactgaaaagaaaccaacaaaaa

SEQ ID NO: 140 - DNA, 12153 bp, Homo sapiens
tgtgacagcccccgggccgcctgcacttgcagcctccttccccccgagcggagctgcggggccggccgggccggggctggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccggtgagcctggcgggggtcccgggagaagagtgggaggatctgaggaggatgctaattcccacctgggcgcagactgacagatgaacgggcgataccccggcatgggggtccacccatctgtccagttttctgccgtgggctccgacggcgctgttctccctggtcgagccttgtccattatcctgttcctttttctgcaccccaccccacccggctccactctctctggtgctgtaaatgcctctctcccgggtctctggctcctcccccaccacttctgggtctctgtccccgtctctttctggatgtctctgccccttttctctctgggtctccgtctccctctttttccagatctcggctcccttctctctgggcccctccttctccctagatctctgcctccgcttctttgcgtctctgtgcccctctctctggttctctggccattgctctcactggatctctatcaactcctgactcagagtctctgtccccctctttctgggtctctcctcttccctggatctctggtccccacttctctgggtccctgtccccgtctctgtgttttaattctcccaccatgggtctctccgtctctctgtgtctttttccgtttctgtctggcatggagtttaatctgcagctaaagcggattggggctcatagcccgttgtccttgagggggtgaggctgggtggaagaagtcacagcaccctgggtccctgggagagaaaggagttagaggccaaaaatttcggctcctggggtaggacagccttcccaaaggatacaggctggggctgacagggactccctcccaaccaggttgatgaccccagtgaaccgagtgtccctcaggataatctggacacctccccacaggctctcacccccaaccccagctttggctctaagtcagataaattactcagctgcggaaaagcctaaaaatatatctggccacagtgcacgaaggagatggcctcatcagcaccatgcccctgccgccgtgccctcaggccctgtccccttggcccacagccctgaccctgtgtttcgctgagcttcagtccacctcgctaggccatgggggtcctttgctaagtctaacatcagtcttgcttgctgcagatcacctcttagctccaaagttaccccaccctctagtaacatgagagacaagaataaggctggacagaagtggggggaggtgggcaggaggatggtgcagtgacggaggttggtggtggaggggaagctgagataacctcaccccttctttttccaattttccagcccctccccaccctttttctcgcctcctttcacgagtttctcaaaatacatcagtgtgaagtcaggagaatgagagagagagaaagagacgtgctggtggagggggctggggggtggcagcgggagggatgtattcctcaggcccctccctcagtctctgcctctgtttctcatctgtgctagggtttctcacagtcaatctctctggctctcactctctgagttacctcttgggtccccagagacccccgggctctggccaggaccatcagcagggagtttgtgcagagaaaagcatttgcttccaatgcctggggtttgctctgatggttggagggagaggggaataccccatattagagacaacaggttgatctcatttaatcctctagacaaagatggggaaactgaggctccattctggggttggggagatcagtggatgagtatgagccccatgatttgaacccaggtcagtctccctcccaagcctagaacagagctcttccttgagaagagtgatgccacagctggtggggagcttccttgcacccagggtgacttggaacaaggacatgggggaatgggatgccagagagatgagaacccaaggtgcctcctttctgagagccaggtcttgggcagggggatgccgagggccagtaagggatcaggtcccattgctgttcttgtctgtgaccttggagtgccacttcagctccccgagcctcagtttccttagttgtacaatgggaagagaagagagagcagagggacataaggagacaaagacgtgggggagtggacagagatcctgagagaagcagagagagagagagggagagacagagaagttgagacatctcaatttggggtaatggcctcctaagtgttgtttttcctcatcgccaagtccccaggcctgagtttggggtatccagggaggggagggggatttacatctagggtctcccttctctgtccttgtcccctgcaaagcatcagggccaccttcatctctgtgtccttggtcctcttgctctaaaatgattgatatcaccttgaagttccctctttattctcttgcatttttgcccttgtcccattttatagatgtgggatactgagaccccctgtttagacagccttgattagagatctgacatctcctcatattaacaaggaatctcacatcaggggctgcaatcacatcttgagtttcagggtcaaatatcatccgatgtcaacctgggtcagtctaatctctttgggtgatgggttctgatgggtggggggagttactgccatcctgtactattcgtcctagtggcttcaatcccccctatctctggctctctgtcttcttcctcttggggtctcattcctactccttctgggttctgtccactccctggcttctcccacccctgtttcttaactgcccctccccacctccttaagttctaggatggggaggggttgctgtgttctcacagctcttccacctccctccccctggaccgtctggctgttccttcctcccccgtcccagtctccctcgcctccatctgttccagccccttcctgggatccagcccgatcccctggctgcctacccacctcagagaggggctgcacctcacaaatcacgtccccagcctgtctatcctccgtctcccaggctctccatctttctcttgcattctggatctctgttctcatctctctgcatctatgttctatctcctgggtttctgtccccgcctctctttgggactctgtctgcttccttctctaggtttccatctcttccctctctgggtctctgtccccctatttctaggtctctctccccctctctctgggtctctgtctccctctctctgggtctctgtcatcctctgtgtctctgacccctccatctctgggtctctgtccccctctctatctgggtctctgttcctctctctctgggtctctgtctccctttctctctgggtctctgtccccctctttctgggtctctggcccgctatgtctctgggtctctgtcccgctgtatctctgggtctctgtccccctctctctctgggtctctgctcccctgttattctctctccctctctctgggtctctgtccccctctctatctgggtctctgttcctctctctctgggtctctgtctccctttctctctgggtctctgtccccctctttctgggtctctgtcccactatgtctctgggtctctgtccccctgtatctctgggtctctgtccccttctctctctgggtctctgctcccttgttattctctctccctctctctgggtctctgtctcttcctctctagatctctgtccccctttcactggatctctctcccttcttctgtctgtgaccccctctctctgggcctctgtacaactccccccatctctgtcaccctctttttgggtctttctccacctgtctgaaggcacctctctctctctgcagcctctctctgggtttgaggcagccctccaaataccctcttcgtcatcacagacttgattctggatccagaacgggcgggggcgagagtcacgctggggaatgagccaatccccctaccagggccatctgtcccctgccaggacaccacccgccactccccctccctaccccctaggctggcagcctggactcaaggttccctagggatgcctgggacgggctgctggattcccagggtcctggacatctccccaccccctagcaaacgtggctgagaagcatctgttcttttgacacctttgctgaagcatctccttagcaccttttgcttcctcgaatagactcttatccgggagaggcggctggagagtctttgggcctcggagtgggggcacaggctcttgaatcccaaagggttgtctggggtctaagtctcctgagttgaaggatttgacagagctgggagagggggactgaagaccgtcaatgtgaagaaggagggggctgggggcctgaattcccggtctgagggagatggaggatttctggatcaggggggcgaagggagccagggacctggactcttggtgaaggaggaggtgcgggcttagaattctggatgttgaaaagcaggttttgccctggatcctggtcttgggggtgagggggctgggggcctggacttccgagtctctggctcttgctgtcccgcagccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcaggtagctcaaggcctgagcccttgcagagccccgccccgctcaccgagctccgcctacgcccccatgacgtcacactcacccaccagacgtccaggccacgccccttccgaaacgctgtcggaatagctccgcccaatccgtgcgccccttagttctgacctcgccttaggggccgcctccgtttcctaagccccgtcctgatctaaatgaagtcccgcccttatttccaggggcttgattgaaaaatgtagagtccgccccaacatcaggttccctaggggttgcccctgccccattttggacctactagcaattttgctcacgcctgtaccccaagctcatgtccccgggtcacatctatttaatctcagtcccatctcaggttcctccctgaatgtgatccttttttgaaaccctgccactgcctacgtcccactgcatgtgttgtgtcccttatctaaagacccacagggtctcccaggctacggtgcagtggggccattgctctgtcgcccaagctggagtgcagtggcaccatcactgcagcctcgaactcctgggctcaagtgactctcctgcctcagccttctgagcagctgggactacaggcgtgcgccggcatacccagctaacatttttatttttatctttgtagagacaaggtctcactatgttgcccaggctggtctcggactcctgggctcaagcgatcctcctgccttggcctcccagtcctgggagtacaggcgtgagccaccgtgccctgtcctttctcctattttaatttcagcataggccttgcccctgcatcagaaaagagtcctgatttgtgcctttgtcctacctgaagttcctccccttgctcccttccaatctggtccgcccccttggctgcttcgtgtccccgcctggaccctgtgcaggtcactccgcaaacgctcataagctggatataagtggagagagtcatcatcatacatgggcccctaggctttcatggaggcaaggaagcaggcaaagcaaggcgtctaggtggtgatggactctgttgttaaggcagcataggccctagcaacgtggaagagcggagtttgtagactttaattgacagaaagatagtgtgagctttgattggcaggcttttggaggtgggaggggttcctcgttgctgataggtcgagacgctaagtctgtgggtgctgattggtggagcggcagagcctggacagggcggctgatttaatgtacattttggcccgcagaaagcccagttcagctgggatccagagactgtcggcctcatacacggctcctttttctggggctacattgtcactcagattccaggaggatttatctgtcaaaaatttgcagccaacaggtacagtggtggggtctcaaagtgggcggtaactacagttgtgtgggtggagttagagggcgtggtcttgaatttgcgggctggctctggtaaatgggagaagcctggatttgggggtgggtcttagagaaaggtggggcttgcgattgaggaaggtgtaagtcagagaggtggtgggacctggggtcccggggaccactgggcctagcttgctgtgggcgggaaaggcagaatcccgggcatggctggatagcttggattcttttctctgacccttcccatcagagttttcggctttgctattgtggcaacatccactctaaacatgctgatcccctcagctgcccgcgtccactatggctgtgtcatcttcgtgaggatcctgcaggggttggtagaggtaaatccccgcctgatatgaccctgccctcgctcggaccctgcctcttctcagtgaccttggttttctcctctttagggggtcacataccccgcctgccatgggatctggagcaaatgggccccacccttagaacggagtcgcctggcgacgacagccttttgtggtgagaggaagagggatcctcactcctgaatctgagggaggaggggttggggcctggactgttgggtctgagcggggaggggctgggggggctgaactcctgtgtctgagggaggaggaggagactctggacctggactcccaggtctgagggaagaggggctggggctggactcctgggtctgagagaggaggggctgggggcctggactcttgggtctgagggaggagggactggaggcccgcactcctgggtctgagaggaggagctgggggcctgcactcctgtgtctgagagaggaggggttgggcctggactcctgggtctgagggaggaggagctgggggcctggactcctgggtctgggggaggaggagctgggggcctggattcctgggtccgagcgaggaggggctaggcctggattcctgggtctaagggaggaggggctgtggcctgtaattcagtgtctggaaagggggaagcggtgggggtccgcactccttgatctgagggaagatgggcctgttctctcccccgcatcctcccccttaggttcctatgctggggcggtggtcgcgatgcccctcgccggggtccttgtgcagtactcaggatggagctctgttttctacgtctacggtgagggacccggatgcctggttccgggtggcgctggggcggagcggggccggtcctcacctcgctcccatccccctcctgacccccccaggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacggtccgggaccaaatcttcggggaaggggcggggagagatagcaagccacgaacctgcacagcgtgtagatcagggacggttcctgcagactctagaggagacgggactggaacgcaaagagaggggctagaacctaggaggcgggttgcaacccgcggaggacgagattctcaggtgctgggggcagggttaggtcgggagttgagcaggattagaaccactgacagggcatagttaaagccagcagagaagggattagaatgtgggggttttgcttagaccttgagttgaggctgtattttgggagcatttttgataaaaagagactcctagggcaggctcagtggcttccgcctgcaatcccaacactttgggggtggaggctgcaggatcgcttgagcccaggagttccagaccagcttgggcaacatggcgaaacccccgtctctactcaaaatacaaaatacaaaaagtaaaaataaaaagaaaaaaagaaaaagacaggtccctgaggggcccggacacctgcggacctgagaggctaccatagggccaggaccccttcatcactcaagtgtcaccttgaggctaggatccctgggtccccacggcaacatggtgtagcccgcgcctttgggtccatagaagtttcagtgcggtcgggatcctttggtttctgcagaactacactgtggtccctgaagggacgcggagaagccctcagccccgctccccgtcttagcggccctcccctcgcccccacagaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtagagcccaggaggagagggcaggggggcgcggaggggtcggcgggagggaactggcggcgatcccgaggcagggaggagccggtggtgcacggaccgggcagagacgccgagccggcggccccgaaccctagtgtccctgtacacctgttcccgcaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggtgagtggggcggggcctgggccggctctaggacagcctgggtggagcagagccggattgagaggtgatggggagtggttacaggcggaaaccatccagcctgccccaggagtccctttctatgcaaagggccgtggccaacagggtggagccggggcagggcaggcctggatgaaagggactgtcacgcggccgtccaaggggccaccgcgcggaagggcagggtgggcgagacttcccgggtggagcagagagaagaccgagttgggcctggagggacaagacctgcacaaagttgggtgtggtaggacatgaactaggtgatgaagaggcgctaagagcaaggcacctggagagacagggtcctagggggcctgctgtctaacaagtgagatttgctaggcgtggtggcgcgcgcctgtggtcccatctacttgggaggctgagaagggaggatcgctggagcccagaactgcgaggccgcagtgagctatgatcgcgccgcagcactccagcctgggcgacagagcgagactttgtttctagaaaaattaaaattacaattaaaaattaaaaaacaggcagggcatggtggctaacccctgttatcccagcactttcggaggcgaaggccggtggatcacttgagctcaggagtttgagaccagcctgggcaacgtcgtgagactttgtctcttaaaaaaaataaaaaatcaaaaattaaaaaaaaaaaaaaccaaaaactcatgagtggggattgaggggaaggtgtgagcgtgcacagcagggatcctgcgtgttcggggagtggcctagtcaaggggtggagctacgggaggggcgatggagctggtgggcgtggtcagggctgggtcttggagaagtaggggcctggttagggtgggtgcgggtggcgtggagggcgcgaagaggcctgggcgtggaggtggccagactggggtggatagacgcggtttggggctggagcaggtctggaagggcggtgtggggcagcctgcgccttgctccggccgacactcaggagacgcgggccccccccgcccccgtaggcttcggcatggaagccacgctgctgttggtggtcggctactcgcactccaagggcgtggccatctccttcctggtcctagccgtgggcttcagcggcttcgccatctctggtgagaaccgcggatccgcagcttgggggactctggtcagctctgtagggaacttcctggctcaggaacggggcctctcagcctcacaaaaggtggaacatgagtggcggggaggggagagggttgagaacgtcccagtgggaatcactcgagtgagattccggtgtgacgccttccgacttgtctctccgccagggttcaacgtgaaccacctggacatagccccgcgctacgccagcatcctcatgggcatctccaacggcgtgggcacactgtcgggcatggtgtgccccatcatcgtgggggccatgactaagcacaaggtgggtgccgcagtcctgactcagtctgcctccaagtgtgtgcttcgtacctaactgaccacgtggtggcactgtctctggggtgccatccctgccttttcagcctccctgggtctctgcctcccttcctctaggcctccccctctctccgcctctgtttctctgtcctcccatttgacctcagccctattgtcccctgcagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagccaggggtgttttttcccagtgcagggttgtgtctttgtgtctctgtctctgtgactgtaaatcctgccctgccccactcccaataaaagctttggtgtataggctc

SEQ ID NO: 141 - DNA, 9311 bp, Homo sapiens
actggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggtgggcaccgctagtgggcgggggctggggtggtgagggagaggggttggggtggactgcggaaacccggactgagcgctgccgcggagaaaagggaggggagaaaagggtcgagaataatgcgtccactgtccctcccaggcccagaacccagagggaggctgcagtctggtccctacccttctaggccaagccaagcctatgcccgggcctgggcctggggggtgaggggtgtttaattggtactgtagcttcctgtgagaaccaggaagtgacactgtgtgagggggaagggggtggggatggctggctcccttgctgggaatggggcaggatggacagaggggaccccgtggggggatgaatgccctccaagcataccctcattgacacccatgtcaaactgacctctctggggtggggttctccaatgctcagattctggagcagggatgggcagggtcaattgggcatggggtcagagcccatgaatccttccagggaagggtgaggggcaccacccaagacgtgggaaggaccaagagcctgggttccaggttcaaggggagaagatcgggaggacagggccactggtctctgagggtggaacggttgcagggttgggaagattctccgtgattgcggggcccaggaagtgatcctgttcacttcaacctgcagtgactcaccctccctgccctgccctgtcccaaaaccagggcatggccagctgctcagccactccccctgcagcccacacctgcactctcctctggtgctgggatcccctgtcagctgcaacctcccctggcccccatgcctatcaggtgttgccccctcagtgcagggtgctcctgggggcagggctcactcttccctcgccagccccacctgcctgccacataggcctcagctctgctgaagcccacctgatgccctgaggcccactagtgcccacctgatgccctggctcctggctcccatagctccttcccggttcctgggcacgcactccaccacactgcatctgtctcccagcactagtgcccagcacagtgctgtgcacatcagacctctgcagaaatgcctggaactttaaggaaggagagagtgtagcaatggcccagcccacagtgcagggcactgcctttaccctcatttcccccaacccctgccagtgtgttataaaacaaagatttctgtccttggggccagaaggtcctaggttcaagctcttactccatcagctttagctgcgccaccttggggaggtctcttaaccactctgggccttgggtgccccatcatccccattttagatgtcacagccacaccaaagaatgaaaatggcaccatccatgtaggagcctagctcagtgtctggcacacagaaagagccctgtcctaatgacgctcttcctgtccctctctgctgtctacctgctaggttcctctttttctcttgcctgccaaggtagctgagcctcttgagtacatggggggaatgagggaactctccttgacataggccagagaaggagaagttgaagggctgaaggtggtttagagctgggagggaaggatagagttttggggggtcagggacataacaaaggctcagtaacccccaggcccctactgcctcatcactgtcacatggtttgcctccagctcccagaacagctccctttagcaggccatgggctcccctgggccctggcctccctgtctccatggtaacctgcagcagccactgcatctcctatcagggagcacaccacagggctcccgggggcaatgaccacctctgcggcacccctgaggacagataccatatggctgccatgctgaacccagtccaggccccatcatggtctgacccagatgaccaggggaaatcaagctggcaggagggtgcgcatagtgaagctggaataatgccccaaacacaggctggctctcagcagggccagccttcccagccacgaccccgctcctcaccatccctgcccagcggccctaggcacctaccttctcccaaccctgcctgggctctcaaccaaaatgtaatgaggcaggtacgattgttcccatttgcatttgacaagaagggactcacagaggggcccaaggccacgtgagtgccacagggaaacaggatttgaatccagcaggctgcctccctctagtgcaaccccaagactgacctggctctgatctcaaggcagttcaactccaagttcaaaaggaagggggacgagggctcagctgtgcaattggcctgagagcctcagaggtcagtggtccaaggctggagacttgcagagtagaggacaaagggcggtggagcaggggctgctccaggccttggtcatcacaacagctgccaggaggccacagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggtaagggaatgcatgcaaagtactgtgcttgccacattatagggcttgataaatataagaagaaaaggacatttccaagcagctcccatttccctggacaccccgcccctgctctgccacccacagcagggaaatcatgggatgttaggaactgtgtcctcatccctgccctactccattgcagggatggcagggggagattgcaggggtagtgactgcagagggagcctgaggcttagacaggactggagagggggcactgcatggcttcagtccttcagccccacaggcttcccttagtcccttcctcccaaagaagccaggcccccaagccccttccagggatctgctgccaatgccccctcctgcccagtgtctgtgtcaggcccataccccgcacctccccaccccacccccgcccagctctgcactgcctggttctgggcagctggtgtgtgggaggccaagccgggaaggaaaggggggaagggggtatctgtgtactgggagcccacctggccacctgcgcatgcccacactccatgtgcacagtgccaactcacatgccctggtacaggtgacccccatccccaaaagggactgaaggttgctccagcaatcacagaagacagctcaggtggggcacacactggcttctaacacctagttgacccaggcctcgcacacacagaccctgaagggtggtctatggggaaggggctcctggaccgcccccggcttgtgcctcatcttcctattttttcagtccctctcaccccttgctcccgaagcttcctttctctggctgtcacctctcctgtcacccactttgtcaatcagtctcccacctgtcacccttcctccccatctgccaccctctcactccacatgacacggtacctctatggtcactgtagtcttgcctgtctccccactcgctctgccccccaccacatccatgcccttcctgacctttcttctctgccggttgctccctgtctctccctccatcacctgtttcctcacctgacaccccactgccccatctccccacctcgccgcccaggttctctgtgaaaacgctgctggagaagtacacagcggagcccatcgatgactcatcggaggagtttgtcaattttgcagccattttagagcagatcctcagccaccgcttcaaaggtgggcccagcgcccctcccccagcggtccctcccccagcgcccctcccccagtggtccctcccccagcgcccctcccccagcggtccctccccaactcccaacctttagctcccagccacctctttctgatatactccatggactctgaaccccctcattgaccctggcccccattctgggccatgcacagaagcttgtgtacagatctgggaagagggagaggcctttggcctacaatccccatcatgggcaagcgatatgctggggtgcccactgcacacgtgcatgtgtgtgcacagatctttgtgggaggaggctgcttatgcttatgcatgtgagtgcctcactacatggaccctctccaaactccctggtcttgctgagccccctccctgccctggctcagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaaggtgaggggcctgaagcaagcaactgctctctgctctggacacagggggcctgcctgtttcttggtttttgccccctgtgcacagcccaggggagaagggcccacacctgatgctggacacatgagtccctctggggcagcaagtaaaggtgaacatgatttccagggccgggcatggatccgggtggcactgatggagaagcgcatgtcagaatacatcaccacggctctgcgtgacacccggaccaccaggtcagacttcccaggcaactcagaccacaggtctcagagtgcacctgcattgcccaaacacagctgatccttaagttcctgcagcatccttcagttcctggactacaagtcccagcaccagcacacatggctgatttccctcttccagcctggcctgcagtcccaggacgaactcttttttttttttttttttttgagaaggagtttcgctcttgttgcccaggctggagtgcgatggcgcgatctcggctcactgcaacctccgcctcctgggttcaagcgattctcctgcctcagcctcctgagtagctgggattacaggcatacgccaccatgcccagctaattttgtatttttagtttctccatgttggtcaggctggtctcaaactcccaacctcaggtgatcctcccgccttggcctcccaaagtgctgggattacaggcatgagccaccgctcctggccccaggacaaacttttaccaccaccaccaccaccacttgcaagtcaaatctaatgcccattatttgccatcaatgcccagcacgctccacccttgcacacctctggatgagcctcagccatgcaccatctcaagtgttggcttgctccatgatctacaacacagcccttctgtctctccaaacaacgaaagcagttctgtacttgctattcacggacacagagtccttatatggggagttcaatccctgcactgtgggttcacagggaggttgggtgcctgaggcaaggggttacaaggaggagtgtgcctgtgtgggcaggtgcatctgaagctgtctgggtgtggcggggggcatatacctccccatcccaattggccatacccagcctgatgtttttactgaattccattcctcagtctacacgtttcaagttaacacgttttttgcgcacctactgtataccaagcactaatgattaagacttgcttcctgatatgaaggatctgggtaacccagtacttgatgaggaaggggtagctcagagggaggagtcggctcagggaacacccattctaggtgatggggccacaggtgcgagccccaggctgaagggggagagaggctccaggcctgcgtgcagatcaggaaggagaattggccttccttcaggatggggtggcagtaagccaacaatagcagctctggggggggggggggcgctccaggggcctgctgcatcctctggccctctgcctccccacagacggttctatgactctggagccatcatgctgcgggatgaagccaccatcctcaccggaatgctgatcggactgagcgccatcgacttcaggtggggtctgcctgacggcagtggtggagggggctgtttcccccataaatgtcctaccccaacccctcacacccacctccaaccctgtggctcctctgcctcagcttctgtctaaagggggaagtcctggacgggaagacccccgtggtcatcgattacacgccctacctaaagttcacgcagaggtgagcggctccatgactgcggcggggcgggggacggggcctcgggacatcctggggacgtcctggtcccaccgccctcagcggccagcgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcggggcggggatgggggccgcggccgggacgtcctcccagccgcccgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacccctgacccccgccgccccgaccacatcaccgggtgaaccccatcttcacttccatcgactctaacatcacccgacacgagcacccacctctccagcatcaaccctctgatccagccagccccaccccgagatgcccacaatgatcttctaacattgcccccagcataagatccagtgacttccaacagccagagcccacccttcaccttcagttatcttccgctagagtggccatccaaccttactgcagggaccccacgtcactcacaaggacctgcggtgttgctctgcaaccttcaacacgattgcattcatcgcctcactcacctgcaccacaggctcactgaccgtcatcatccgccgtgacccccgacctcacccctgccgatccctgtaacacttcttctctacgcctttccaccaccctgatcttgcggcaagatccccaagacgatcttacacttcagggattcccacactatcctccactgacgtccccatcaccccagctgaccccaacaacactgcaccattccctccaactcccaatatttgtgcacgaatccctgtcacccctccaccccagtaccacctccacttcctcccgggatctggcccactgaccccaacaccgtatccccatttttgccgctcagatttcattcctgacccctccctcatccccttgctgaatctcccttcctcacttctcctacttccagccaggcctgactcctcctccccctcccaggacaggtctgatccccagtgaccacgcccctctggcccagggttccaaggagctcactacacccctggtcaatcaatggccctcactgggaacgcttaatggggccgagggcgccagcaactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctcccccaacccaacacccagtacccctccagaaagggctgaggcaaggccctgaggcctcaaggcatgtcctcattcattctcttagtcttttttttttttttttttttgagacggagtctcactctgtcatccaagttggagtgcagtggcgcaatctcagctcattgcaacctctgcctcccgggttcaagggattcccttgcctcagcctcccgagtagctgggattaaaagcgcctgccaccacgcgcagctaatttgtgtatttttagtagagacgcgcggctaatttgtgtatttttagtagagacggagtttcgccaggctggtctcgaactcctgacctcaagtgattcacccaccttggcctcccaaagtgctgggattacaggtgtgagccactgtgcccggcctctctcagcctttcttgagggtttagcacagcaatcgagagcttactttgaggtggcagaacacagcatatgcagaacccagcataaatctggctgtgcctcctctgaccatgtgagcttggtcaatcactttacctccatgagtctattctttgtaaatggggatgttgataatcaccaatgttgtcacatggtgagggctcagtggttttttagtgtcatgacatcctcgggggctcacaaactctcggggaactccttagactaatttgctcttatctcatgcacactgtgaactacttgcctgaccattgtttcccccttctctttggctgccaggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctc

SEQ ID NO: 142 - DNA, 24221 bp, Homo sapiens
gctgccgtgggctgcgcggggcccgcggtgtgtagagtccgccgccccggagccgcgtcccgcacccggacggtcccggtaagcgggggcgggggcggcggggaccgggccgtcacctgaggggcgggtctgcggccgcggacagtcctccgggactctgaggtgcttgtgtgggagccgcctccaaggtggcccccctgtgtcattggatgaaccccaagtagctgctgcctctacgccttgggggagtccctgaggtgctgtggggagccgcccccataaagaccccctgtgggaatggactcccgcggcgctgtctgcatttgctgccatagggagccccagcgtggaggggactggccccagagagcccttctgtgtcactgtgggagcaggcacaagggtggtctctggagctggctcaatggaagaccacctgggaacataggggagccgcaggaacctcgaggtggtggagcccccagagggctccctagaaaaggaggacctgagactgtgccctagaactgtgggaagcaacctctgactggggagggggatcctcccatgggatccatgagtgacttcccacggctccaaggactttggcctccaccgggatccctgtagggttccatgtgcccttacttgtatccccacaccgtggcccagaggtgggggccttctagggctgcagcctctttccattcctcctctttccccattcggatttttcttctccatggtagcccagttgctccacgctgcattttagtggagacagaaactgctgcgagagcacagggccctaagccgaggatgaggaccagtgaggcctctaaagcaaagataggagatttgagcccctaggtttgaccgtgcggaaggaagcagtaagatcaggtggaataactgactttggcaggtcctggagggaaaggcctttgaaggaaggaataaaggatgtatgggattgttgagcaccagtacgctaggcagtatactaggtatgtttaaacatctcatataactcttacaacagctttgtgaaattatccccttttaaacattgagactcagagaggtttagcaatttgcccaaggtcacaaagctgatgaaaaacataatcataaaatgtttttcaaattttatttgggaaaaagtactaaggagcagcagaagaaagaatagatatttgttaataagttgcattaaggtgcctgccgagcatagggttttgcagtggtacaagctcagtaaatgtgatgattaaataagtggatgaggacagtttaactggccatgagattgctgcaggaactgatttccacagaatccccagatttcagggtgtggcttccttcactggcagtcccactgtcatgatgccttggggtggctctggacctaattgaggcctctgggtgtggtttttgacagggctttctctggggatctagggggacccttctgcggatggagtgtcccaagaccaccctacctgctaccgaatactcgaaggagagaaaggagagacaggatcacttttaggaagcacgatccacactgtccttgtgaccctctgactacatgcaccggtggacaatggtccacagatagcactcaggacacttttgcccaagagtgcctctgcatgaggaggaggaggacaggaaaggtgcagagccaaggaaggctcactgggagtctgttagggggagcgcaaagggtctgcgccagacatagtgttgcctcctcatctcgccccctcgttgttttcattctagctgaatcccaagagttcaactttgagctccaaggatggattctggtttcttgtccaaaaacggagtggtgagagggccaagcaatgatattcattagagccattctggaagggttttcctgctccccttccctgctttcttccacacagtcaaacctagttaaatcctccttgaacagaagtggcttcctttggctcctggaattacatagtgaggagagagaccaagctagtgggaaaacagaacaacatagtttaccagttgttagattttttttcttttaactcagtgatgctaccttgcgcgcaactcagtggagtaaagcccgacaaaggtttttgttggttaggacctccccattgtaaagttgtttataatccccctttcagttcaaacccatctgatcagcttaacagatcagaataaataggtaggcatatatttaaagaaagtcagaaggaccaaacctgaagatatgatctttgttccagatcattgatttgtcattgaggttttattcctaaattggtcttttgttgagggtgcttattatcacacccactcatgaccctggaaaaatcactaaatggatccaggctctcccctaatcttggaccttggatatcagcttccccatgtccagcattgggtaaaattaagatttcaaaaatcctaagaatacagcctaactctccctagtcacagcatgagtctgcaaatcaaatcattccagaatgtgcacgaaagatgtcaccaggtggccttaaccttctcaaaaatgctctctccaaagggaaataaaaggggagagaacggctcacccagtttcatttgagcttacccaaatgtgtctggattttactgtctggatttctcaacctttgatctttcacatattctccaatcttctaacattgtcttcttctaacatttgccattcctttccttcaacatggatagtaagacctccccaggcccatttccccgactccttgcaattttttccactacacctgttcctaagtgaatcacattcatgcaaatagtttcccttctctttagctacagaatctattatcttttagtcccacacgcttctctccagcagtgctgcttggcttctgctatcttcatgtcccaaattgatttattcatttctgatgggaatatcattatccactccacccctcaatcttaatgaccaaattctgacaggaattgcttgccagctttggaccaagaaaccaagaccatcagtgtccagctgaagacatgattattttttccattagcacatccccctccattctccccactcttccagcaatcccctcagagactcacttacatttactaagtgctacttacttgccaggcactatgctagataaatatgagagtttcttgcccttgaggagttcacatagaatcagtctgcatttctctaatcattcactataaagagtaggaaaagtaagggggaaattatggcattacagaatatccacaggaaccaatatagagtatgccttttcccaagcatcactgaaactcagctgctgtgctatgcctcctctggcagccacattcagccctcctgccagtgccctgccaaaattacttttgcccatatactctgagtgtaaactgaccacatttttgccttccttatgatagtaatgacagaaccttttatttagatagcatgttacagtttatgaagcccttttagatatatgttggctgtttggttttgagaaatgcttcatcttactggggtcctctcactgaagcagagctgtgtgggctaattggctctctctctttttgtatgtttgtttttttgaggcttaggagtctcccagagggaaagccccagtgattcactacagtcaccacctacgagctcttaggttgcgaaggagtttcctgttgggtcctaaggccaaacaatgcactcactggtcagcgctggaacttatcagggcagtccctcttcctggcctcagcaaatccaattctctgggattttcttcctccttgaaactcaaatacatattctaacaaatattttaagcatactatctcaaaccagttctttgggctgatgctaattcttatgtgaagacacgtttccttgcctatttctatctagcccccaggctggcttcataccatctaagtcatgatggagtccccatatagctccatgccttggcatgtgctgttacctcttcctggaatgctttttttttttttccttatccactgatgtaactcctactcatattcaaaatttagctcaagcaacaccttttttttttcaatcctacacttatgccccctgcacacgcacatactcactgcattctcacaggctgaatgagcttccatttgttcattctaccatcagttattaagcacctgatttgtgcctgacgcatagtaggctgtactcggcgaaagtttgcagaatcaacagagaagtaaatggtgataattaaggtgtaataattgcattacatggggctgaatctgtgtttcagggaaccagagcagaaaacagggagtgcctctccatcttgctgaaaagctctgcttgctaagtgcagtctcaccagccaatcactgatggtgtgatgttccttaactgttgctctgcctctgtgggaagtcagcactgtggcttttaatgaagactcaggccctaagaggctaagctcatgccataattttgctctcatctatattagaactttgtgagctttcagtaaatattaaacagcagcaggatgccttgtagtcttgagctgaggccagaaagacagtttttctgtctagcctttctgttccttggaaaccccagaaaagccccatgtagttgtgactgtctcatcctgaataaacaggctgaatgaagagaggtggggaggtaccaggtagacctttcagggtctacaaacatgaatactaaaattagtttctaggctactgccaggtgacaaaatgtctgagtaggaacaggctccaagagcactgtagtgaggcactggaatttcctaaagcaacagccagtcactggagaacaatcggacccctcggggcttggatttcctcaaagacccgcacgagaactctttttgatggtttttttttttttttttttgcttaaaatcttgaggttgatgctgatgttcacagtaagctcagagtctgtgctatgcattcagcgtttgttttgtttttttacagaccctggttgtgttgattttccacactcttgcagctggtcaccttctgtgttaggcatatggcttttcctaaggctctcagccctttgggcacatgcttccaggagccaattgttgaccaccttgaaatttttcacttgtatgtgcagatactgctcgtgctaaatttcaaacccaggacaaaggaagtgcattttcacactttctacttgtgtccttaaggcaactgccctcctgtgggcctcaccatagtccacaggacacagcataaatgcaggggactgttgactttggtaatactggcttctcttttcttaccattgtgattgtagaaaccggctaaattgcagaatttcttaactctcctctgtagtcagagagaaatcatcctcgtgttctcatccctgctagccctgactcactgtccaggtgccacctcttgggaagtagagtagatgtgatgatgtgagctggtgactgcatagtttctagaattgagttttggagatttggtctcattagtctctggccaatttgataaagagaaaagacactatgatcttaaataaattgtttatgttgcccagtcatctctgcatcattcattcaacaaagatttaagaggctaaaacccttaatgcttaatggagatgatcaaacctgtatacaaaagacactttaattcacatgctctgtggaagtcagtaagaaccatctctacttttctccctcctgatctcagtgaaacacagattcctttactccacttgctcaacctattctctttggttgtctttccctttcccctcactcagaggttttctttgccttgttccttcctagggaagccctaacctccaggcagccacttttacttgcttgtgagccttttaaatagcctccatccccataccaagaatcagattgaaccagctactcgggaggctgaggcaggagaatcacttgagcccaggagtttgaggccagcctgggtaacatagtgagaccctagaaccaccctccatctgaaaacataaattttaagaagagaaaatcagtaaatgtactttacatttaacaggctgcatgaggaaactcctgcctattaggagtgttgcccttcaggctctccacagctctgaatctttatacagagtgctgggaaatagaggctccccagcttccttccccttccttatttctctatcagctcctgctccagagcagcccctcctcctcttactcccaccactttgcccttattaataatcccgctgaattctaagcaggtgctctgcagaaaatgggtgtgtcttgcaaacattacaagctgcccacaaatgtcttactgcctgacaaacacatctagacatgcttctcttacccaagacagattctacttgttgctgttttcatttcttccagttcatgaagtcagacggccctattccaccttcttgtcccgctgttatataccatcacctgctcctctcccctgagtttttttccaggccttccctagataccacaaattccctgacagccacataattcttgggacaatatctttttggcctcttttcgtcatttttagggaggcagaaacccccagtcccacccaccagcgaaagaagtaatcattaggtataatttgtgggatctttgcaacttgatttccttttaactctctctttttcctaggacttattccagcacaggagaggccaggtttttatccacaagcatttgtttttacctggcaccaatcactaccacttgtttctctaaaaatttgagctgattttgttaagttctcaaacatcccaggtgcactttttggatatttcagcacacacacttttaatcaaagtgtcttttgtatacagttttgatcctctccattaagtattaagagttttagactcgcttttaaagctgaattctgttgtgtcttcacagtttactgtcaaagtcaaagtcatgtcaattcaaaatgacttgatggtcttgtttggattttgatggtttactgtgaatagttctactttgcatttctgcccttacaggcataaaatggtctacaagattgaaccatctcagctaaaaggaatagcagtgctccaagagcctgtgcttaggactggaaagcgtttgtttttatgtttgttttgctagtagatgtcagcttcagtcttcatagaaattgctttaaggataaactcccaaaaccattgcaatgacatagttgaccatggagatagcttcatagctattcttggtatccttataaagaataatggtatccttacagttaataatgggttgtagcggatctacagtgtgttgggaggtgtctgtgattaatttgatgattctctgttaatgagtaagttcatttatagagtaacttcctaactggctggtctttgttcaataacttttattaaagcatctgaaaaagccaaaaacaaaggcataccattggttttcctctaatgaatcgttcttgaaaatgtgaatttagtattttttttccagatctccaaataagtgtttctcaactatttttttccagtgtttatcagaccttctgataaacataaaagtctcttgactgttccctaaaacttgtgatataactcctgggaggaggctgcctccaactatttggagagttagtaccttccgtatagccctaagaacaaagaagatactgtcaaactcactgttttgtagtctatgtcacacacacaaaaaaagcagagatggtttttaatacttgttttccaaatataaatacataattgataagctcttgaaactcacttatttctcccctcctcccggagtttctgatatacacctcccacctgccacaggatccagccaattcaccacttgagaatcattgctctggttgttgtgtttaaaaaattaaatcaagctgggcactctggctggaacctataatcctagctacttgggaggctgaggcagggaatcacatgagccccagagttatcaacaagtctgggcaacataccaagaccctgtctctttaaaaatttttcaaaaattagcacgacctgtagccccagctatgtgagaggattgcttgaaatttttcaaaaattatcaatcatgacctgtagtcccagctatgtgagaggattgcttgagtgcaggagttcgagactagcctgggtaatatggcgagaccccccccctcgccccatctcaaaataaataattaaatcattttttctcttttttaatagcatgaatatatcacaagttattcagtaatttccctattgaggttgtttccaccttttttcttttttaagagacagggtctcactgtgttgcccaggtttcagtgtagtggctattcacaggcacagtcatggcacactacagacccaaactcctggtctcaagcaatcctcatgcttcagcctcccgagtagctgggattataggagcaaatcaccatgcccaatttctttccatctttttaatcactgtaaaaagaatgctccaatcaatcatttttttttaatgtgatgaggtattgctatgttggccaggctggttttgaattcctgggctcaagcagttctcccacctcagctgcccacgtagctgggattacaggcatgtgccactatgcctagctaaattttttttttttacatatacccacaggtgaaagagcatcagcctcttggatacaataggttttctttagtcagaggtatattagtagctgtccatctctggtggatcttccaaccacacagactcctaagagaagcttgaataaactgttcatctttcaccacatcagttaagggcagcactttccttatatccttgtcttttagaggtgcgttcttcaaattgcagatttaaatccattagtaggtcatgaaatcatttcagagagtcactatcagggttgttttaatgaaataggatagaaaatatcagggagcatcacatgtagtaaaagtatgattgttccacaaaattttgacttcagttgcagatctataaacacatgtgtctacagggttatcacaaaaaatatatttcttactctgagccacagttgaaagttttgagaaacatgccttggggtttctgaggaaaacctagtggtctggaaaatgtaattgctcataataaaaatatgctcaaataaaaatatgaagaattatctgtcagttttgtattttctctcttggggtacctctgtcactgtaagttggggagttgcatcccacccagccatcgaacacgctgttgcccatgaggcatttgagcagcatctggggactacagggccagccctgtcacttcaagaacccactgggtccaaagcctcagcaaaaaatttaacatatacatactcttctctccatccccaccccaccctggctagattccctcattagatcatatgaacttttaaaagaagatgaaaaacaacatgagcattctaaatgcttcagactatatgttccaaatacactcattaacagacagagaactaaagcccaaagcaaccagcaacaggttctgaatcatagaacaggggacccaaaacaaaaacaagtcatcaagttgccaaccctaggatttgttttattatctaattaatgtgcaatgtgggagaattggaaaatatagattacaaaaagattaaaagtacatacagtacaaaaattagatcataacatgagcatttttgtaacttgctatttttgttaatatgtttgcatattttgagtatctttcccaccaataaatatacttctacctcagtgttttccgtgttgtttagtctttcgtggtacgtaatttatttccctattgcttaatatttgtttccagctaatgaaaaaaagatttcttaatcacaattttttatgaatttatttggggattaagatattttcattttaattacaatttattcttagttgtccactgaggcatgaataccctaaatgatttcctgaatgtgctcaataaatctttcttcaataaatctcctgtgccactgccctttaaggcagtattaagtatttaaagtcaatgttccttcgtcacatacttcagttttacaaacaaatttataaatggagtcggggaggtggttctttcctttcctatcaatcagtttataaattcaagaatatgaatttccttggtagtagtagtggcaaggcaagcacgtgagcagtgtaggagttcgcaccactgtggcacatacaagcagtgtttccgaaaagaagatggggctgtcatcagatagtacatgtattaaggtttcatttttaaaagtaaaaggaattctccacaattaattagctaattggaaaatgtttattaagaatctattctgttagatgcttaatagacagacacattgctaggcagtggagataagtactgtgtgggataaaacagtctaataggggaaactgacattgatcagtaatcatcctattgaatatgtaatgatgaaggtaagtgcccagagcagaagggcatggtgctgtgagcactccgacctggactggagtcagcagtgacttccccaaggaaatgagacttgagccttagctctgatagacaaataggcactagtcaggtggggaggaatgttcaaacttccccaaaacagagggagtatagcaaataaagactgaaataaggccattatggttgggacacagagtaaagaagggaggccagaccatgcagggcctcacaggccacagtaaagagactgattgtggggacttcctcctgaaagctgaaggaagcactgaaagttttaatcaggggataactcgacacctgaatgtcccagggacatctttaattcaacatatacaaaatccaatttaattatccctcttatttccaatttctgtaagtggcactaccattcttctagttagtccatttaaaactgccctctttcgccaggcacggtggctcacgcctgtaatcccagcactttaggaggccgaggtgggcggatcatgaggtcaggagatcgagaccatcctggctaacacggtgaaaccccgtctctactaaaaatacaaaaaattagccgggcatggtggcatgtgcctgtagtcccagctacttaggaggctgaggcaggtgaatcacttgaactcaggaggcagaggttgcagtgagccaagatcgtgccactgcactccagcctgggcgacagagcgagactctgtctcaaaaaaaaaaaaccaaaaaaacaaaaaactgccctctttccctttatccttcatccaatcaattatcaatttattcctagatttccctaattctatttccatggtaacagatacactcagtcagtattattcctgctatcatcatttccatttaaaccctctacctcttgtctggactatgatattaacagtaaccttcgaactggccttacttctcctcctacccgctgtcaccttttcccccaaacaaactgagcataaccgcctgtgcatccttcaaggtccactttgaccaccagtagtgtggtgggtctcgccttcctttaggtactctcagcactttgacttctttggtttctaatattaagtagcttgagtggtgagactgttctcctgtcttctgtttcctatgatgagcagttagtgccttgcacataatactgttcaataagccttgattagaatggattgagagcaaggctaaaatggactctgctccactttacttagaaaaagaattccccagctgacttccactaagtctcctcaggctaggaaatagcagaccagctttgcaatgtgccctgtcatgccctcactgtccaatgctgtgctctggtaccacagagaagagcaggtctgatgttactttttaacctgtaaaggatatggacctttcttgaacagttcagaagaattaaagcagaaaatgtgggagtgacagcgcagccttagaagtgtgagaggtaccttagagctttgtaataggccagtgtctgtaatagataagcagacccacagagaggcacagctactaatgagagggggcaaaggagtgtttgtgtgaccttgaccacatggatacgggtggcagagtttccttactgactaattcaggagtcctctaaaactaggagttcattgacttaaaaagtaggcatttgatgaggattagccccagatggattgttcatggcacctactgaaggagcttttcttgtctcaaaaggcctgaactgtgttgctgccagcttgctttaagccttgagtcttcttgcagggtagaggagaaatttggattctgaagtctccaaccatttcgaagtagcagaggtgtaggacccctggactaaattggttttaggacaggaagggagacagagatatcatttcatgcacgtagagtgctttccagtctacgaagcaccattatgcccattttcttacattatccttgtaacatccctgtgaagtgggctggggaaatagccctcattccatagatgggaaaaccaaagttgcaaggcctgtcagaaatcgaaccaaagtcatccaggcaaggtggtaggcctgtgatcccagctacttaggaggctgaaccaagggaatcactaaagcccaggagttcaagaagagcctgggcaacatagtaagacctcatctctaataaataaattaaataaataaataaataaaatttaggaaagaagtagaaccaacatcttctgatccttaacatgtgctgtctccacccccaccatgttctagaagagggagaaactgtttaatagcccttgccacttaggttgaaactgattagcctgacatcctcagccattggctgaacctgtgcccctctgctttttgtccacagagccatgggggtgttgatgtccaagcggcagacagtggagcaggtgcagaaggtgagtctggctgtgtctgctttcaaggatgggctgcgggacaggccttccatccgacgcacaggtgagctgccagggtcccgccgtggcactgtagagggctccgtccaggaggtacaggaggagaaggaagcagaagcaggaacctcggtggtccaggaagagagtagtgccggccgcgcagcctgggagcggctccgagatgggcgcggcgtggagcctgaggagtttgacaggacaagtcgattcacaccccctgcgttcatccgccccacccggaagctggatgatgacaaacctccagaaatctgcctggagcccagagagcctgtgagtatccagttaggacaggatcctcaagtcttagtgcatcagggagcaggacagggaagatggatgtgggtaaggtgatcctcaaaaccggaaaaatggagctgagtccaaaaaaatctttgaatttcttctgtaagaataaaatgtttgttatatcctggattcatcttagtgaaaggcttggggcaatggatgataaagaatgatgctgtggcaggtcttctgtcgaacctccccctcttccccgctgccatgggttttcaaccatggatagtactacaccctgcgggaggcaattggaaatttgggagggaggagtttggggaggtcacaacaccaggtggctactggtgtttggtaccaagaaaagcagggatgataaatgtcctgcaatgcctggaacaatctctcacaacagattgttctttctaaaagtgctagtagctccctgttcataaacatggtcacaaagacatgagcagctggaaggacctcctggttcttgtcgtccagaaagaaaacctcaacaatggcttcagttggggctgttcctctaggctaatctgggaagactcagccccatgcaggtagctctgtgcttagtggccttggaatcttgctgcctacatttacacatccctgtttcctcctgccatctttctgcaggttgtcaacgatgagatgtgtgatgtttgtgaggtctggacagctgagagcctcttcccgtgcagggtctgcaccagggttttccatgatggctgcctgcgccgcatgggctacatccaaggagacagtgcagcggaggtgacggagatggcccacacagaaacaggctggagctgccactactgtgtaagtctggactgcagggacagcagaggacttggcacttttcctggaggcccggtcttagaacacttgattttaggcagtgacctaaagaattttccaatgggctgggcgcggtggctcatgcctgtaatcccagcactttgggaggccagtgccggaagatcacgaggtcaagagattgagaccatcctggccaacatggtgaaaccccatctctactaaaaatacaaaaattagctgggcgtggtggcacgcgcctgtagtcccagctactcgggaggctgaggtaggagaatcacttaaacccaggaggcggaggttgcagcgagccgaaatcgcgccactgcactccagcctggcgacagagcgagactctgtctcgaaaaaaaaaaaaaaaaaaagatttttccaatggtacatacaagagacctagagctaggatggggtttctcaacctcagtacattttaggctggctagttacttgtttgaggggccaagtgcattgtaggatgtttagcggcaccctggccttaatcccctagatgccggtagcatacatctcaatgtgaaggtagcaaaatcacccccggtagagaacctctgagctaggagattgactggggcctaattactcaaaagtaattctgcttggagcagttctttctctaatagtctatagttgtcattcattgtatccatatgaaaactaacctgagatcctaaccagcttgcttccagtaggggtagattctatcacaggaaaacttcctaggcctgagatcctcactcagcctgccacctgactcataagcatttgctcttcctctttgaagtggttattatgtgaattaaatgacaaagctctattgattcagaacttcgcaaattatatataaatgccttctaacttttaatgaaggacagagtctaaggtttccattgaaagccagatttatatccatttctcactacacctgaatagagttcaagtcttgccttattgatctgttgtcctgcagatatcgtcattgtttattgatttcagagtgaggagcacctgctgatccccccttcttcctgctgcttagacgaaagcagagatgtgccactttctaacaaataactcttcctctatggcttgttatggaacagctattttcagccactgaaacacctgtccccatggagtacactgcagcagaccctgctgtaccggcgaccttctctagtgcctgtcaccccttccaaatgccatcctttcatctcggccactctgctttgcggtgtgctgctgctataggactggggtgaaggggtcacctccctaacccccaggaacacactgctccctccccagcttcctgacacagtcctaccatcattgccaccatgctccactgggctttttacagagcctccttccaagtacctctcctttctttccttcccttcacagccaacaaatcttcttcttcttttttttctttttatgagacagggtctcactgtgtcacctggctgaagtgcagtggtgcgatcgtagcactgcagccttgaactcctagacctaagcaatcctcctgcctcagcttcctcagtagctgggactacaggcacaagccattgcacctggccccacagccaaacttcttaaaagaatttcaccatctcctatggtttttcaaccacctatcatataatctgacatctgcatccatcattctgcagaactgttgcttcctaaggtcaccagtcacctcctaattgtcaagtccactgaccttttctgaggcatcttcttacttgatctctctgaagtatttattacttctttattcctctctcttttctttaggatttaagtatttttatgagaattattgcataagatatggaaatgagagaaaatagaaagtcaataaaatcccacctcagtggtgtaaccaccgttaacattacctcccacattctgcagctgtctttgcttggtatccagtaccttcttctctactgatgctcttccagccttagtctctgaccattctttctcaatgccctttgttagtttcttgtctcagtcctgtttctcagggttctgttgtttaatactcttcttttctcactgcgccctctttggtgacttcatctacagccaccatctaaacactaatgactcctatttctgtgtgtccagacctaaatttcctgtctcttgcacttatccaccttgatatctcacaagtacttcacactcatcatgccccaaaatgaactcatctttgcccccaaacctgctcttcctccactccttatctctgtgaatagtaataccatgccccagttaccaattccagttcaatctctccctcatgcctcacatccagtgagtcatcaggtcctgatgatgctgcctctaatatctctcttcccttcttcattctcatgtctcagtttagctgctcatcatttcttgcctggactgttgcggcagcccccaactgctctccacacctccagactctgccgctctaatccatcttccacacagcagccagagatctgaccacggcactccccacttgaaaaccctttggtggctcccttttgccctcagaataaaggcctaatttgaggggctcgataaagggtattggaggtacttcatagtaggccccctccttccctcacacacacactcacatgtactccaaacctcagccacactgaacatctcacagtgttacacaccactgtggcgcccagtgtttactaggtgctcagtaggtgtttattgaaagtatggtttgaaagaaaaatacaactattatatattagtttttaaaaagtgttatggaagaaaaagaatggtttgagttctttatgaaatccacgtatgaatactcatgaaatatctgctcttgtactttgcgggtatctcagaggaagaaaatgaccttgtactagaaaggatctttgatagtttaaagactgtatggtaacgtcaacacaataagatattggtgctcctttggaattaaaacttctgtggcactacaaaaaaactcatttggctttaggagccttgtaataatggcatcttttaaaaccattctggggttatttaaagtgatacaacccacttggagcagagctaggattaaactttttttttttttaactaaaatacatttttagcacagcctaacacagaagccaagtagataaaagggatggagatggagccgctctgcttgatggagatagggattcacaacctgcctactcactagcccccttattccctgcagcagcttcctaaggcacttccaagaaatccctaggttagctcagaggagaaaaccactgttttagtaaagggactcagtgctggagtcaggatatctgggttcttggggaagattctgccccagagtaaagacaactctggccaagtcctttctcctctctggggcctcaatctcattgattgtgaataggaggctgggattagatgatcttggaactgctttccagttgaaattctatttctagcccccttgaccctggcctttcttactggcctgtatggccaccgactcagctcttccttattttcaggacaacatcaacttgctgcttactgaggaggaaatgtatagcctcacggagacctttcagcggtgtaaagtcatccctggtaaggttgggtggtgctgcatggatggagaggggccgggcagatttctccttcaggctttctagaatgaaccatgaaaggagtgttccatatttagtgggtagagggtaaatgagtccttgttcctgagttgttggccagcagagtcacctatccctgtcacagcctgggtgaccctggccatgggaggcagagacttagcaagagctgtgggtttgggggccccgagggtgccctggaggtgatggaggtgccctgaggctgaggaaggatgggcatggctagcacggggtgcctcccacagattgctccctgacactggaggactttctgcgttaccgccaccaagcagccaagcggggggaccgtgacagggccctgagtgaggagcaagaagagcaggcggcccgccagtttgctgccctggaccctgaacatcgaggccacatagagtggcctgacttcttgtcccatgagtccctcctgcttctgcagcagttgcgtccccaggtgagggccagttggggcaaatgttcctgggatactgggtgacaagggcctgggaggcacgctgggcagattgggggagcactgggtcctgctcaagcagggacaagtatcaggaatgggctcaggttccatccagtgacagatgatctggtgcccaggctgaggaaactgcgtgaggaagactgatctgccctgggccgcactggaagtgctgatgcctccagaagggctctgggcagcttctaagggaggttgcaaaggtggtaatggagataggattctctatggcttggcagtttacaagatatcttcacctctaagatcttgtctcttcttccccagaactctctgttgaggcttctgacagtgaaggagcgggagcgagcccgagccgccttcctggctcggggcagtgggagcaccgtcagtgaggcagagtgccgccgggcccagcactcttggttttgcaaacggttcccagaggctccttcctgcagtgtcaggtctgctccttaccagtcctggtccccactcagcctctcctcctcccttttccatgccagtggcccttccatacctccctgctccccctgccaacagccgagagaggagcctcctgtgcattaggtagaggatggtgatgcctacgggccagggcataggacagcctctgccttcaactcggtgttgccacatgtcagaagagcctggatgagcatgtccagagccttgggcttaccagagtttgggagggggcaggcatttcactatcccactcctaaccacgtgtcctcatgcccagcagcatcagccatgtgggtcccatcgcagatagcagcccagccagcagcagcagcaagagtcaggacaagaccctgctgcccacagagcaggagtccaggtgagtaggacctcctcacctggccatttgtaccctctgaacccccacaaaacacacaagtaagagagggcattacccactcccactccaaaacagcaagcgcccacccaagaaaccaggctccaagagtgcacatttgacccaagtctataggaccagccagctggtctgttggcctggtagcacagccagccatagccaggtcaggcatgagccaagcttccctgagttttgtgtagctcaagccatgctgcccctgggatcagggctcacgcgtcttcaaaccagcctcctcaagccatgctgcccctgggatcagggctcacgtgtcttcaaaccagcctcacgactctgttctttgcttccactccagatttgtggactggcctaccttcctgcaagagaatgtcctctacatcctggctgctcgccccaacagcgcagccattcacctgaagcccccaggatagcatggagcagagaagctcggtttgaggacagtgacatcctctccctcctttcctttctcccttcccccaccaacctctggcacagagactcatggggttgggacactgccagcgtcttaacttgtcactaagctttaaggcactgaaatcaccattcccctcacaatagaggcagtgaatgcattgccacaaggagaagccctgggagctgtggcagcatcctctcctggaccgcccctgccccacatcatagacgggacctgccaccacacttatatacatgtgcacatgctgcccagctgtccatgccttcagaagcctggttctttttggttgagaaaggaccaaagtccctttgtgaagcccctggtatagaggagggggtctctactcaccccttctataggcaggccagttctaatttccaatagataagtctctggccaagtgattcttaggaagggggcatgtcagactcgcatgcctgcctagagctcctggagatcctaatgggccccgctttctccaccaaaaatcccttctgcagtcagctgctgttactagtaggtgtgcattatgtacctcggctgtactgagttgggaaaagagttaaacatcaccactgaaattcagccctttatttatttaaattccaattcctggtgacagaaaaggcaactagcctggagaatcctgactggaagagggggaggcagcccttcccagggactcgggattctaggaacctctcagtcaggtcacctgagtccaaaagtctttagcagggtagtcaaaaatcaaggtgagccttcttggccccatttttcagatggtagctcatggcctagggccaagggggcctgaatggagcaaacacactggcaggagccacagccctctgtgttagatgcttcacccaagtcaccgaccacagagactgacgagagcacactctggaggaagaggagagaacggggctctgcttcctcatcattccagctcaactcaactgtagacaccttccacagcccaagaaagatctgcagagccctgagcagggactctttcagccatcctgacaaacaggataagaggctggggcttaagaagaggctctgcagagaaggtcctgggaaagccttacagaagaagttttccgcttctccctatcactgagactcggcttgagtggctgcttctcctcactgctcatcacatgtccttccccagcaggctagggcttgggcctggcatggaaggccttttggggcaatcagaggctgccacaagagcaccaagcctggcctccaagccccagccctccttcctaagtactcatcaaattcaaattcttcagtccgtgtgttatggctcatcttggccggccgtggggtccatgttctaggcttctgtttccaacttaatgacttaggcatagcgagatctgactaccaagagttattcaaaagggagtggagtgcagtcatgcagaagcaaacacgtcttcattgctcgaggcccttgtgctaaatcgggtgcgtacagaagaacacacaccgctcggtgctgaatgtttcgaggaaagcaaggagctgcggccaggggcttcttgagagccctgtgtagtctcctcctgtaggaaccaccttagctggaagcagggtggtgagctgctggggttggattatttgggactgaaatgaagcagacaggagacaaatctgggctcaggtgtatggcccacagcttttagaaatgctcttcagccgtcccccaggattgatccataggaggggccattattcagtctagtcaaaacaagaaagcgcaggactcctgggcctaagaactgcatctgaagcagccaggcctggggttttgcactgagatgaaagcacattaagcacaggggctcttacctactctcctggcaaatcatctcctgtgccactggccttgggctgctcgatctcacagacggggcattttgagtagagacaagctctgggctttgagagctgaatagcatttttctcctgcctcatcagtcacagggactggaagtccatcttgttccctgatccttcacagatcaaggtgatgcctacctctttggagctgctgcctctagctctccacgggtgagtgaggagagttggtgggccaggtcaggcctgccgtattccagggcctggcaaagcagccccagagttcttccacaacaggaacaggcccatttggatcacgcttctccctattccagaacagcaaacttcctgggtgagggcctgctacagagatcccaggggacacttccctcagcaaagagtagagttcccatcccacaagagtcctaggaagcaggaaagcacgaaggagcagccagcctcttctccacaggcagtcatctagctttttaccaaaggggaagtgccgttgctccccaagtccagagttgcagacgccctgccccaacccccgtccagaatctccctttgcagtgttctaatccccagagcccctctgcggtatgtatagagttgttaaaaacgttcagaaacccagtgaagcccatttcgttttcaagccctcccatcactgtgactctgaaattctgccaagtacaaatattagcgtttggctctaataagggtatgagaaaatgtttcagtcttttctttgtggctacccaaaattgagatcagtgtttctaaccaaggaaggcctgggttatagacaggctcctctgaagcccacttgccctaagcatttttcacctagcattcctcttcctcatgttcagatgtgaatgaaggggcagctggaggatgtggtggagctgcagggaccgagggtcagctgagcagtggccctggccacaaaaccactccaagtctgctccttggcttcctctcctgagcccagccttccccaacagaacacttgagcaagggcccctagagtatcccagggatggagcagtcccctcactctaggtactgatctaaccttcaagtgctcctcttcatttgaggacacctacagtagaaaccatgaggacattgcctctttctgccctcagcccaagtacctggggctagcagggcagataccagcctttctggtcctgctgctccctatgggatgtcaccctgaccttgcttaagtggccaagtcttagggtccccttattcctgtcaccattatgaaaaacacagcattaaactgcctgggaagaggacacctccttgggggagtgagccccaaggttatacccaggactcatagcccaaagcacaacctcggccattgcaggtttcacagcttcagtcagagtggtgccaggaagcccaaaagccaagagggaaggtcagcagaagctgcctggcaaggccccaggccagccaggcccaccccagagccaagagaaacttcaagcaggactgagaactggtagctggctctagtgatcctgaaagcatgttcccttcagaccagcagagtgaagacagacagatgtgtggccctaaaaggcagaacagttttgatgccagaacttcaggactgtcaccacagtccctttttacccctcctctatttacagtgaaataaaattcctattttcttttttttttttttttaattttccttatttcaagctcttatctgaaaaaatgctactttctcctaccacttagtttgaatttgcccaggatatctgtctgggcccctggctgcaacccagacaatggcgagatctcctggagtgggggatattcacgcatcgtgcctgttcctgacagctcagccctggtgtagggtgggactgggcattttctctgctgttacttttctgctaccactatttttggcaaccttggaaagaaaataaacaggttacagaatttcggctagcactaagggaaagctttttcctctgggccacatgccccagtgacccagagcatggaaagggggtcagctctggtctgggccagtgactaagaagcccaatcacattccagtttctatagcactgggtaggcacaacccacagttaagaacatcaagttataagtagccaggccttttcatagccatggtgacacaaaggccctcaagattagcctcctgccatcatgggttggcctgtgatctgtcccccagccaaacccaagtttgtgagagggactctgagaacacttgagcaacacttgggaatccaatgcgctctggtccctcatgcccttcccatgtgcttttctgcagaaggtaacttgacagcaagctgaggggaacgtccccaagccctgtctccctgtctctacagctgcatgctcctctgcgtggcccagccttcacagcgctccagaagaagctgatgccctgaggctgggcacagtggaaatcataataaagcgattgcgatgctc

SEQ ID NO: 143 - DNA, 10953 bp, Homo sapiens
ctcatttgtgtgttttctgagtcagcattagctaaattttccagaaggccatccacaaagtacagcctgggcgttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaaggtaggtttctcaccagatttccaaactgaagcaaggcttcagtcctaagcctcctaagctgttgactatggatttctgggaatgagggtgaccctcagtgtcaacagcaggtctaattggtggtactgctctgccaaaaatgtaccaccatattgtcaacttcaccaaaatgattgacatttacgtttgtatcatctggacttttacttttggttatggaatatttttaatgaggacattttgaaataaaacactgaagagaaaccatttgatttttactcttttttgtatgggtggtatttaaattttttgtagcaatgggatctcgctttgttgcccagcctggtcttgaactcctggcttcaagtgatcgtcctgcctcagcctaccaaagtactgggattgcaggcatgagccactgcatccagaagtaataatttttttttaagtatttcattgaagacgcaaaccatgattgtaaaaaatttaaagcaatcactaagcttgggaataatgggtaactttcactaaaattggcctgtttttatgttttttgggagtgttagcataattattttaattttgattttatcataccatgaatgaggtgcaatgttttaaaaaaatattcagtaaatagcaaattagctgaaaaaaatctgtaaaaatataagtttgaaaattaagccatcggctgtctactaaaggaatgacttaaagtgatcgctgggcttttgagatgcctaaatggaaacctcattttgcactgtaggcaaaaaaattgtaaccacaaatcactcattgcagctctgggcaaatgaaaatctgagcactttaataggaaaatgtgtgttcctatgctggaagatgacctgagatataaaatatgctagaaacagacattcagagttgatttatatgttgttgcattacattttataagaaaggtcagagttatatgattagttttttaaaatactgttactttcaaataagtttggtcctctttgaaatcctctggggagactatttttccccacaatgctgccattattcaaactattggacactgttttttgaaaatgactccatcacactctggactatcctcagcaagggaaaaagattttctagggaaattacatttttggaaacaaccaaaagtcagcataaccatgactgcagaataaagtagttgatgaaggtaagtgaataggggtgggaactatatttgagggccaagtatatagtgatccagagctaggtgtgtatatacaatttcatttaatcctctcaaaaagacagtttataggtgaagtgacttgcccaatgtcatgcaggcagtacataataaatattgggtttgaattcagccctatctgattcctaagcatatgctattatctgattccacatccttatatctaactcctaagcatacactatttctactatgtttgctgtttcctgagaaatcttaaggaaggagttactggagtactcccttaaattccagctccctcttttgatccctaaatgaaataggaaagcataaaatgactaatgttgttgacttcctactgggccccgcctctgctaggtacaagttatctaatttaattctgataaaaatcatgtgaagaagatatatccatccccattttcagatgagaatgctgacttgcctgatgtcgcaacagccagttaacaatagaaaaaatattcaaagctaagtctatccacctagaataagtctatcactcctctaaataatagtatttagagtacaaatgacatatgatgagagggtagtaagaccaattgataatgtgacaaataaacctctgcaatccattcccaaagaagtagctataagagacctgagcaatagcaagctcatgagctaaaagagccaaatttcagagcaaacggtgtgttcagggagttcagcctaggggtgtgtgtgtgtctgtgtgtgttcatttccttatagcactgtgaaaggtaaaacagtgtcattgttaagaactgggggccgggttgggcacggtggttcatgactgtaatctcagcactttaggaggccgaggtgggtggatcacctgaggtcaggagtttgagaccagcctggccaacatggtgaaaccccatctctacaaaaaatacaaaaattagctgggcatggtgtctcgcgtctgtagtcccagctagtcaggaggctgaagcacaagagttgcttggacccgggaggcagaggttgcagtgagcatggatcacgccactgcactgcagcctgggtgacagaacgagactctgtctcaaaaaagaaaaaaaaaagggccaggcacagtggctcacgcctgtaatcccagcactttgggaagccaaggtgggtggatcacctgaggtcggcagttcaagaccaacctgaccaacatggagaaaccctgtctctactaaaagtacaaaattagccaggtttggtggcacatgcctgtaatcccagctacttgggagaatgaggcaggagaatcgcttgaacccaggaggtggaggttacagtgagccgagatcacgctattgcactccagcctgggcaacaagagtgaaactccgtctcaaaaaaaaaaaaagaactggggttcttgcttggccatactggtgcacacctgtagttccagctactcagggaggctgaggtgggaggattgcttgagcccaggaatttacgaccagcctgggcaacatagcaagatccatctcttgggaaagaagaaggaaaaaagaggaactggggttttagaatcaggcataattgagtgtgtgctcctaatctgccaccacagcaaggttcatatggaggacttagaaatgctccttccatgttttcaaaaagaaacttccattagatatcaacctaggaagtggtcaaagcatttgactgagcatccaatacacagagctgcgtacaagcaattacttgagagatttaaatgcccttttatggatgtttgtggatgaagcccagtaggaataatgtatttgaatacaatacaacttggcaattttatacaggtctgtacatcccagaacccagagaaaagggttcaaaagaattcccaaatccattagattttgagtagaaatattattcatatcttacctattcaacagcctcagcttctgtggggtaatcaatcattagcagaccaaaaccaaaatgctttaacgataatgataatgttatgtggatttattaagcacctaccatgtggcaggcactatgctaaacatttgtattagaatttactcacttaactttcactaccctattcagtagacactgttactcccttgaatttataaacaaggaggctcaaagagctgaagattaaagagatgaagtatctaggctaaggtcacagagctagcaaatgacatatgctagatctaagcccaagtctgactctaaaattctgctttcttcatttagtttttctgccattcaaagtttactgccagctcctccaggaacttctgagtaagcctgtcccccagtggccaaaagacctggaactgagagcactcacattcttttataacaagtgtgacattttcagcccatctcacaaatagtagtgtccccaaaccacattggtttggggtattgctaactattctatgaactagagccctgaattctatctttctcaaagtctcagatgcttcattttacagactccagaaaggtttgcagtaactgcatcccttagactgcaccccaacaacaggtagccaaagcccctatatggtgagcaaggcatcttaatgcagtgggatgggatagattttgattgggcgacatttacagcttggacaagaacaagcatccatctagcccagcagatggtccttgtggaaaatgcctggtctgtgtcctgttattctaaaccccagtcccagccagatagacctccctgcgcatcaggacgatatactctgctgggaaggagagtctaagggctggaaacaaggacagcagcaaactgaggacctatgtgattcctttgcagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcaggtgagaaaaagctggtttcactgtcactgctggagttcttttttagctctgtgttcttgttcagcaatagagatgaagccttctaatcatttttctgttcaactagtgtgtattcttttacagctatggctgggttggagatggattcgtggtcatctctaggattagcccaaaccccaagtgtgggaaaaatggggtgggtgtcctgatttggaaggttccagtgagccgacagtttgcagcctattgttacaactcatctggtgagtctgatctgcaacctttccacgtggcattctctgggtatctctcactctgagacctgtctgggaagagtaaccctgagcagcagcagaagcaatcacagccacggccatctaattctcccgacactgtctctctggccaggctaggggtggcaatatgcccctcaaaggaaaaagttaggagagatataactgaatggcaacacacgagaagacattcaggaggctcaattaccactgccaccatccctgcatcctataagataagcaggcagaagggaaggaacaaaggtacagatgtatgtaatgcatccattatggacaaagtgatgcacagtcgtccctcagtgtcagtgggagattggttccggcaccccatcatatacaaaaatctacagatgcccaagtccctgatataaaatggggtcatatttgcatataacctacacacatcctcctgtacactttaaatcatctctaaactacttataatacctaatacaatgtagatgctatgtaaacagtcattgtactgtattatttgcttttttattgttgtattgttatttttctttttttcccaaatattttcaatccaaggttggttgcttccacctatatggaatctacagatccctatgagatatgctttatcatccccactttgcaaataaagaaaccgagttcaggccgggcacagtggctcatgcctgtaatcccagcactttgggaggccgaggcgggcagatcacaaggtcaggagattgagaccatcctaacacggtgaaaccccgtctctactaaaaatacaaaaaattagccaggcgtggtggcaggcacctgtagtcccagctactcgggaggctgaggcaggagaatggcatgaacccaggaggcggagcttgcagtgagccaagatcatgccattgcactccagcctgggcgacagagtgagactccgtctcaaaaaaaaaaaaaaaaaaaaaaaaagaaaccgagttcaaaggatgtaaacacatttgtctaacgtctcattactgtaaaggttcagactcaggtctaactctgaaaccgcactctttccactgttccacattcctttataattttaagaaccagacccagtctccactttatgaaggaaaagattgacacctggagggcagcactgatttgttcgtggtcatgaagtcacccactaaccttgcttgaagaccttggctgccttagcccaagtgcttcacctaagtacttctcctaaagtttttcttttactaaatactcacttgctctcagtttgtcataaggacccctgtctgattattacttttcacacatactcatctatctgaccttctgaaggttaggtggctgagaggtcatacacaggatagatttcaagatcattctcgaagatccgagagataaatgtgcaccagccaatattagcaaaaactgtcccagaaaggcaatataggatccaagtagttccctgatccagagggctttggcacagaaaaggcccatggagaaactttgaccagttccctcacttcatggatgaaacaactacagttcagaacacgggcttagcttgttcaaggtcctacggtcagttagtggcagaatcaagactgaaacatagggcttctcctaacagtgtatttcccatcttccttcccttctctgcctctttggtctatcatcactggctggggaattggtgagctacatatgcctgcatacctcatagccagcccatgcctgtcaaatggctttgctttttaactgccttcctgccagctggcaatgtgatgatacccagccctctgactaaacagagaagagccagaggaagaggacttggatttgtctatttcctcatggtttcatttaacttgtactcccatcccatgtatttcttttctttttttccagagataattttattttattattttatttttattatactttaagttctgggatacacgtgcaaaatgtgcaggtttgttacataggtatacatgtgccatggtggtttgctgcacccatcaacccgtcacctacgttaggtatttcttctaatgctatccctctgctagcccaccccccaaccccagctgatgctacccactgccacaaataattagggacttaaaatagatgcaaatttatattataatatattgcatggctctgccatttactagctctgtgactttgggcgagttattcaatttctctaaacttcagtttcctcctgtgtaaacaagggtttagtaatattgttcaatgagatacctatttaaacacttactgccatggtcaactcagattaagatgctttaacaagtgtttcctctctagcacatgcaacagattggaaagcaaacccttatccctctcctggtccctttttgttcacttctttttttaatgagcccagaaatatcaggtcttagcatatctttgtcctgaagtgacaccacatgtgtatatttggtcttccaatctatactttccttcctttcccttttccttccttccctattcatcaaatagttattgagcatgtgctatgtaccacacacagtgctcataccatgctgaccaagacagacggggtttctgctgccagagagcttgcagtccagtggggaacagtgtaatgagaactgtgacaaggaagtacaagaacatatgccaatcaagtcaacaagtctgcctgagaaagacagggtcaatctgagacctgagggatgagtcagagtaagctaaataaagagaggcaaagagtcataaaggtgaataaagcatcgtggtgcaaggcttggatgtaagataaagtgtatcaaggaatttcaagtaatttcagtatggcaggggcaatgagagaaaaagagcagatgaggctggcatgttagcaggggccaaatcacagaaggccttgtaggccatacaacaaagatagccactgaaggcttctaaggaagaaagtgatatggttagatttgctttttaaagaccattccagctgcggtataaggggtttggaggtagtaagactagaggcaagaagaacagttaggaggctgttgcaatacttttattccatgtttccctatcccaacagatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtaaatggtttctgtgtctatgttacgtgtgtatgtatgttcatgtataacagataattcatagaatcctgcctgtctttagatgaggcgctcaggacctgtcaaatactaataaaagcttaacacaaactcaactttcatgaagtcatagaatctgagagctgtaaagaaccttagtgattaagctaaaaagtgtaagtataaaagaatttcactgttgaaaactcaagacttttaaaaataaatcactatctgttcctatgcataagttctttttaaaatatataccctaaaggcctatgactttattctagtcatctctttctcaggcaggcttgttgactagagtaggtctcaaggccatggaggagaaatgaactctgtcatattgcaactgatagaattgagagtgtgagaagcaaggccaatgattctacaagcatgaagcaaagaagctggtgtgggcccaatatcataaagggctacagagaaggtttttctcctgtactgtctactgtctcaatcacctggatcatgcaatgagcattacacacaatgtttaagtgaaggaccaacaggccttgtctctgttccttgcaggtgtccccacggctctgctagtgcttgctctcctcttctttggtgctgcagctggtcttggattttgctatgtcaaaaggtagggttgttggtgcactgctagtcttgtaatctttgtcatgtttctatcctgtgctttttcagggtcactgttggcattttgctgatcaaaatggagatagcagtcctctgatataaatttctccctcatctcatctctttcccttcagcccaatcttttctatttcaggacatgcatgtcgtccagccatcagtcaatgactgtcctttgaaaatcaagaaattaaaaaaaattgacatctggggaaaatttatatgctttatttgatttttggttctttgtttttgttggaagagttatgtggtcagcctaaagtctggcctgcaaacatattgtccaatttaaatgaatccattaaggtggtgatgtcttaatgtattagagcatgcatgtgctggcatcactctgaaataaaggtatccagtgtactgtgccaatatgtaccatggccaaaaagtgttatctatcgttatgtgtgagagtctctcactttaatttcatgtttctgcctaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttc

SEQ ID NO: 144 - DNA, 15039 bp, Homo sapiens
tctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcaggtaagaagggacccactaggcacgggagaggccggcccgtgcgggcagaggcgttggggacgggaaccggccccgggtcggaggggccgccgggtgtgagtgacgccccggggttagagcccggattccgctgcctccttgccggagagcgcggccagagctagcgcggcgacttgtggtgcgcccggagccgcagctaccctccaagtgcgaggccaccacggggagccaggctgggggttggcgtccgcagccccgatcccctgcgactccctagccctggcctgtcgggagggcgcggggggccccatttccacgattcccgctgttgttattcgggttctgcgcagacggaaagttcccattgttggcgtccccctcccccgggccccagtttgtggccagcttcggccaaggcgagagaccggacttctaagggtgggtgtgcgcgtcagcgaagcccggcccctgcccgcccgaagaggcagcagcctccagcgtccccgctgccgaccctgcccctgcctgggggccgagggcgcttccccgtgggtgcgcgccgagctccaggcaagcgaggggcgcgtgtcccagcgtcgcgggccctagactgggctggcggtccaggtcccgcgggacgtcgagggtctgaagggaggtcccaaggggcgaggggaggggaaggggcgcccggccggacctgcacacgcgccgcggttcctcgtgggccgggccgagagctccggtgccgccgccgcgtacacccgcagccggctccggacgggcgaggggggcgcgcacagctcagcccggcggccgcgcggagggaggccttggcccggtgagctcgcgccccacccgggccgaggcccgaacagccgcttctttgtacctcgacgcggccacagaccgcgcattgatggcggctcggcggctcgcggggaggtgtgagcgaccgcgggcgcggcgggccggggagggcgcctggagggccgaggcagatggcgtccgccccgcccgcgcccccgcgcccctttctccgtcggcggctgcagcctcccggaacaatgtcattttttttatgaatgaaagtggcccggcgcttgaatgtgcgtgtcattcagcggcgtgacaggggccgtcgggaggtcagcgcgcgcttttagcgtctgctcgggcggccccgcttccaggggtgccggaggggcggccgcggggggagcttggctttcgcattctcattcagataaagatattactccctacggcccgggaatgtcagccagccccggggaagggcggcggccaggctgcggagcctctcctggaccccctgcgggcgcgcggggcctcccccagtcgctcctggaacgccccgcccacccctcccccggggcggcgcccccgcccgcactggagctggtgaaacaggtagtgagttgatcggtcaataaacttaatccggttccttaacaagatgggccgggcagtaaaaatacaaagacctcgtgaaatggactgaggtctaggctggcgcttgcccgggaacataaattatggagccttggctcgcaggggtcaagggcggtgggaaaggttttggccactggactgccctggccaccccaggccctgccaggacagcccccatctccccagggggccgtattcctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgtggcaccccttgttacagctgagcttgagtgggagcccaggggcttggggtctcctggaggacggggatctaaagtcacctcatctagggaggcatgcagccctcacctgagtgattcaggagtgaatgagccaggagtggagccacctttggtggggtaggggtcagcctggacctctaggctgccagctcaggctcgggtgccctcttcgaacctcagtttccttacctgtccaagagaaccgataatggcaggctgtttgaaggattaggccagataaccctggcaagccctctttagcctgcccagcctccagatcccttttttccggactttattgtgaaactccaggtggggagacagggaggctggacttttgggggccccctcctcttaggctattttatagctcctacctggcaatacctcctgtaccccagagagctgcagagaacttcatgtgcatccgaaaccagaatgtgttgtttcctgaccccaggccctcatctcaccccaaaacccaaataaacccctggggcagccagctccggaagcgagtctggatttgatccttgttctctggggtcaacccgaggggcttatgatggagcaaggctcccccatcctctcagccatgctccctcacatgcactgggcctccactgcagagacccagagcctggagaaaggttccccaggccagagtttggccgtccccagcaccctgcctaatggacatcagtcttggggccagagacccagggcagggagcgcctctcacccctaccctcactcctgcagccatttcagggcctggtgccctccctgagctcctgggcctgtggggtgggatttttactttgtgccacagtgggggaaactgaggtacaggaccagtgagtggcagagttgtggagactctgggacacagcagagggctgtcgttggcatgtggagcccaagttgaggtcggcactgtgtggggttggggcgccggcaggagcacgtgttgtgggatccatagaagggtgggaggtgggacgcgttgcctcctaccccgccttgggtacagcaggagttttgtctccaacgtgtttgggcaccagtgtctgtgtggtgtcagtggggcctcccttttgtggatcaagaaagaaagaacccttcctagggctgctggggggctatagctctccccatgcctggcagctgggtggggtatgggggctccacccaactgctgacttcccagtgggagtcagaccctgaacttatagcacccactcatgccccgtgtcacactgtccttcacctggtgctcgccacccagcccctgctggggtaccctggcctctgctggcacctagcaggcaggcagtggggggggcagtcagggctgcaccctccccaccacacacgggcagatggccactggtgtggctggcctggggctgctgtgtcccccgtccccccgtgctggaccaggctgaagcaaatacttgtgtggatggcttgacctgttgtcgccactcagaccaaaccggaaccaaccggctgttgcccttgggccagggcctgcagctgaggctgccataaccagcctgttctcggccttctggggggcctcgagcagctcccagctctgggtggtccccacaagacactggccaggaccggagggctggaggtcaggccaggagcccccctgactgcggggtccctacaggggcagtccttgagctgtgggtcccggtggggcgagggctccttcggatgcttcaggggatgagtgtgggcccttctggctggcagggtcaccctgggcactaggcgtgtgtggctggatcaggtgggttgggcagaagagggcctggccgggcagccagggactggtgtggccagagtgggcagctgggcccccgaatctaggccacgcgtctgcagaatgacaagtgatggcgcaacccgcccagctgggtctgaagaaggaggctgcctgggggaccacccacccccgtcccggccccaagcccgggacgcctgcctgcatgcattgtctggccctggcagggaagcctaggggcgattgtccccccagccctgcccatggtgtgtccttgggtcacaggctttggtggctctggggagctgggcagctactggggagggacccaggggccacctgcacatctgcccctgtgggtgggcccccaccccagcttctcagcccccagggaggggccagggctgctgacctgccctggctctcacagcttcctgcccccagcctggtcgtcctctgtgagggggccccagtccccctgcaggcagcaggactccaccccccggcccccttgagggcccgcctgggcctccccactccccggcctgtgagacccacttggccggacccagcgccgtgtttgtactttgctcttctcggtatgttttccgtcatgaccgccgtgtggagcttccataggagctgcaggatacagaaccttgcccaccccaaggagcccccacccccgccccggccccctcgcgctgctccggcctgtgctctgaccggtgaacccgcgcatcgccccccagaccgtccacacggccacgtgaccctgcacctccttccttctcgcctgttctgttccctggctgtccatctgaactgcttttcaggctcatatggggtgcgggggctactgaggacggacccctcctggggtgaatctgcaccacgagggggctggctggccaaccctggcaccccctctgagctccatttcagtcagaggccagcaaagggcagcctgtcccctttgcccgcagcacctgcccgtcgtggtgccgcctgtgagacaagcatggattttatgtttccaagcaattgaacaaattaaaagaacgaagagtcacattttgtgacactttgagatttgaattctccgtgtccatgagtgaagcatcatggggccactgctgtggggttggctgcaggttgtgtggggaaggcggctgtcacaccgaggcagaccggagtccttgggacagactggttggcaaagctgaagatagagacctttggcccttttgggacacagtttccagcccctggtctggtgggaccctggatctgggtcagagccttcctcactcagggccgccgaggcttccactgctgtgtctgtaaacggtgccgggtttgggggtgcctgcctcatggttgcccatcttccccacagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacaggtgagctctggggccacgccagctacagaaaggagccgagtgccgggctccctgagtccctgcgtgggtcaggagcggctgggggtctctctggtcattggtggagaggagggcacccccaggaagtgctgcccaaatgggggaccctgccccatctgggaggggcacctgggggcctcctggggcaggttgggcattggttgcggccatctctgccttgcagacgctccatcctcgggagatgacgaagacggggaggacgaggctgaggacacaggtgtggacacaggtaggagcagggtccagggttcaggccagccggggtggggcccgctgccaccgccaagccctgcccttcacaggcagctgagggactaaggccccggaacaacctccctggggtcaccccgaaggtctggtcccctcaggatacaggaggggctgggtcactgacatggctctagatgccccaccctggtggcagggctggggtgcaaggggacaccgtgttgctgatggggagactgaggcacagggccctgggggttccaggagcaggaggaggccagggctggcctgtggggctctggtgttggctataggtgaggtggaccccgcagacattagcgcagcagggcagggcactcaggtggctgccgtggggtggatggacccggggtgagggcgccggggcacctgccacaaccagtggcgggcagggtggctggcaggagggtggctggtgggtgggctgcggctgtgagagagcagtcggggacgatgcctggcgtcccggcctggaacggtggcaggtggactttgccaagttgtagggtggggaggtggggcttctggttttggagggagctctgaggggagtgcgtgcaggtgagggtcatcgtggcacagacatggggggcagttacgacttgcggactgatggtgtgtgcgctgggtccctgggccagtggggtaagcaggtgaggaagggaggctgagtccatgagagaaacagctgggggaactcaccctgggggtctccaggaggcctgggagggagctcagcaccgtggggtgcctctttccagcctgtgtccacactgctgcttgctgggcctcagtgcccctgatgggcgtgtgcctggagggggctggcagtgagctcactgaggggagggctgcttccctcctggggaatgccagcccatccttgcctggagtcccggcaggaaggcagcaccagccctgaggaaggagaaaaaccagttgggctgtgagaggggtggtgggagccctggacatcgagatgggaggaggcagggcctccagggtgccaccgtctctgggtgcccgccagacttggagctctgcagagggtggtgtagggtcttgatttccgtgggcccatgctgcccagctgcctccaaggctcctggctctgcaggcgactgggctcctctcctggtaaactgctcccaggtcctggcttgtccactagatgggcctgccccctgggtcttcagtctccccgttggtgggcctggccctggcacgcctctctgggcaggtgggctcccctggacaatgccctgtgccctgtgacttcacaggtccgggcagagcaccctggaggggaggggaggggacacacggcccagctctgagaaagccccggggaggggacaagatgtggaggctcctgggaacctcatcccgccctcttcctacacaggacgggaaactgaggctggggatgggcaggggcagctctgggaagggggttgttcagaggggcctctgctcccactcgggtcatggccttcacacgcacctcggcccgcaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggtgccgccgctggggctcctgggctggccccaagggtgccccttggctgcgggttgcgtgaggatttgggtctaggggttggagcttcgggggcagaagctgtgggggtgcttgtggggccaagtctcagccaccccacacctcagggccataggcagctgcgttgggacccgtttccgtgtctgcagagggccagcctcagccactgaagtccctgacatggagctgcccacgggcttcttgggggtgggtgcggcttgggcagcagtggtgccccaggacaggagggcagtgtggccaagccctccaggccccctctgggcctcagaggcggtggctgagccccgacctggccgattggctctcgtcagctgtgtgcagtggggcccgagctcactgtctgcccgcctcctgaagcccttagctttgttcccatggctgccgggtgggggccactgaattgggacggttgcgacactcaaagcccaaagagaaacatctgttcagagagaagacggtctcttgggggcggggagcaggcgcagggcgagggtggagtccagaccccgcccagagaggccgcctcgggccctgtccagggtgcaggttctgcaagagcccgggggagggcaggccagtgaccagaggttgtctgagggtctgggctgggttgttggggtggaggcagagacgtgcatcctgtgaaaccacagccaccgtgaagtgcctccacgcctcctccaggcagcctttggggctgacgcagcccagcctcgatctgtaccttgggggtctcccacatcctgcctcgtgcccggcggggctgcctcgggggcgtgcctgagccgggtctcttgtccccgcagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcaggtaacgactctgtcccatgccggccggcacaagagctccagctccaaggccctggccgcgcgccctgcacgccccgcacgcccagccctgctcgctcccgccccggctcgcgctccactcggggccgcctcggcaaggctggcagctccagcctccacggtgaccgcccgcttcgagccctgtggcctgcgccgacccttcccgcacgcctgcgacccccacaggaggtgcccggtgcccaccgggccggctccgtgccgtctgtgagcacccctttgcgcctctctccacccctgcccgctgcctgctcgcttccgcagcctgtgtgtccctgtgtccatcctccacctgcacccgcccggctctgcgctaacccgcatgctgcctgcccgcctgccgctcacctgggacagaggactcgccggtggaggggcctggcttcgggctcagtaccggtgtaccaggcggagggccctcagccgcgtggcggtgaccaagttggcggtggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccaggacggacgggaatcctgtgacttacggccgtcccgcttcttgagccctcactcctggccctgtgcccagtgtggggacaaagttggcctggcccggtcctggtcccagaggggccccctcagccccctcgagcccacttcccatctgggtccccaaaggcctctcctgtggctctggtgtctcccgggcgcctggtggcggtgtgggactggctggctctgctgggctccttctctccagggtctggccctctagactcactggcgttactgactgcgagaccctccagacaaggcgcgtgctgaggttctgagcccccttccgctcccagtggtgcctgcggctctgggccaggggcatccatgggagccccgtgggggggggggccaggccaggcctcaacgcccatgtctttgcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaatcttcattcaatgctggtggaagtcagaacgcccccccttctggcccagcactgacccccggctgtacctccacgccctgtcgcccacgcggcgccaacctgcccctgctgacccaagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggtcagtggtgctgagggccagcgttggctgtagggggcttggtggtgggggtgaaacagccaccagtcagaggcccggctgggtttaggggccgtcagggatgtggcggatgttgggtgtggctggggttctgtggagatgctcctgggacgggtgtatggcagggactgcccctctcaaggtgccctgtctggaggggcagcaagggcgggaggctgtgggtgacactcttcgtccttacgagcaggctgtagggggagcatggagggcttcctggaggtggtggctctgggcctcaagggctgggccaggctggggtggggaccgtggtgggctgagagtgggcgagtttgcacactcatggtccctctgcctccactgccaggctgaccctgggcaagccccttggggagggctgcttcggccaggtggtcatggcggaggccatcggcattgacaaggaccgggccgccaagcctgtcaccgtagccgtgaagatgctgaaaggtgaggagggggcggccaggggtgcagagcagggctgggggcgccgccgccgcctgacacaggccccccgctccgtgcacagacgatgccactgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtggagtaggctgggccctgccctgagatgctgggagcagcggggagaggtggagaggcttcagccctgcctcccaccccttccccagtgcatccacagggacctggctgcccgcaatgtgctggtgaccgaggacaacgtgatgaagatcgcagacttcgggctggcccgggacgtgcacaacctcgactactacaagaagacgaccaacgtgagcccggccctggggtgcgggggtgggggtcatgccagtaggacgcctggcgccaacaccgccttcccacaccctcccagggccggctgcccgtgaagtggatggcgcctgaggccttgtttgaccgagtctacactcaccagagtgacgtgtacgtgtcctgcagagctcaggcttcaggggtggaggcgggaactgggcagagccaggaccccagctgcagtccccaggcctgtgccctggagctcctgggtgtggtttctacccctccctgggggcagcagcgcagccctggcctattcccctggtgcccgcccaggtgtctgtcctgggagtctcaggacagcctgacctcaccttcccctgcagctggtcctttggggtcctgctctgggagatcttcacgctggggggctccccgtaccccggcatccctgtggaggagctcttcaagctgctgaaggagggccaccgcatggacaagcccgccaactgcacacacgacctgtgagtggcatccctggccctccactgggtcctcaggggtgggggtccctccggggctgggcgggggagggactggcagcccttcaggctgttcccgaataaggcgggaagcggcggggctcactcctgagcgccctgcccgcaggtacatgatcatgcgggagtgctggcatgccgcgccctcccagaggcccaccttcaagcagctggtggaggacctggaccgtgtccttaccgtgacgtccaccgacgtgagtgctggctctggcctggtgccacccgcctatgcccctccccctgccgtccccggccatcctgccccccagagtgctgaggtgtggggcgggccttctggggcacagcctgggcacagaggtggctgtgcgaagaggggctcggtggcacagcgctcaccccgcctcccgccagcaggagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctg

SEQ ID NO: 145 - DNA, 372452 bp, Homo sapiens
ggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggtgagtgactcgccttcctctgttatttgtctgccggagcagcccggcggggagggaggaaggagagaggcgggagagagggggagccgtgagccgccgttggctcgtgtgccccctaccttcctcaaccccctccccaagtcgtccccactcgcattagccaggcgcgttttccccactgtacagtctttgtggtcctttattttaaagcggcagcgcacctccagagctggcctccctccccgcctcgggttcccggaccggctgcaggagcttccttccccgggtcgggcggcggcgtctggcgtcctcgggctgggccattgtcccatgtccttctctgggcgcctggcgcgtgtcccaccgccgccaccgcgcctaaaggccaggctggaagcccggccgcacgctctgagagcagacgagtctgatcgatagtctacagtgtctccttattggcataaagcccgaatgtagcgctagcggtggatgtggggttttccccaggacactgtcaggttttatcgttagatcgctgcccgggaggcacggggcagcccgaatgcctcgatcactcccagagatcgttgccgcgactgttgagattgtagataaggtcctggagattcctcctccccgcccccccattcccttcctcacttccctcttccacaaataaagccgcagctagaagatgaacaacaaagaaagatgggtttaggcgctatcgaatggtgtgtgtatttgttcctttttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggatggcagatctgatgcaggagacctttctgcatcatgccacggtgggtactcgcctggagtagggatgggggaggctatctggcatcctttgtatttttgcctcgctttggggtttcttgagcatttcttcctttcccccctcctgtactggcaactgtttcccggtgcagtattcctggaggatgctagaaaggagacgctttgaaagctattctatctctaatggaggtatattatattgaattgaaaatatgtgcatgaaaagttttttttaaagcattatttggaagggtcttttaggtttggaaatcagtttatggtttcctgagattaattagaaatagttgtttgaaggatgtatatttattttagaatttatatagaaattgggaaccaaaagtaaaagtgaaatggaaacacatataaaagttctgtggtggttttttttttttttttaacaatgtactattgttgggagatttctaagagttggacctataaaggtgtcttctcctttagcatgtggcactactaaagacaatggtgagattattgtctggctttcctaaataatgaggactagattggcatgatttagaactgaggtttatttacatctggatgagccagaaatctgatatacagaatgaagtgctttgattaatttgtattgggaataatatcaagaaatgatgtagaaaaataatttattgttagaattcaaaacataaacatgcattttcctttggacaaaactgagctaactgaatggataaaatcatttaagatatctttacttaaggtattatttcataatatcatgtatgttttaaagaaacactgttagttgggaagtttatttttcattccttttatgttaaacttaggtccctctaactgtcagatagcttcacgtggatattggtacaatgagtttatactcatatggatttgactacacccactatatgtgttaacatatgtgtccttttaaaggattgactattttaaataacataaattctgaacaattttagagatactaagatcatcataaatgtcagttattcaaactagcattcacgcattcatataccactattttcagtcaaaaatttatgcagaatagctaaagaattactgctaagacatctagtatagagtgacaacttcagggataatattaaagtaacacgtgtttattcagtaaagattccatatatttatgggagagaatataattcatcaggtgattgttagataatggttctcatgtagtatttaagagctctgcttttcattcaagcctgttttgaaatattgaagaggtttttaatttatgaactcgtctattgctctttataaaatttttatactgctcccgacatagaattataggctcctccttctctgagagacagccaatcatcatttcaatgagttaaaaaataaaggatccccttttatcatgtgtttccctacatttcaaattattccttccttaatgatacattgatttttctttccgatggtaggagtacagtcaccaagaagacaaaaatatattttctcttaattccaaggcatatattgatcaaaataaaatactgtatttgaatggtattttcgtgcagactaagaatcattcttagctgcttgaggtttgagggttcacggctggctttgctgtcagtaagagatgctttgctcctgatgttgcagtaatccactgctgctgataattagacatcattactactgcgaaaagggaaagagaaaaggggagaggacaggctgaggctaattatctactttagtttaatgaaagaaagagagactgatggcacctgggaggttatactagaacagagtagacacaccacatagacttaattgaaacaagactatctttaagtctcatagttaaagaagcttggttctactcttattttcccaaaagaaatatagctttccaactactcttccccctaaagcctaaacttaactgatgataaaatcgagcaagttacaactgacttaaaataaaaatattgactactggaaaggataaatatgtcctttaatatttgtcctggtcatgtctaaacctgaggggacatatctgccactgatgtttagactgctttttgatggagtagatactgtttggtcaccaagcaacaacatccggcaactcagccattttaggtctggtgtgggacctgtgcttttgcgagcccgcctgcactgcacactcacgcgcacgcgcatatgcagtttgttgagcaacccatctgctttttagatagtaccactgttatttttatacattctttcattaaaagtgtcagaaatttagaagaatgaaatgatgaatgacttaaaacagttccgaaaacgatatagcaaatggttgacattgattacatccaacttttaagcagcgatagttttaaattcacttaactatggtaactctgttttacacatttggtagttccagtgtagtttgtttttagaagcttttgatcctgattaacgttttctggcaacaattagtggaaacatcacacttgcagtttaaactaccagaacacattataccatttgatattgtgaatggtaaacttagaaaaggagaaaatttattaaacgctctttttaaaaagtcctctgcattgtataaaacattaggaatttggtaagctcatgtttttgtctttcagtatcaagcaaagaaagtaatgaatatgaatattgaaactgtataatcaaaagatgtaatacttttcttaacctatatttgtaggaacagacacaaaggtctaaattatgcctttcttatatatatttctttcttatatttattccaatacaggtcttaaatgaatttccatccagaaaggaaaatgcattatctttagttgtgctatttacaaatgatgatttattcagttctgcaatctgtagcctcagatttcatattgttcttgctgtgcatactactaattgattactgtacagtgattataatgaatattcatggactgactcataaacagtaactgtttttgttatttttctgactgtggttttggtcataaatcctttatgctacatcagagtgaaagaaataataccccatgaggagtcctgtatacctttccacctggcctaactttatgcctaaggcacctatattaggccttgatctggaatctgctacagacccagttatttatcatgatactttgtatctatgacacaaagacaaatcatcatagtggtcactgagatggaagcacatttttgcttctatagtggacattgctgttgatagcccatgcatttttcttttcattaaagtactttgggagatcctgtagcataggatttgggggtcaaatagatcccgagaatgaatatcagcaatgtggcttattagctgacttagtgattctttgtggagttgtgaagaataaatcatctatgacaagtccccagcataggtcagctcgcagggaacagtggggaccagtagtaaaggccattctggcttgagtattaaggggcaggagatttcctctgaatataaagaggaaatatgaccctgttcgtgtatgaagactatcccacacttatttcttgagataccagttttttatttttccgttggttcttccttgtcctattagtagccacaatagggagatggggcaagatttggcactcgtatatatttcttctgtaatcttccttagtttgctgggatcctgctccctacgggtttactctctagactcactgcataagacggaggaatgatgaagtagaaaatacaggcatatggcaggagaactttcaaggactttaattttgtgtcaagtctataaagaccttttcctaatagctgttgtgtttgctaagactttcactctttgttttttgtttttttttttttggtctaactgggaaagatgaatgtgaatctactatgttttaggttatattcatttttacaatctttatataacaagataaaacaaacttcatggatagcatagatggcaagaaacatggcatagtgagtagagtgttgattttacagcacaatttaaatcctggctctgacgtttactggagttctgggtcggctaaagtttaactaaagatgcagtttcctcttgtaaaatgttagtattaatactagtcttactagttttgcatagttagtagtgtatataatatatactaacatatactatatatgcatatgcacacatatatacacatacatatacacacacatacacacaagcatgtggtatatgtagcatatgccggggacatagtaaatgctaaaaaaaaaagttgcttaaaatatgattcatagaacatgaaaatcacgatgtaattataattaggtatattttatgaactcaaaatcacattgcaacacggagctaaaatacaaggtcaagcgcggtggctcatgcctgtaatcctagcattctgggaggctgaggcaggcggattgcctgagctcaggagtttgagaccagcctgggcaacacagtgaaaccccatctctactaaaatacaaaaaaaattagctgggtgtggccatgtgcccttgtagtcccagctactcgggaggctgaggcaggagaattgcttgaacccgggaggcggaggttgcagtgagccgagatcgcaccattgcactccagcctgggcaacagagtgagactccatctcaaaaaaaataaataaataaaaaaaaagaaagaaatacaaggtatacttgtatgtatttatgtacatatgtattattaagatttattctacctactccatttttggaagaaaaaatgactgttattgtaaaagtgatactgtctcagttttttaaaaaagttaaatgaaaaggaaagaaataaagaaaaagtcataccaaatgtcccatcaaaatataatcaccgtaagctaattatgaacatcattctagattcctctctagaaatatatgccaaaagaagagtcgataaaatgactgatagttgcatatggacaggcagaaataattttctaaaactaggatgatgatgatatgctaatttaagtaagaataagaaaatataagattgtcaatgcgacaaaagaagaaatacataaaatttaatgaattgctaatagataaatgtttcttctcaaagatatttattcctgaagttaatggaaaagattaagaaaaactttaagatgttgaattacacttattttaccaattacaaatttccgttttataagtattattgactttctctaatgataaatgagaagcatattttcacttcttcccacctccttgtttcttagatcctggtttacatttcatttcacttattatattatacttattatatattataatttattatattcattatattataattatgtttgtgttgtcagggttgttgatattaatgttaaattatgtaatttcattttaaacattattttcctatttaaatgtttattatctgttttgttatctggtttcctttacctctgaattccttgatttgattgactctaattacagtttatcatttttttcctaaagtaggtccatgcactctattctttgaattttatatacaattgagagtatttgtcttttacctttatccttgaaggacaactaaccagatgcagattctgtattttactttttctctcagaacattatagatattgtgtgtgctctgtaaaattctaaggcaaattgattttcccaaatttcatgaattgtttacttctttatccttgaaattaaattattttgctaagatatatttgaatttcttgtctaactctatattttgtcctgcgtaactgtgcccctgtttatgacttcagttaggcctgtgttctggtgacataatgtatatcttctgaagtctaaatctgtacagttgatccttgaacaacacaggtcaggattgcctgggtccacttgtatgtggatttttttcaataagtatttggaaaatttttggaaatatataacaatttgaaaaaactctcagataaactgcataatctagaaatataaaaaatctaagaaaaatatatgccatgaatgcttaaaatctatgcaggcactagtctatttatggcttaatagactatctttttgctaaggcttgcagtcaacagtagactattagtagttaagttttgggggagcaaaattatatgcaggttttcaggggcagagggtgtcagtacacctaaccccaggttgttcaagggtcagctgtattttcgattttctattgggtgttttcaccaagatatcccaaaatatctcaaattaagtatgtctagaaacacatttttcttccttccattttcccatccgaggtcctccgagctgacacatctttttcttattccctctctccatggatagcagcacaactttacttacctgtacaaggtgaaatttgtatggcagccttgatttctccctcttatagtcaatgttcaactgttggttgattctactaaactaatatttcttgaagccatcagattctcaccatataataaaatatgcctattgcttaataatttgttaaatttccacaaaactattttgaagaaagatttaatctccagtacctggcataatgggtgatgcattttgatgttcagtattaatggaataaataaaaatcacttcccaatctgacatgacataatgggacattatacaacagcttcttatttaccaccacacaagagctttttagttttatctacatctatatctatctgtccaactgtccatccatccaactatgtgttttaattgtgataaaaaaaacacacaacataaaagttaccatattaatcattttacattgtagacttaagtagtgttaagtatattcacattgtcttgcaacagatctccagagctttttcatcttgcataacagaaactatattatacaacagttcccctttttcctttctctccatcacttggtgaagtgccattttagtttctgattatatgaattgaactactttagatgcctcatataagtggaatcatacagaatttgtctttttataactgactcattttactagcataatgtctttaagattcatccatgttataattatatgtgacaagattttcctccttttaaaggctgaataatattccattgtaggtatatgccattttgtttgtccattcattagttgatggccatttggattgcttgtacttcttttattgtgagtagtgctgcaatgaacacgagtgggcagatatctcctcaaaaccctactttcaatttttctggatatgtacacagaagcaggtttgctggatcatatggtagttctaattttttgaggatctccctactaataataataatttgaaacaaaaagtccctttaatcttcacaatagtcctatggtattaacactttttattatacttatgtgaagattatggtttacattaaggtgaatttctaaaaatcacacagcttgggacaagaaaccatttggattctaaggcccttgctttaaatcactggtttccaaattctaatgataacgtaactcatttgctaaaaaagattcccccagtatatacacttttataaactacatctatataacactctaccaatacttaacccattataaactatatttaaaagtacaaatatattgggctgagattaaaatatatataaatccaagttttaacatttccttcttcacctcaataggttatcttatgcactgcctgagtgtacacataccaatttgaataccttattctaatttataacaccatattgcctctcagagaacattgaatttaagactttacactcagctaaaatactttctgtcatcttgtaataaaatatttttatatgtagagggaaactaaggaggaataattgttgacctcttagttattagtacattcacaactacaaagatttcccattggagaaatcctactaaaaactcaagtggagaattctatatggagtacttatttaaatatggaccttttaaaagtaaaatgaatgtttcaaatgcttctcaaaacattaggttcatgcttgaatgcaatattctaaattttaccccattttttcttaattatacttctttgattttatacctgtcttagtccattttgtgttgttataacagaatggttaatttataaagaatgaggatttatttcttacagttctgagggttgggaagtccaagaagccttcttgctgcctcatcccatgtcagaaaatagaagggagcccttttgtgagagagaagggaaggggtctaaacgcattattttattaggaactcactccagagatcatgacattaattcattcataagaacagaggccatgcgcagtggctcatgcctgtaatcccagcactttgggaggctgaggcgggtagatcacaaggtcaagagatcgagatcatcctgcccaacgtggtgaaaccccggctctactaaaaatacaaaaattagctgggggtggcggcgtgtgcctgtagtcccagctactcaggaagctggggtaggagaatcgcttgaagccgggaggcggaggttgcagtgagccaagattgcaccactgcactccagcctgggtgacagagtgagactccatctcaaaagaaaaaataaaaataaataagtaaataagaacagagccctcaggacctaatcacctcttgaaggttccacttctcaacactgttgcattggagattaagtttccaacacaggaacttcggggaacacattcaaaccctggcaataaccatatgcctctatctaccatgaagggttcttcagtgttttgtacattgtggtggtcagaatcctaggatgagtctcagatggcccccacccttgtataatcccttctcctttgagtgtgggcagcatctgtgaacatgacgagccccataactctcatagttattatcttatatggtaaggctgactttaagaaaggggggcctttcatggggatctgatttaatcacattagccttttaaaagcagggagtattttcctggctagtccaagaaggggaagtcagggtggtttgaaacctaaaatgtacttgctgcagaagttctctcttgctgaaatggaatgggggcatgtggttaagagctgagagcagtctctggatgctgagaccactcttggctgacaacgagcacaataatggggactgtagttctacaaccacaagggaatgaattctgccaacagcctgagggaacttggaggtggattttccctagtggagtttccaaatgagaatgcagttggctgacaccttgatttcagctttatgagaacctgagcagaggacccagttaaaacatgccagtcttctgacccacagaaaatgagataatgtttgagaagttgtaagccattcaatttgtggtaatttgttacaccataaaatggaactgatacatagttctttaatgtaaaatttaccaaaaacatgtgtgtaattaacaggtcaatttttaacaagcgtatttgaccaagattatttgtggtttaggatacagctgaaaatagcttaaatgttctttttctctaataccttatgtattgccatttctatggtttttgatgagatggtctataatttagtaaaagatgtaagctctcacagattatttgacatatttagtgactaatgactgtcattaggaatatgtatgtatataaaagttactttgatttttctctaaatgtttttatttttgatcattatttacttcatgatattccattcatctcttgagtagaatacaaggtagcttactgttttagcagtaggatggagaaagacaagtacacatatcaaaggaaattgttattctcataattataattaatttacattaaaggatttttgaaaacttacaagaaaatataacaatataatatttgttctcatttattagaaataaccattctataattttatttttttaacttatttaaatattacacattttgaagaagatctacctaacatttggggaatagaatataaaaaatagcagtaattggcaagtctttttcttttgtcaagatactggaggaaattgtaaattagtctctcctctctacgttgattttattttgattttcttcctttctatctgaggtttattcaatagcctcttatgttccactctttctaattttaatcaaatattcatttgtgatagttattctcacagttacgagtttttgaagtgttttggagctgttagaaaattggaaggttgagaaaaactcagagaataaatttaagaagttgaaagactaattttgagaataaggaacaaccttattggttctcactggatgtaactacagttgccagatggctgaagggttttaggggtttaatctagggccatggggtaaagctaagaggcacatatggggatctaaggcctagcctggtcatactagcgccatgctctacccaattgacctaattagatgagatttttcaaatctaatatcaaaggtttgtttgaatatcagatgtgggtcattgttctctaagcactctgtttacatggtcattgttgtttacctgaggccaagaaagaatttttgctatgttgttgctcatttttcctctgtaaaagctaccatcacaatcaattagtttatttgtttgttcttactaatttagaatatgtaattcataattagcagtaatttgaacaggggtaagatgacatttaccttgaactacctattaaaggaggatttttcttttccttccttccttccttccttccttccttctttccttccttcttccttccctcctttcttttatttgagagtcttactctgtcactcaggctggagtgcagtgctgcgatctcggctcactgcaacctccaccgtaaaggaggatttttctacaaattcatgataagatagcagagggggcatgcttttctactacaagaaaaaactttttcttaaactttctctgtccttatataaacaaattatatatctattccactataaatggtgctctaatgtaaaaattaggtgttataagtaccctttagctaatttgcattactttgttgtaaatgcctagtattttcaaataaaaaaggtcactctctaaaattaaaacttaatcaacatagttaatacagtgatatccaaagtcactttaaagtgacagaatggctataacactgtatgaccagactgtaacttgcttgaaaacttactaaaagctcttttaatagagcttcactagtgaactaacactaactttctctttcttctgtataacataatgactgatacccagggcatggacaggctcactcatagtgatctgctctgtagttatttgcactttgtgcacatacagtagagttgcaggcatagcattggttatgtttttcccatactattttttgctagtttcacttataattatgtgatttaaatatatcataaactgagaaaatgagtgcaaaatttaaattcagtgcattacaaagactcaaaataagggtgagttactaaaaagacctatgggaaaaaaagagaacttcgaattctgaactacttagattgctttacaagtaattactaacttcccattctactttaaagtaattgaaactggaaattacagacaatgtttcttggaagggttatacacttgcaatgctcaacatgcttaatgactcatacttaaagatctttgtcctatcacaaaagtttagcaaataattatacattagtatatgttaaatggaaatttaatattaagaaatatatgatgttttatgccttccaactttaacttcttgtgactgaacagcttcacaattgataacaagagctttttaaattaacataggaagtgttaataagtttttggtcagccatagaactatgaattaaagatataaatattggatgtgcccatagaataatctattgtcttgataactgaggaacttagtgtttcctgaagggttatccctattattgaggaaaatatttatatccataagagcctgagaacccttaaatacttgccattattttaacccctttaaatcaatatttaaccccttttaattatttgcgtttctaactgccttgaccagagagaattcacgggttgaactgttgccaatgatggcactatttagcagttctatttctcagtataaattaagtaatcttaggttttatactacttcaatttcttgtgagttttgattgagttcagagtctatattttaaccagtctatatacacaaatgagacctccaaaaatataatcactgggtggctgttgagaagaggagggcaaatggatgttagggagtccactataacctgactcgcttagaattttcccttttctataaccattttttcttggatttcagttctcttgccatcctgttcatccattctagttctcttgccattcatcatgcctaatgaatggattattttaaaaaatataatacctagcatattttttagagttatggtttaaaatataactttcaattctgctgttttttatcaaaattattaccatcaacatttctcaatgttgctacataataagcctttacaaataatcaagtatatgtagtgtaattttatttaccatttctatataacatgtgattttacttatttcttttttttttttttttttttggagacagagtctcactctgccgcccaggctggagtgcagtggtgtgatctcagatcccaggttcaagcagttctcctgcctcagcctccagaatagctgggattacaggcacccaccatcacgcccagctaatttttgtatatttaatagagacaggggtttcaccatgttggcaaagctggtctcgaactcctgacctcaggtgatccgtctgactctgcctcccaaagtgctaggattacaggtatgagccatcgcacctggcctatttcttgctttaaatcccctttcccaatgaattatgataattacagttttcttttcattttttcgagatggagtcttgctctgttgcccaggctggagtgcagtggcgcaatctcggcttactgcaacctccgcctcctaggttcaagtgattctcctgcctcagcctcccaagcatttcaggctacaggcatgcgccaccatgcccggatcattttttttttggtgattttagtagagacggggtttgaccttttagccaggctggtctagaactcctgaccttaggtgatccaccttggcctcccaaggattaatcctgtgctaggattacaggtgtgagccactacgctcagccaataattacagttttcatttaaaaatgtatatgtgtctgtttgtatattacaactgacattttgaaccttggaggactttatatgaatcttgttagtaagattctgagagtttttttttttttaatctttttcttgtcatctagctgaggacatctcatctattaccatgcttaccagtcacctgaggatcttgctaaaatggacattctgggtcagggtagggctcatgagtctttgtttctagaaaactaccatagggttccagtgctggttaagctcactatgaacaatcccttccactgattatactaaaaactctggaaggaatatacaacataactccctgagaactctgagaaacaaacaatagcagggtaaatgaggatggatgtcaactgcaagtacacagcacaaggggtgagtttcctttgccctgcccccttcatctactggatttaatctaagggcagcctcagtcatgaaactgcacaatgaaagcagacagtacaaattttgaagaaaagctctttctgtccagaggaccaggaatagggttccttgacacctgcagaatgtggagggatcaccatgtctatttttttcctcccattttcactaatagcctagcatgagggcagccctgctcatggagctgcactgctgatgtgatggtggcagtgccagcagagaggggcctaaaaacctcagtggaaaaacctgtctctggccagaggaacagaaaacagaagttcccttggtccctgtggcaaaagagtgtgtgtgagattctctttttcagggctacatgttcctggagatggcctcaatcccatggaattgtgtaacagtgcacataactaaaactctaagaagtaagaaagttttcaggcaagaaacatcagaaaaaaagtaatctgttgggaattagagagtgtgagggaaattccaaagagaagatcccctaaatcttgtattaactgtgttcattgtcaagctaagaatgtgcagaatatatgcaaagcaccatggcaaagtctttgagaactgaaatatgatataaaccactgcacaaactaagactgacctctgagttgcatgtatgcaaggtagaaccaaagaaacatatcaaaatttaaaaactgaactgacattggaatcattaactgtgaagacaagacagaatttttggtgtcagtctaatgggatttactgcatgctatccaaatataatattttttttctggaggattttaacaagactaagagttccacaacatagtattcaaaatgttcaggttacatctgaaattatttggcatataaaaacaatgaaaagggaacaaatcttaaaaaagaaaaaaatcagaagatgtcaaccctgagttggaccagatgttggaattataaaggatttaaaggcagctaacataatcatgctctatattgaaaatgcaaacactcttgaagtaaatgaaaagatagaccttttcagcacacaaactatcaaaagaatcaaatgtcaatatttgaattaaaaaatacatgataaaaattcactaggtgggctcaaaagtagaatggagatggcagatgaaagagtccatgaatttaaaattcatggactcaatagaaattatcgttgctgaaaaacagagtagaaaaaatatttaaaaaaacagactcaggaatctgtagtgcagtatcaaaagatctaatatttgtgccagtggaatcatagaaggagaaaacaaaggaattggtagataaaaaaaatagaaaaataatggctgaatgttttccaaatttgttcgcagggcaattcaaaatgcttggtggaactgaaacaagataaactcaaagaaaaatgattcccaaacacatcataattgaaactaatgaaagaaaaccatcttgaaagaagccaggggaaaattacacgttatttgtaggcaaacagtaattgaaattactgcagacttagtcagaaaccatgaagcccacaagacaaaaatttctaaaatgctgaaagaaaataattgtatctctagtgaaacatttttttagaaaacaggtgatataagattttctcagatgaagaaaaaccatgaattaatttccagcaggcctattctaaaataaatgctgaaggaagttcttcagtatgaatagatatgatattacaaggatatctggagcttcagtaatgtaaaaagaccaaaagaaattataagtagattactcttattctatacattatttaaaatatgtatgactgatgaaaaaatacagcattgtatggtagggctttaaatctctgtgtagatgtgatattgtgatatgtatggctctatgcaacatacaaaggatgttccctgaccagaaagggtttaaactacaaatctgtaagagaaagttgtctggaaattccctaagtacttaaagattaaataacattcatccaaataatccatgggtgaaagaagaaattcaaagataaattagacagtattttgacgtgaataaaatgataatgtagcatatcaaaatgtgtgggatgcaccttaagcaaggctttgaggaaaatttatggcaatacatgctaatattaaagataaaatgtcttaataatttaagcttctgcctaagaaatgagaaaaagaagaataaatggaactcagtgaaagcagaagcttaattttagttaattcctggtgaattaattttgttaattccttggtaactttgaggtatccctttgcctggggttttaacattcaaggatggtccatatagggtcatattcccagagtgaggaggggatagggtcttggttatctgctaatcaccttggcaactgcttatatacacattttcccatacaatttgcttctgacatgtaggttgtcaatgtgattcacttgcttctgaacacagggaatatgcaagattaggaccctcttaaatattttcgtctctttcttgctgcgacatcccaagagttcatgggatgaactcacctaatttcccaggtgaggctgtcttatactaacatgcaccggcattcaattatctctattctactgctcagaaaccgctttgggtggagaaaagtgtaaaatacatgccacccgctgatacatttggaatttcataattttccaaaactatttgggtttcgtttcctagaattcttacacactggggaggcgtagaaagcagagctacttctcgggaactcatgaatatctaggctacattttcttttcatgtctctttatctactgagagaattgttatatcatttaaagtgtgaaaactgtctattacttcatcaacattccttcaggtctattgttcatggcataaataatattatgatgagttttccagactttaagtttctgaagcttgaaagcttaggattctgtaaatccaagtaaacttttgaaatttaaaatccaggacttaaacatttttcaaaaaacctgtttccataacaaccttaatccagggcagtaaggatggaatgccttaacaatctggtttagagaaaggactaggatacacatagaaatgcaaatgacagaaattggttcacacttcaacatttttctcaatatatgtgaaatggggacagtaaatgatatctacttcacatggttattgtgatgattaaatgagtacatttaacaatacatgtgatgtgatgcatgtgccagtttctgacaactaaatttaattcttcttcctttttttctccattattctcacctcttccttttttacttagtattgtcacctttttcttatataattggtataaacttatgggttctgaagtaccacctctgactaaagataatggaaagatgtcttagggtttattcatttatctatgaaacaattcagaaaaataatatgcttgaagggaggcttgtgcccatggcactgaattagaacccagctggctaaaggcacagtagggatttaattttcttcactcattcttttttcctactcactatttagaatacattttgaccaaagcacatttgtaaaagtcttttcatataaatggaatgctttgttaccctagccttaaaatgcagcatattcaaaattataaaaggataagagaaggataagagaacctcagaatattaaacctcagaatattaaaataaaaaggaatgaaataagacaaatatgatagtattactggaaagattgctttggggactagtgaattaaacaatacatattgcagactacaagaactaatcatcacctgagattatttgtgataaggggtttagaactcactgtcaaagagcacggactttcctccaattgcagagactacacataataatcagatcatgggagaaatagcatgtatgttattgcagaataataaggtgttatatatgtgtattttatatgcacatactaaagtttgttgagcaccatttttggaacaaattgaatttttaatgagtcagcactctacagggtggcttcaggtgaggccaggaaataatgaggagaggtatacactgtctacactgtcttatcagcacttgtcacatcctattaattttttaaatagaaataaaggggtatatttttttctcattcaaaataaagtcaaaagtagttagggtacggatgatgtagtggagtccctgggtcatatgggaccaagacttctatttttctgcttgccatctttaatgtatagctttcattctcaaggccacttgctggggttgatctagtgctgataaatatgctgctttctaggcagaaagggccgtgtgtgtgtgtgtgtgtgtgtgtgtgtgtgtgtgagagagagagagagagagagagagagagagagggagagagagagaaagagatcagggggctgttccagctctctaatcccacttttttgaactgaattttttattgaaataattgtagattcacatgcaattgtaagaaatattacacttactcgacttcccaccaatggtaacaattttcaaagctataatataatattatcacatccaaaataattgtattgatataatctaccagtcttttttgacattttcccagctttacttgtgtgtatgtgtgtgtgtgtggtgtgtctgcatattaatttctatacaatttcattgtttatgggtttgtgtatccaccaccacactcaatatatggaacagttctaataccacaaggaaccctcagtctgctcttttataatcacatccacctctttcctgttccttcatcctgccatgacccctgttcctaaccactgatctgtactacatttctaaaatctctgatttcaaaatggacctatatagcacataacctttggggactggcttgtttttttcacttagtataattccctggagatttattgaagttttcatttgtttcaatagtttgtttctttttgttactgagcagtatttcatagtatgtgtgtatcactatttcatcatcattaatctgttgaaggatagctggtctgatttcagctttgggctgttacacataaggccattataaatatttgtgtacaggattttgtgtgagcacaccttttcatttctctcaattaaatgcccaagagtgcaattgctgtggtgtgggttaattgtatgtttagtttgttaaattgtttaccagagtgtctgtaccattttactttcctaccagctatatatgtgtggtacagtttccctatcctagccattttttaaatgtaatggtaataacaatttataccaataacaacatcatgaaagtcacactttctctttatgagcaattattcagtggatttgaagataactgtcactaacacaaatatgaccatagaggtatcattttaatattttctcaattttcatgttagaacatttatggatgtttactgagtttagtcatctccaccatcaatacgttcaccttatagattgtgtgtcactttctttgataagtttcttactagtgctttccattttagccaaagttgggaaaattgacaggtctaaatcgtccaaccaggtgggtatcttcataaaatagaagctgtagaaatgaatattttcaatattaatgtttataaacagtgaaagaaaggattcagtttttaactctaagattaaagtattgatgtgaaaatgatagattacagtaaatcatgtagatgtgcaatttattacttaacaatttcagtctaatggactaacagggatatgctaaaatttgtctttcaaacataagcccttaacagcagcaatacttaccttaatcatcttagtatccttagaaccctgcatggtatctaactcagagcaagtgcttaataaacacttaatataataattaaattagagtaaaagtgggatttggactgactttcttttaggtcaatacaaattgaaataaactttgttgttactaaaactctaactggttaccagatccaggacaaatacaatttaatgagattgtttaacatttttaatgttccaaaataaaataatcaaatatatttgctgataataaaaaatatttacacaaatctaggtaagtagaaaatttcccatatagaataaacatagatctagatgtatatgaaagaagagatagtttatttcttgactagaccattagtaacagaatattggtattttcatagcaccgaatataaaatttatattaatgaaactgatatatttaaattataggttgaaatagaaaatttacagatattttaaaaatataattctgaccctagaatattttgaaagatttcaggtggttgttatggaactgagaactatcatgtgaaatctgtggaacttaggaatgtattgaatgtggcctaatatttgttcaggtgggcctagaagtaaaattgtgaaagaaaccatgaaaaaaacctcaatattttatgttaatggagaaaggatgcagatgaaaagtatcaaataattaggagttatttgcagtatttatataactatctttgtgtaatccttacagtgagtgtgttacttttctgtctcttgggatatataattcctaccattaatttccattgacagtaagagtagcggttaagaacatgaactctaaaggcatgcaactgccttagttttatttccagctctgtcatgtgttggctgtgggacttgtggcaagttacttaatgtctctgtgcctcagattatctacatacagaagatggtacttacttcatgggatttttatgaagattaaatgagttaatatcttaaaatacttagaaaatgcccagtatatagtaaatgctatagaagtaatttccaagtaagaataaatgtgtttttggaaatgataatgtaaaaaaccaacagaatatcattttcccctttctcttcctctgtccccctctcttgctctctctttctgctgccttctcttctttctccctctctttttctttgtgtgtctctcacagtctctctatcttatgcaaacatcaaccctatatagagcagcataggagtatagtattatattaatttgttcaatttaagacaaaaatgagcctcttttttaagtcagaagctgatcctcagtttgaaatttcttatccactctaaggaactgtcttattggttagaaacattctgggaaaaaaaaattgtctttcttatggaactcttcttgccacatggaactcttccattgaatgtttttactgaattagccagttagttcatttcaacaatacatttcttatttttttcatctgaacagatcaacttttttatattggcagctgacttttggtaccgcagtgacatgcctaagtgtatgccctgcattgattgagagatattgtatgtaatatatgaatatattattttttcagagtggctcattgggactttttagttttatggactagtaaaagattcgtaaaagttaagcaggagaccaaaaccaatttgccaagtttttgttttgccatatgaagatataagagcattaaagaataaactgtcatctatcataccaacattgtatcaaagaataagtcaacctaacaacaacaactaggaaagatttagagtcaagatttttaaattgaataagtttaacttaataaaaaattcactttattttaaaaattatttcttctcaaataggactacattacgatctggcaccggtactgagacaatttcatctctttatgaggcacgttttgtttggtttatcaggatatattaattacaggaagaacagccaatgaagtgctaccaggtcaacagggcttgtggtccagtttataaactgctaaaagcgatggctgaaaatgaagtttctaatgagcttttcctcatagtagtagttttcttctccaataaaaagtaacatgtttatttctctgtcaactcttagtttgcttacttctgtgatgacactctgtagatggtgccagggtctgaaaaacaacacaacaattactaaaatgaaaactgaagaacaaagtagtcattgtataaaaggaattatgtatatatcccagcttaagatgctgctgctcttgttggtatccagttataggactagggttgacagcagctattacttaccgtgtgcttattcagcaagcctctccttccctctctgaactgtagagtttgatgtgaaacaatatttttaaatgaacaattaaataattggtgctttctgattgtagaaatccctcttcctacctcctagaattcactgatatcactgttttttctaaccttatgccataacaaaaaatgttccaggatattcaaatctttagttctctaactccaacaatgagctatgccactgatttctaggcttgtgtcatgatagaataataggtttacagaacactgacgtgttcatcttctggtgttatgcataagttttacttggcttttatggtttgggctgggatacagtgaagttaaaaactacatttgatgctgtggattcagagttaagttgggattctttcccttaaggagcactttaattgtttgtttacttatttgtgtgtatttgtgtgtggggggacagataaacctgcttatgttaccctttaaagcatttttagatcatttttgctcctctttttatttgaagctactgtctcattttagccagatttcatctacttaaaatgctgattaggttggaggctagcactttaacagctgtccataggccagcagatgtggccctggtaccacataaggtatgaagtttgaactaaatcccttcatagagctgaagccatctaaggattttgttctcagtagaggttggactagggtataacaaaacaaaacatacaaaaaaaaaaaaaaaaacttctctgtcccaggctttgctctgaaaaagaaggaacatttcctctgagaattcataaccataagtccctcacttatgttgatttgttgttccaatatgcaatagcaatgcaatcatgaagattcaaagttaagagattaacattagtgaataataggtggtagcatctgagggtgactgacagaagcttttacaaaatatctttggaatgatacacttaacacaggcccctaggattccaacagagaaatcacaactgaacttgaacttgagcttgtatgctgcaagtagtatgaattttgtcatatataaagcaacatttgacagaattacaatgaaaaattggcaaagacactataatagtggaaagcttgtcacatattttcattcaattcttgtttggtttgactgccctttactaaaaaagtacaagatttaatctaacagtaaagaagcttggtcaaatgtacaggtattttacctgtacctagcaatgacagcatccacattgttcccaagaatatgcaattttttttaaagttgcatatgcattatgctataaaacaggcatcaatacatttctaagatggattcatacatttaatttgaattcttaatttaaattaaaaattagaagtgaatttttatttgaaaatataatgggaatttttaaaagcacactgaaaaataattcatctatcaaagaaaaatcaaaatggaaattagaaaatattttgaaggaagtaacatatatttatgtcagaaattttatgaggcagacaaattggcgtttgtcacttttagtgtttctctttatggagggtgaggaggattggaaatcaatgagatatcccgtataatttaagaagtcagaaaagtaaaaaataaagacaatctaaaataagtgtttaataaaaaaagtagaaactaatataccctttcaagactgtgggtttgtatactttctgatgagaaatccacaaaaattcaagttgtttttattctgtatgcaatgtatttttattctctagttgctttgaagattgacattttctttgatgttcaacagtttcactgtgacatgactaggtttcactgtattctccttgtgatttggtgtcttgactcttgtaaattttgtttaaatttatgtctttcactaaatgtgagtttttgcccattacttcttagaatatttttctacctcccttccttctgggcctttaacaacccacatgataaaaatttggatattgtcccataaatctctgaagctcttttcatttttatcaacccatttcctctcttttcacatcaggtaattgatagatctattgatctgtctttgttcatgtccttaaattaatgatgcttcctccctacaaaggccttttcctatgttgttccctctgccaggaattcaaaccaccttccaccaccctctccaccgaattaacttctatacatccttcaggtctcatctcaagtgacactttttacagcatgtctccttagtatttcttcttagtgtttatgtccctttatgataatacatgtgctagtgtgattatttgattaaatcctgtaattcccatgagataaactccactggaacaggcagagtttaaattttctgccactattcgttagcttctggcacaaaacaagcatataataaatgttgagtataaaacatatagctttgttctttcatggtattatcagcctatacatctgtgtttaccgtagacaagtcaaatactcatttgcttttctttttgacctctccttgctgaactataaaattaagaaattggattagattttacctatagatctattcaacactgaaatgccattttttaaaaaatctattattggtttaaaaggatgcttttaatagaaaaaggataaagatcatagctttcagttttctgttttcttaattgtaaaatcataatgaaatggaatagaatattgactatcactaaaacctgcttaattcccatgttatatattgcaatttctatataagtttagcacccttttgtagtttttctcatgcacaaataattttctataaatgagagtaatggatcttcataaattcatcattatattttctactcctaaaagaaaacagaagaactcaaaaccttcactatacctattgtttgatatcaaagagatggcaaaatcaacaggaatgtatttcaaaaagttctaaagtatctgctcattaatttaccaagccttctcgaagactgttatcagaagtatataaggagttataaaatagtttgtataccatatataataaaactaaactcaattatttgtttaatattatttagtttcttgaacctttaagtgtagatgaaggaattataacatggagaaagacaaaagttaatggaaaataagttaaactattgtaagggaaaagtccctttctgctgttttctgtaaatgccaagtaatctttccattgcatggaagtttgctgcaaatacatgttttgcagttaacaaagtgtgaataaaccctctcagaaatatttgcttgagggcccccaaatccctgctgtgaacatctaatcaaaattcatgttctactgacaatagctcagtaatgtcaacttcacttagaggacaggccatttactttattatttactgaattatgttgtgatctaaaccactttgtgattctgactctgcacagttgagaagactgtgaatgtgtgtggtgatcagtctcaagtggctctgatcagcaattttctaagatgtcatataatgttgtcagcagttaccttccttagtttgagtaaaacaagatgatagaatctttgtaagctagttgactgtccttagtatttctatgagggtaagtatatgcacacattaaagcagacagctcctcttcttgaacttgacacaatggtagaaatgtttatctgtgtcctagagaaatatgagggaaacaatgttttcagcatagacattcctgaagagaatctgatattttgcagttaacacattttgttcaaacataagaataaaaagcaggtatacataatcatctttttttttggtcagaaaatgagatttattagtttattggttattcatgagtacagctatttcctgtgtgaccttctacagttatctaaattgttaaagtaagaaagttagagaaaggttaccctgaagaacagaaaaatgaattctttatctactgggagagatttcttaaaaataaaagattgttccatctatacattaatgctaatgtcatgatattttaacttactgaagcaatgctagtgaagaatcccaggcaaggtgacattttttaaactttcaggtatcttcatcattgcaatggaaaataaaatgcatacaactagttgtaaaattggcataattggccataatgcagtggccacaagaagcttatttggcacacaccggtacaaagctttgttaaatttaaatagcttttttttttttttgaaaagtaacatttgcattacaaaccttgaaacttaaaggaaaacatggcagtattatttgaaaaggtaacaatctatcaaacatacataaaatataaacaaactgggtttggcctcttcagtatttcgtactaataaaatcatcaaatttgcaaattttgttttttcttccctacatcaatttctacattgataaatattttgttatttgagagtcatccttagattatttttattaattttaatgttgagaaagaatttagaaacagatgatgccaattgtcaatagtaatatccataaagtgaagatttaagaaaaatgttgcagtgatgccttagcatttcttgaaaactgtatcagtaatttctgataaagtatcttttaaaattttatttgtaattgatttaacaaggctgtaattagaagatttgggtaattcatttgaaaatccttttttactgtaaacttttcattaatttgaattaagtgggttggagtaagtaaaatatctgtatgttaaatagctcttaaaaagatattcacatattcacatttaggtagatagtttttctttttcttttctttcttttttttttttgagacggagtttcgctcttgtttgttgcccaggctggagtgcaatggcgtgatctcggctcaccccaacctctgcctctcaggttccagagattctcctgccctagcctcacgagtagctaggattacaggcgtgtactaccacgcccggctaattttgtatttttagtagagatgaagtttatccatgttggtcagactggtctcaaattcccgacctcaggtgatccacccacctcggcctcccaaagtgcagggattacatgcgtgagccaccgcacccagcctaggtaggtagtttttatattaattacatgcaaaaattatttataactttattatccaaaaactactgaggatgacagagctaacataatagctcttgaaaaatgagtaagatgaaacaatgtgtaaacatatttaaattttgagcaaagacactttgaaatgctggtaatggtacattttttttcccagcttacttacgaggtaatttaataaatccaataaaaatttgctgcttttcttcattcttttctcgcctgcctgcctgcctgcctgcctgcctgccttccttccttccttccttccttccttccttccctccctccctccttccctacctttttcctaatctttcttttcttcttttcttagttgcttttaaaatatttatttaacaattggcaaataaaaattgtatatatttatcttgtaaaacatgttttgaaatatgtatagattgtgggatgactaaattgagctaattaacatacgcattgcttcacatacttttttgtgatgagaatactaaaaatgtactttcttagcaattttcaagaatataatacattttttaactgtagtcaccaaatcatacattctatattttgaaattattcctcctaagtgaaattttgtatcctttagccaacatttccccaacccctatcccccaccctagcccctggtaaccaccattctattctcttcttctgtttattcaagttttataaagttcacatataaatgagatcatgaagaatttatctttctgtgcctggcttatttcacttatgtcctccagcttcatccatgttgttgcaagtgacacaatttccttcttattaatgctgcatgtatttgcttgtgtatgcataccacattttctttatccattcatctgttgatggacactggttgattctatatcttggctagtgtgaataagattgcaatgaacatgagagtatagatattttttcaacattatgatttcatttccttggaatatatacccagtagtaggatggctggatcatatggtagttctatttttgattttttgaggatcctccatattttttataatagctgtatgaatttacattcctatcaacagtgtgcaaaggtttttttttcctccacatcttctcaaaagacttttatattttaaaaagaatagccattatagtgcgtatgggatgatatatcattgtggtttaaaattgcatttatctgatgattagtgattttgagcgttatcctgatattcatattggctgtttgtatgtctgctttgagaaatgtctgttcaaatcctttgctcattatttttctgctattgagttgagttccttatatattttggatattaacccctttaatatatgcatggtttgcaaatattttctctcattccataaattctttcttcactctgtcaattgtttccttggctgtgcaggatcttttcagttagatgttattccatctgtctatttctgctttttttgctgtgttttgggtatatatcaaaaaatcattgtccagactaatgtcataaaattttttccttatgtttttctcttgcagttttacagtattaggtcttgtgtgtaagtctttaataattttgtgttaatttttgtatatggtatgtgccttagtccattttgtgtttctgtaacagaataccaaagactgggtagtttataaagactagaaatttatttcttacagttctggaggttagaaaatctaaggtcgaggagcctgcatctggtgagggccttcttgctgcatcatttcatggtgaaaggtggaagtgcaagagcgcatgaaaaagcaatagagcaagagggggcctaacttgcttcttataacaatccactatgtgataagcaacccactcccatgataatgccgttaatccactcatgagggcacagccctcatgacctggttacctctgaaaagccccacctctcaacactgttgcattggggattaagtttctaacatgtgagctttggaagacacatttaagcaatagcagtgtgagatatgggcctacttttattcttctccatgaggatatcaagttgtcccaataccatttattgaagaaaatgtcctttctccattatgagttcttggcacctttattaaaaatcaattggctttaaatgtgtgaatttacttttgggttatctattctgctctgttggtctgtgtgtctgtttttattaccagtaccatactgtttttattactacagctttgtagtgtatttcgaagtcaggtagtgtgaggactccagatttggttttgctcaagattgctttggctattttgcatcttttgtggtattatacaaattttaggaaattttttctgtttatgtgaaagtgtcattggaattttattaaggattatgttgaatctgtagattgctttgggtactatggatgttttaacaatattctctcaaatcatgaacataggatttcatttatttgtgtcatcaatgatgtctttcatcaatgatttgttttactaaagaagcagtaaatctcaaagagctataaacttgtgacagctctttgattttgcagataccaataaaggattcttaatccttttagctgaaaatcttgccaaaatttcagagctttaatatacaatcctgacatagtggagagatgtacatctgatagcttagcacatcacaacaaacagtatctcctttacctaagctagtaattgcaggaggagcatgcacatgtgcatatgtgagtcagtatgtgtgtgtgtagggggagaataggttggtaggtagaggaatttttaaccatgtagggtaaattagacaaatatacagatatgacagacttgtagctaatatcaccaacctgtattcctctattggcctttctctgctggcgtagtcggcttccttttgtaaagtttgaatgtgctacacacttgcttttccagcttccctggaagctagatatttggactataaaccccacctataaaacaagagctaagggaaagtcttttgtaaggctttcaggaaagttatttctccataaataaagagattaaaagaataaaacagtctttgcttgacacggcaagcaaacatgaagccggagacttctgaagtcatattgcaaacaacagagagatagaattatcatgacgtggatgacaaaggataaaattgggaattacttacatgggtcatgatgataccttcttgactcagaaccaaatggaaaagcactgcctctggaactttttgtatatgaaatattaaatgtgtaagaattttaaagttggatattatgttaattatagtaaaatcatattaactgacaagtggtcaattattgtgttatgtagtacaatattatgttatatatgtatgtattttatatagtatagtgtaaatcaatttctgaaacatttagaacaatggaaatgaagagagtgagacttaatagtattttcaaccgataatatattctaaaattaggaagttagcagaattgggtggggatacaaccaagtacttgtggaattttcttgttttatcacatgtccacgacctgaaattgtgtaatcatgtagtcgtatttttaagaaaacacagtaaaacatagggtctttctactttctgttctacaatttcaaactaaagtttatttgcttattcagtgatttttaagcaatatctttatatttttaagtaacatgggatacttataattctttgcctgatgagattctttggctgtgtcagaatatttttgtaatatgtgaaatagttttgcatagttaagccagaaacctatgtataaaatgctgttgatatgttttggaatataaaattatttctatcatgttctgatctgaataacattaatgtacttttttggagtgtgaaataaatatacaattgtaataaaatgcataatttaaattattggtaaaatatatttatgtgtatatttaaatattaattaaattataaataatcaaaacctaacatttcatttgctgtttttatatattaaaaatgtctttgtactcttcctttgacctgttctactcaatttatgaatataaattacaaggataaaaaagagactaggactcactgtaaacagataaacgttactgataattcaaagcacacattttatttttggtgactgggattctaccttcatatataaaggacagcacatttattcatataaattttgaatatataaacataatacaatgttaatatattgttattatttgacagttatttatataatagtatttgggagatacatacaatcatatacaccatttgtccagttgcattacattttaagagaccattttaatttatattccaagcttttatttgcatgcgatctgttacagatggcctctagccatacttaccaagagctaagcattctcagctcttgtaattatggtaaatgaatatcaatcaatctgttttgccactttatatagaccataattccagatggaagcttgctgtttataaatctgaattcctgccaaaacagagatgttgaaattcgtttggatactatctatatgcaaaagatctaatacatatatatgcgtgtgtgtgtgtgtatgtatatgtagatataaaataagtaatatatataaaataatatgttatatatataacaagctatatatgtgtgtatatatatatatgcatatatctaactttctctactattggaattgtaactctaaaaaagagcaattgtccagtatgaagtttagatggaaacctcatgatgtcatagcaacctgcaaaatagatgtttaaaatgaatctccaagtccatagagcactgccaatatgactcttttggattcaaataactcagccttatgggaattaaaaaatatgtatttattttgcaaatgaggactcaaaataaagtacatattttgaactcagtttaaaatggcttagtattattttttcagattgaattatttctaaatagaatacattaatttaaaatataccaggtggaatatagtcttaaaatgtattattacatataatggaataagcttacatgtgtaacttggtaaaattaactttttcattaatagggattctttgattttgctcactaatacatttcttgttctagaatagggcctcttatatagtaaacacccaatgaatttttgctgaataaattaactttgaaagtcaaactgcttgctacgttttgagtgtattcatgagaattcatgtgttggaaatttggtccccagcacggcagtgttcagaggtggggcctttaagttggattgggtcattaagaggtattaatgctgctcttgtggaactggtgaattcttagggagtgagcgagtatcactcttgctggactggaagagtttctatgagatcaggtggttattaatataaactgagactgctcctcatgttttgcctcttttgcatacactcacttgcacttccacttttgtgccatgttatgatgcagcacaaggccctaatccaacgctggccagatgcagccacctgatcttggactttccagcttccacaaccacgagccaaataaacctctttgctttataaattacctggtctcaggtattctattacagaaacagagaacagactaagacattgccattattcaaggttcttggaagtctttgataggagttaatatattggaaatatagctcattttacctttaatcttcctgagtctatttttaaaaaaagtaccaatattagtataaaacattgaggtcatgtaccttgggttcatatgttaattttgtataggtgagaatattcatttgggtctaaatacagatagtcctcaaattatgatggacttatgatggtttgactatggtttttgaactgtacaatgttgggaaaatgatacactttcagtagaaactgtacttcagattttgaattgatcttttcctggtttagtgatacgtgatataatacactctttgggtggtaggcagtgacagagagccattctagttttcactattggtagagtattcaatacattaggtattcacattttattataaaataggattgtatcagacaattttgcccaactgtaggctaatataagtgttctgagcagatttaacataggctaggccaagctatgatgttcagtaggttaggtgtactgtattaaatactgtattgtctgctataatattttcaacttacaatgggtttattgggacatagccccactatatgttgaggaatatctgcaatatatacatttatcaaaatgtgaaattactaaaaatttaagcaatagctaactctggcattgtatcttagacacccctgagactgaatttgccctgctaatgaactgaggcatatctccttgaattctttcatttttttttactacagtcctagcatatattcaacaattattttagtggcaagtatatatgaggcattatactgtattcagttaatgacaaaaagatgaatgacttttgatactcttaaaacgcctgtaattaacatggatacacagtgtctacaaaaataactacagtacttgacatcatgtgtaattaggacattgcatgcaaattaaagcacagtgagattccactacctacctattagaatggtgaaaatccaaagcactgacagtaccaatgttcgtgaggatgtggagcaatacaactctcattcatggtggtggaaacgcaaaatagtacaggcactttggaagacagtttcatggttttttaaataaaacagaatcctgcaatcagactccttggtatttacacaagtgagttgaaaaacataggtctacataaaacctgcaaaatttttttaaataaatttttaaaacctaaaagtaacaagttcttcagcaggtgattggctaaataaactggtatagccagacaatgaaatattttagcattaaaaagaagtggactggccgggcgcggtggctcacgcctgtaatccagcactttgggagtccgaggcgggcgtatcacgaggtcaagaaatcgagaccatcctggctaacacggtgaaaccccgtctctactaaaaaatacaaaaaagtagccgagtgtggtggcgggcgcctctaggcgcctgtagtcccagctacgcgggaggctgaggcaggagaatggcgtaaacccgggaggcggagcttgcggtgagtggagatgcgccactgcactccagcctgggcgacagaacaagactctgtctcaaaaaaaaaaaaaaaaaaaaaaaaagaagtggactattaaaccatgaaaagacatagaagaaccttaaatgcaaattactaagtgaaaaaatccaatctgaaaaggttacatgatgtatgattccaattatctgacactctggaaaaagcaaaatatagaaacagaaaaagtatcagtggttgttatggggttaaggaggagggagggatgaataggcagagcacaagggaattttagggcaataaaactattctgtattatattacaatggtggatacatgttatttgtcacaacccataaaattgagaacaccaagagtaaaccctaatgtaaactataagtccactctgggtgataatgattgccaaggtagattcatcaactgtgatggaagtaccactctggtgcaggatgttgatagcaggggaggctatatatatgataggatacagcatatatgggaaatctctttactttctgtccagttttgcggtgaaccttctatccagtttggctgtgaacttacaacttcactaaaaataaagttgttgttgttgtttttttaaaaaagcttcaatgtgaataaattttgcagagtgccaacaaaaacaaaatccatgtgtttgggaatttataaaaggcagtttattggttctggttaagaaaaattttatgaaagatgtaaccatgatataaggttaatattttattacaggtaagagttaaatattgtatatgagagaaatggcagtagcaaaaattttagcaggtatagcactctcaaaatgcttttctgtggaatggcacatagtttcattggaccgaaaagcagagagcaattggtagagtaatggaagctaagatttagaaagcagacttgtgtaattttacagctagaatgtttgatgtgttcactcctcattttatacatataaggaaggaggcttacaggtaggataacacaattagttatgaatatttgtcacctaatccctagttctaaattgtattacattatactttagtaattacacagggtcctagaactttaaaataagaagtttaaactttaattggccatcagttttgttgttgttgttgtttgtttgtttgttgtgctttcttattttggacagtagcaaaatagaacatcatcttcgaatcaatatggtagaagtgagcagaatagattatggagaaaatggagatacccaaacatggagaacattcatatttggataatgcagacttgagctaaataatacattttataataaaatggatcatttttgtcagcaaacagcaaaaagattccaaaagcaaaatgatgtatttcagaactaaagatatcattaccacaacaagcttgatgacttctcctgaagttataaagcctagttttaaacctaatcactaaaatgaagtaagaaaaatattcctgcatcacaggactgttagctgtcatattaggcacacagcatgaagaaaaattgctgttgcatgtatgttctagttattacaagtcttttgaggtagagcaaaaggacctcatgacaattattcttatctctttggtgaagtaggagatacgtcatgatttgggtagattgataatgttctttggaagtgaaattgtattcaagccttattcttgaaatgagaggtacaaagctcatgcactctataaagtgaaagaaagtgcagaataacttggggcctgaatagaacttaatgagaaacaagagattctcatggaacacaattgaaaagagtagagttgggtctgacaagagctgaaaagcttgtctttcttcccctttgtgaaattgtacagtggcttggaaattcttccctttgaataattgttcaatttttctctctgaattttaccttgaaaaaaaaataagcctctttgcaaattatctgcccattgtaaaaaattcagtttctctgagctcagagtttctttcctgcagcacacctcatgatgtgcacagatgtcatctggccttcttcctgttgctttgtgagaagtggggtgtggagaactatgaaaaatcccgatcctttggctattgctattcctagaagtaatccatggtcttttatttctgattagaagtcttgtatgttctgccagaatccgtgaaattgtagcaggctaaattattagcttgcaagtagggcacaatctcagctccttcacaattgacagttttcagattagaacatcaacattgctttagtggttgaccatgggaatctagtgtaaggaggcaagtgaagctgaaaagagtactgataaatggaaccatgagacaggaggaagtaactgaaagccttaactagggacaagatagagattgagtgttgttagaggatgagatgacaggtaagaaaattttgagtccctaatctgaggtcctatttagcctccacaggtttctgctcaccgcttctgaattccaacttctggttacccaaatttcagtttcacccattagttacttgtatgtcttcttcaccacttactttatacaaaccctatttttaagtggtttattttcataagttgtttgagagtagacagtttgattgctcccacatgtcagctggaagtgcccttcctgtcacatctaaatgggattggtttagcctccattctgaaatttgaaaagtcaaatgctatcccctaatgttttgtgaattcataaggagcttttatttccatatcacctttggaactgaacccccaccttctcagaattcttgctgttcactctgtcgcttgtggatcttcctttgccatcaaactagtatcaacacagaactcagtcccttccttgactccttttccatcataaccactcccactttccaactctatgttctttttctttgttttgggtcttcctaatgttgtggaagaatgtcaaagtagtggcaacaacttattagttatcccttctaaatgctctttgactctttttcatgctgcttttccatattccattatattactaaatttgaaattgattcatgcttcttagaaacataattgtatcatgttattatatataaaatattatattacatgacataatatgcagttattatggtagtaataacaatgatataaataattatcttatttaggtaaatccagtacatactcagaattagcactgagcctgtttgcagtttcaattcggctgaagctttgaaattactttgcagggccattttgttcaatgtttagataaaaatacattttaagctctgagtgtgtgtgtgtaagtgtatgtgtcattatatgctttgggatggggttcatttgcatagttaactttatttcattcttttcatatcctatcagttgcatttttttatcttgaatacattttatattcatttttatttatatttttatttacatatttatttacatacagtaaaattctctttgttatatacagttctatgggttttgacaaatgcttagagctatacatctaccaccacaaccataacattgaacagttccattgtctctgaaattctctcattcttcctttttgtagacagctcctctaaccactggtgggttctcttgtctctattttgccttttccagaaagttatatgagtggaactgtggaacatatagacttttgagtctggcttctttcatttagccaaaggcagtggaggtggtatgtgaatcaatagtttgttcattttaattgctaaatactatttctttgtagggatataccacaatttacccatttacttgttgaaggacatctgaatgatttccatttttggcaattatgaatagagctgctacaattgcatacaagtttttatgtgaatgtaagttttcattttcttgtttaactttataacaagttgccaaactgttttcaaaagtgacggtacccagtttacattcacactagcaacgtatagtgtgtcagttgctctactcttcactggcatttgacattgtcagagtttttaatcctccattataatagtgtatagtgatatcttgaagttttaatttgcattttctcatgaatagggctattgaacaccttttcctatgcttatttgcatccacatattttatttggtgaagtgtttgttcagatctttgcctacttattaaattggattgcttattattgaattttgagaattatttttatgttctaaatacaaatcctttgtcagaaatgtgatttgcaaatatttcctcctactctgtaacttattttgacatttttaaaattgtgtgtttcacagagcagaagtttcttctttgttaatatccaatttatcaatttttctttcacaaatgatatttttgtgtcacactgaaggatgctttgcttaaaccatgggtaaacagatattattctatgtttaatactaaaatattctgtagttttatgttttaaatttactctatagttcattttgagttaacaaagtgtgaagaatggtcaaatttcatgtactttttggtaaacgaatgtctaataatttctattggccattttaattttatccatttttaatttatcaacttaattcacttaactatttttggattataaagttaatgcaattattttttaaaaatgaaagaagaagtttaatttttttaaaaaaaatccttattctcactacccaaagatattcactataaacattctggagcatatcttttcaggctttattcctcctgcactcagttgataataaattagtgaagatatgaaactattcacaaatgtatcagtgtattgatttttattaatgtaatttacctagcttaaaattcactgttttaaagtgtatattttattggttttaaatatattcacaaggctgtgcaaccatcaccactatatagttgtagaatattttcttcattccagaaaaaaatcattcacacctgctagcattcagtgcttattttcctgtccttccagcccctaacaactattcaactttctatcttaatgggatttgcttattctaaacattttatataaatgtattgatacagtatgggaacttcctatctgttttctttcatttagcatgttctcaagtttcaggcatgttatagtgtgcctcagcatatcattctttttatggatgaatattccattataccgatatgccatattttgttaatccatttattagttgatagaagtttgagttgtttccatttttcagctattacaaataatgctgctatgaacatttgtgtataagtttttgtgctgatatatatttttttgttttcttggatataaacccaggaatggaattgttgggtcatatggtcagtttgtgcttaactttttggagaactgccagactcttttcaaggtagttgtaccatttagatccccagagcaacgttatgaggttcccatttctccacatcctaacatgctaacatttgttattttctttttgtcttttcatcacagccatcctaatggatgtgaagtagcatctcattgtggttttgatttgcatttccctaatgactaatgatgttatgcataatttaatgtgtttattggatgtttgtatgtctttggagaaatgtttattcaaacacttagcccacttcaatttttttttcagtgttaagctgcaagagttctttatgtaatctagaattagacccttctcaaatatataatgagcaaatattttccactctttgggttggcttgtgacttctttgatagtgttatttatatgcaaaagtttttaattttgatgaagtctaacttctctattttttctttggctgcttatactgtatatgtcatattttaaaaactgttacttaaagcaaggtcataatgatgtgtacttctgttttcttctaagattgttatagctttagcacttgcatttaggtggttgatccatgttgagttgatttttggatatgatatgacataggtattcaaattcatttttaacgtgtgcatatctagtagtcacagcaccatttgtggaaaagattattatttaccagagtgaattgtcttggcacccttgtcaaaaattattttacataactatatgtgtttacttttggatgctcaattacattccattgatctacatgtctatcttcgttctaataccatgctgctttgattattgtatctttgcaataaattttgaaatttggtagcatgagttctccaactttattctttttcagattgagcttttctggattcattgcatttccatatgaaatttagaattagcctgccaatttttggcctccttccaaaaaaagacatttggaattttgatagggattttgttgaatctgtagataatttatagagtattgccatcataaaaatattgtcttacaacctataatcttggagtatattttcattattttaatcttaatttatttcaataatgttttgaaagtttacagtgtacaagtcatttattttgttaaatttatttttgcctattttattctttttaatggtataaaatagattgctttcttagtctcagtttagatttttcattgctagtatataaaatgaaacattttaaaaatattgacatcatttattaattctatcagtgtttcaggggattccttaggattttctctatacaagatcatgtcatctgcaaatatagttatatacttcctcttttttcatcatggatgcttttatttttcttgcctaattgtcttagctagaatctccactatagtgttgaatagaagtgacagaagcatacactcttgtctccttcctgatcttggggggatattatgcttaatgttacttgttggttttttgtagatccccttaatcaggtggaggatgtttctttaagtccccagtttgttgagcttttttgtcatggaagcatgttggatttttctcaaatacttttcctgcatctctttagataatcatgtgtttttactttattttatgagatattacattgctaatttttatctattccatcagctttgcatttatccatatgagataaattccatatggtgatagcatatgcttttgtatatgttgccgaatttggtatgctaatattttttgaagatgtttgtgtctatattaataaaggatattgttctgtaattttgttttcctgtgaaatcattgcatgattttgggataaggctaatacttgccttatagaatgcattggtaagtgtttcctctccctcttctaatttttggaagactatgtaaagagaagatgttaattctttttaaaatatttgataaaatcaccagtgaagccatgtggtctttggctttctttgtagaaagtattttttttttcaatctgtttaatcatcacaggtttatccttttttctactttttctagactgattgtcttactccatttggggtgctaaaacaaaataccataaactgagtagtttataaacaaaagaaatttatatcttacagttctgaagtctgggaaatcctagatcaaatcactggaagatttaatttctgataggggcctgctttctggtgcacagagagtatcttcttgctgtgtgctcacatggcaaaagatatcccccatcctaataccttcacaatggtgattcggtttcaatatatgaattttggggaacacaagtatttaggccatagcaattagttttgttagttggggtctttctatgaatttgttcattattaaacatattaatctatttttttggtaaacagctgtttgtagtatcaccttataatcttttttaaaaatgtaagttggtagtaatatacttttttttcattcttttagtaatttgagtattttctttctttaaaaataatttattctagctaaagatgtatctgttttgctgatctttaccacaaaccaaccaacttacggtcttattgattattctctgttttttctagtatctatttcatttatttctactataatcactattatttccttatttctgcttgtcttgagtttagtgtgatttttctttctagtttattaaggtggaaggctgttttttgtttgttttgttatttttgtttgtttttgagatctttcttttttaaatgcaggcatttacagtcaggttttgctcaaagaagttattttgctgcatcctataagttttgatacgttgtgtttttattttcattcatctcagagtattttctaattacctttatgacttcttctttgactcattagttttgagagcacgttgtttaatttccacattagtgaattttccaaattgatttatgttgttgatgtctaatttcattatattgtggtcataaaacataccttgtatgatttaagtcatttttattattttgagacttgttctatagtctaaaatatcacttatcctagagaatgctacatgtacaatagagaaaactatgtattttagctattgttggatgaagtattctgtagctgtccaaacaggttggtttatcacattgtcaagttctctatttcttttctggtcttctgtctagttattctatccatttttgaaattgggttaagtctccaactattatttctgaactatttcacccctccattctgtcagtttttatttcttgtatcttgtggctctgttgttaagtacacatattgaaaattgtcatatattcttgatggcttgacaactttatcatgaaaaactgtccttttttctctatagtacaacttttgccttaaagtatatttgatctgatatttttataacctctccacttctcttttggtttccctttgcagcgtatgtgttttcatccttttactttcaacatttttgtgtcagaatatcatatatgtccattgtatgcatatttttggataatttttatccattaatttagtccattaaaattaatatcattactgatacaaaataacctgcttctattttgctatttgttttctatgtctgtgtctgtttttcttccccgcaattccttctttactgtcttcctttgtattgagtagttatttttttgtttaccattttaatacacatcttgtttttttaacaatatgtttttgagttattttcttagtggttgttgtggggattaccattaatatcttaatctataacaatctagttaacatttataccaacataatatcaatagtatataaaacttgtgctcctaaatagtctcaactagtccttatgctgccacagattatatctctatacattgtttgtccatcaacacaaggttataatgattgaattatgcagttgtcttttaagctaggtaggaaaaaagaggtacaaacaaaaaatacatcatttatatttaactctcccttcatatacttatctgtgtggttacccattagtagaggtctttatttcttcttgtggattcaaattactttctagttttcttcatttcaagctgaaaaattccttcatcatttcttttagttcaagtatgctagtgacaaattctttgaatttttgtttatctgggaactaatttatccttatttttgaagaatagattttctggatatagaattctagttgacaggattattttctttagtgctttgactatgtacattctggcttccatgacgtctggccattgctttggccttcctaatttcttattagaaattaactctatcttcttgaaaacatcccgcgaaaaacctaatagcagcctagcctgaacacacctgtgctaattaaatgtgtattttctagttctgatattcagcaaaaaggggactcacactcagcctgtctcagttttcatgctaaaccatatcagctagatttgtttaagtttattatttgaagttttaacaaatttatttaggtatgattgacgtacaataaattgtacatatttcatatgtacaacttgatacattttgacatatgaatgcacatgtaaagcagtcaggataatgaacatatccattactccccaaaatttcctaatgcctctttgtaatccattcctcctgcctctccatgacccatctatccctatctttaggcaagcactactctgctttatgtcactatgctatatagtagtttgcaatttctagaattttatgtaaatggaataatcaatgcactctttttttgacttgcttattttcactcatccatgttacatgcatcaataagttatacctttttattgcctactagtatgccagtaggtttgacatatcattcgcctatttgtctgttgctgcacatttggattgtttccagtttggggctattttaaataactatgaccattcctgtatttaaaaaaaaagatatcaactctatcttataaaggatcccttctatgtgatgagttacttctctcttattgctttcagtaatttttatttgtctttggctactgacagtttgtgatgtatataggtagcttagcatttttggctgccataacaaaataccatacacttggtggcttaacaaacagaaattaattttctcatagttctggaaacgcaagtctaagatcaaggtgacggtattgtcagctcctagagagagctctcttcctggcttgtagatgaacactttctctctgcatactttcatggtagagagagagagcgctcatgctctcaatatttctacatataagggcaccagtcctattatgagagcccattcttatgatctcatttagccctaattgcctcccaaagccccatttccaaataccattatatttggttagggcttcaacatatgaacattgaggggaacacaattcagtccatagcactgtgtgtggacctctttgagtttgacctatggggagttcagtgtgttttctggatgtgtaaattaatgttcatcaaatttgggaagtttttcttctgttattatttcacatattctttctcctcatttctcttttgtttcctaggactgattgatgatatcttgcaggcctctaaggttctgttcacttttctttgttattcttgtttttgttcctcagataataatatcacttgacttcatgctcattgatacttccttcttcgtgttcaaatatgctactaagatactctagtaaatttttaatttcattgattctccttttcaaatccaggatttccacttggtcctttatttttttaaataatttccgtgttcttattaatattctccagctagtgtgacaatgttcttatactcttctttagctctttgaacatatttaaattggctgatttaaagtctttgtccagtaaatccaataaactagtttcctccaagacatttcctattgattgtttttattcctgcttgtggaacatactttcttgttcctttgtgccattcattttttaatgaaaattgatattttaaataatattatatgggatctctagaatgagattcttgtctctccccaagatttgctgttgctgcttattgtatttatagttgttaattgtttagtaaattttctaaatttaatttttaaagtctatattctttgtcatgtgtagcaactgaagtcatttctcagcatagtgatctaataatagaacagtgatttcctttaatgcttggaaccaataaattctccagcctctgccaatggggtctgtagtctacattagcacaaatatttgacattcacctaaagttgagagctctttcctaacctttacctcttgcttgtacagtgccttaagttcagtcagaggtgaaagcttagcccagtcttagattttttctgagcatgcacatatatctgtacatgtgtggtcatctggattcctagggaatatgctgcagagtttcaagaatctatggattttttcattcgctagtttttcctttaagctttttgtttagtttactatttgattcaactgttatccacagctttaggcagctgcaaagataaaacattttcctgtaattgttttttacatgggtgctgaggagaaggtttttcacactgggtgaaatccaagtcaggtcgacaagaggcagcctgttaagtggggtcttccatggaagcactagacatgtaaaataatgtgataattctttaggattgaggcgttgaaaaagccccagttccattctcctttctctggtggctaccaggctgtataggaatgtgggccattgtgaatagtgccgcaataaacatatgtaaaaaacatgtaaagtgcatgtgttctttacagtagaatgatttataatcctttgggtatatacccagtaatgggattgctgggtcaaatggtatttctagttctagatccttgaggagttgccacaatgattcacaatagcaaagactttgaaccaacccaaatgtccatcagtgatagactggataaagaaaatgtggcacatagacaccatggaatactatgcagccataaaaaaggatgaattcatgtcctttgcatggacatggatgaagctggaaaccatcattctcagcaaactcacataagaacagaaaatcaaacaccgcatgttctcactcataagtggtagttgaacaatgagaacacatggacacagggaggggaacatcacacaccggggcctgtcgggaggtggggggctagcagagggatagcattaggagaagtacctaatgtaggtgacgggctgatgggtgcagcaaaccaccatggcatctatctatctatgtaatataaaactgcatgttctgcacatgtaccctagaacttaaaacacaataaaaaaaggaaaaaaaatgtggaccattatttttcaaggctactgaaacatacagagcagaagatgaatctagagcaagctaaaacaccccaaatttttaggttttttcaccaagacttagcttttttatttctttttaacaaatacatattggattgttgtgaaactttgataaattaagagtttttgaaaagttgattttgacagtgtttgccagttttaaaattttttatgaagagcaaattttcagaggttctttctctgccattttcactgattttacttctgtgccctggatttaaatagtacagattaagtttccttctttgaacagtacaattttagcctgacactttagtttcgggtcccctaaaggagcaagcaaattggtaggacactactcattgaatgatgtaagacagtttgccagtcattatccacttcacttattgttacatggtattgtactgttcagctgctctggctctgattcactccattaggtcatgtttcataagagatttttaaagttcaattgaaataattaatcagaatcatgaatcggcattaattggaggctcctaaatgagaaagtagttaataatgattacgtttgaagttaaaatagatattatatcattcacattagaaaaggtgaacatatcactcatgttcagaggatccttttccttagtaaaaatgcattcatacaacacatggcactgccaagatttaaaattcatacatctgtaatatctgtgaacatggcaaagatttgcctttcaataattcatataacactctgtcataggctgagacagatcaagatatgtggagccccacagcaggttggtaacttggcaccacttaaacagatactttaaaaatattctttcagcatttatttggtggatacagagggaaattgattttttccttacttatttattttcatatcaaataactttaaaacactattttattattttattttaattaattaacaaataaacattttatatatccaaggtatacaacatgacgatctgatatacacatatacattgtgtaatggcacaagtgtatagtcaagttaacatatccaccatattcatagataacatttttatgtatgtgtgcatatggtagggacatttaaaacctgccctctcatcaaatatcaaataatacagtattgttaactataatcaccttgctgtacattagatctatagaacttctttattttattactgaaagattatgtttttgaccaaaatctctttatcccatcctccagcctctggaaatgactgttctactctgcttctatgagcttgatctttaaaacattccatatattagtaaaatcattcagtatttgtctttctgcatctggcttgttttgtttagcgtaatgtcctctaggctcatccatgttgttgcaaatggcagaatttccttctttttattgttgaataataaaaacacaggcaaaaaaagcaaaaacaaggcaaggcaggctacatcaaactgaatagctgtttgcagagcaaagaaaaaaattcaacaacattgaaagacagcctatggaatgagagaaaatattttcatatcatataccttacaaggggttaatataaaaaatgcaagatactcaacagcaaaaagtctaaacaacacaatttaaaatgtgcaaaaaccagaacagatacttttccaaataagacgtaaatatggccaacaggtatatgaaaagttcatcagcatcactaatcattggggaaatgctgattaggaccacaatgagatatcacctcatacctgttaagatggctatcaaaatggcaagaaaaacaagtgttgatatggagaaaagggaaccttggtgtactgttggtgagaaagtgaatttgtatagtcattatggaaaacagtatagtttcctcaaaaaattaaaaacagaactaccatatagtgcagcaattctacttctgggtataaattcaaaagaatgaaatcagtatcttgaagagatatctgcactcgcatgttcattgcaacattattgacaatagccaagatatggaaaacaaacctaagtgtctattggcacatgaatgaataaagaaaatagtatatgtatatacacacatgcatatgcacaatggaataaaaaataatacaattttaatttacttggaagtataagttgattttttactttaatcagcatttaaagctgggtgattcagttatattagtcaaaagattaatttcaataaatactttgatgtagttatccaaaaatatttagttcatttgctttaaataatgctgcaagtgatatagaaaaaataattattaatcttttagttcctgatcttaaagcttttacgtttatgttagaataccttattaaatatcataaaaccaggacttctgttcttcatagctttcttctgttctgtgcctccagaactacaagttaagtcaagttctcattttgaggtgtttgcttttgtacaaaagctctcattcttttgtacaggcaaggcttcattgctgggtattgtattggagttttgcaccaaatggttcaccagttagtaatgtttaagaacttgattaccatttgggatagagagtataattctgattaaggctagaatgtagttctaagagtcttaatttaatgctgcttgataaaaatagtgacttagaatactacttgataaaagtcatggtcagaatatgtggctcagactcaaagtttctgactttcctgagtgactacattcaaatatctatccaattatcatctctttatttgtagaagaggaagaaatgaagtaagagcaagcattactagaagaatgttgactttcccttcacactaggcccaattttcctctgctttggttttctctgttaacctaattggacttttaacaagtaagactatggtcattcaggtatttgactatttcttcttgaaggagggtacaaagtgaatattctggaaactctacaatatcttcgattgctactttaaattttagggagatgaatgacataggtgatatggtggctcataagagcaaattaattacaaatttattctctattctatgatgaaacttttccttttgtattatttcttgaactagccaagcctatcaaatggttatacaaagtgtactaccttctttacttaatggtagcctttgatgaaaacaacaaaacaaaaaacaacaacaaaagggggattgagatcttagagtggtagaaggctgagaaaacctaaatctacatcacatttcataacataaaccaagaaaatgtgttgtatgattacctgaagaaccaataaacctgaattgaactaataacagtaaatgtaacatctggtaaactacagttataatgcagtttttcttatgtggacaagaaaatgagaggctaactaaccatttattctatgaattaaaagaaagcctcaaatatttattccctcaaagtcatgttctatctgctaaaaatgctgatcaatgttagcttaattatagaaaactgtattttatttatagcaaactggatgtttactggtagaactgtgcataaatatacactcattatatatttagtgttcatttaggctgctcaacatcttggtctattataggggaaattgtaataagcttgaagcatagttcttagccatagtatgtatattgatatcctctttttaaagaccatttgcaagatttgaggatcatttttaggtatgattagaatttcctaatgagaattttcagtctattaaaaatggctacaccagcactatccaatagaaatataatgtaagccatagatgtaatttttgaactttctagtagtcattttaaagtaaaaacagataaaaataattttaacaacatatttcatttaacccaatatattcaacattttaccatttcaacatgttatcagttcaaaacaattatgaagggaggtattttactttttatgttttagagaattatcatccgggcgtggtggctcacacctgcaatcccagcactttgggaggctgaggtgggtggatcacctgaggtcaggagtttgagaccagcctggccaacatggtgaaacccatctctctactaaaaaaaataaaataaaatacaaaaattagccaggcagtgtggcacgtgcctgtaatcccagctactcgggaggctgaggcaggagaatcgcttcaacccaggaggcagaggttgccatgagttgagatcatgccattgtacttcagcctgggcaacgagaatgagacttcgtctcaaaaaaaaaaaaaaaatagttcttaaacagcccatctcaattcagactattcacatttcaagggctcaatacccacatgttgctactgactactggttggaaagtgcaagtttctacctttatccttgagatatttaactaaaaatatgcttatgattgccagtagagtttccaaaaaggatctgtagaatgtcagagatggcagttaaatggaagaaacagaacagcatatacaaagtctaaaaagcaagagagagaattgattaaaaatagaaaaataattgtatattagtgcatattatgtataaaatatagtaaaattttgtccttaattctgataaggaagttccttattcctactttcctgagagtttttattagaaatggatgtgggattttgtcaaatgtgtttttttgtgttattgagatgaacatttttctttttagtttgttaatacaatggatgacaattgattttctaaatgttaaaccaaccttgtattccattgataacctagcccttgtagtattggcatggtgcatattcttctatccctttattggttaactatttgtgactttaaatgtgaagtacattttttgtaagtggcatatatttggagcttgccttttaatctgatgtctgactttcaattggatgttcattagaacatatacatttaatgtggttaggtttccatcatcatcttgctgttttttttttttttcctgtttgcccaatctgttatttgtttttttcaccttctttttcctgcacattaaaaattagttaaataccaatggttactttagggtttacagtatacttatttaccttatttaagtctaccttcaagaattattatgccacttacatgatgtaaggagcttagaatacttctatttccttcttggtttatgctattgttgttatatatttctcctatacatatgtgataaatcccaatatacactgttattttgttcagatatcaattatatttaaagtgatttatagaaaataacaataaaaatcatatattcatgtggttactatttctggtgctcttcttccctttttatagatctgtatttccaactgacatcattttattctgcttgaaagacatttctgcctaaaggatattgatatttattataaacagatctggtagtagtgaattattttagctttgtatgtctgaaaatgtgttttggtttgcattaattttttataagatattgtaagtatttgtatatttctatttttaatatcgcattctttgtattcttgtcatatctatcttgtttattttttaatgtttccttatccactacttttaactgtaaaattattttttattcaccttccctcttgattggtttggaatttataaattagaattatcttagaagtttccgtttaaatttgaaaatgcaaacatattaaattctacatcttaatatttctgctaatcctttgactcctaccatattgtagtgaattaaaatcttttgttatcaagggtttaatttttttcttttgaactccagaacatggacaatagccttcttcttcttcttttacatttcttttaaaatatatattataaataacataaatatcaattatccttactagatccacttgttttcagactcatcttccaatttactagtttttttcgtttttcttccccctactttcttttcctatctgtggggcttttactctgcagaccttttttcccccctgaaactattgctttagaagttcctttagttaaagtctgtgaatggtaaaatttcttaattttctggctaaaaaaaatttatttatatctcttattttaactttttaaacatttaaatatttacacacataattttattttctgtattccattttacttcctattgagaaatgtgcagttttattgtctttttgtagtagaggatcagtctcttgcttgacagtcttaaaatttttatctttttttgggtattctacaggttcattgcaatgttctaggtgtagattttaaaataattatcctacttgatatatgacatttttcctaaatttctgaattcatgattttgtcacttatagaaaattctttcattatctccttgaatcaagaaaaaaagatattaaagtgactagacagatttataaaataaaacagaaaaaaatgtaaaatgcaggaactcaattgtttcaatagaagcttagataacattaaaaagagatttagtgcactgaaaaatggatgtgaagatattgtcgaaaatgtagtcatttttatattattcctttccctccaattccttgcacttataaaacagctacatttacccaaatttactagaatccaagacttcactgcttctccctactccctccagtcctcagatgttatggttcctggtataggaaattgctctcagataggcctctgctctagttttctgttatagctcactaatctggtttcattttagcatttatttaaattttaattttggggtccttgaagatttcacatacatatgtgtgagcttaacaatacatttaaaatgtggttgtttcttctccccatacaaacctctatctatctgtctgtctgtctatctatctatctatctatctatctatctaattatttgaggaaacagtctcagatttttcattttagaaagatactttaggcacctaagagaagaatgaaggggccaaaatatgaaacaggtagaagaagtagtaaattgaataagtaatccaagccagagatacaagcaagtatcgacagattagagaagtgtttaacaattaacacttagtaactggatatgtaggaggtgtaagaaatcaaagatgacttattttaaaggtgaactgaacgttatacggtattcccttggtatccattagggattgggtccaggaacttcctgtgatgctcaattccctgatagaaaatggtctagtatttgcatataacctatgcacatccctttgtatactttaaatcatccctaggttacttataatacctaatatgatataaagactttgtaaatagttgttatactatatatttttttttactattttttttttttttttttttttttttttttttttttgagacggagtctcgctctgtcgcccaggccggactgcggactgcagtggcacaatctcggctcactgcaagctccgcttcccgggttcacgccattctcctgcctcagcctccccagtagctgggactacaggcgcctgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggccttttttttactattatatttttattttttcccaaatattattcatccatggttggttgaattggcagatgcagaacttgcagacccaaaaggtcaactgtatgtaaattattccatatttgttaaagttacagcatgattgttataaatttatgagctttagttaatatttttctattgtgttagtgacatgattgcatttatggacatttaccattggctccagttcaaatgatagatctttgataatgggactttgggaaaatggagatagacaaattttcacattatctactttctgtaaaaaacaaatacctttcagttctccttttccctcttctagacaaagtctgtttacttacttcagttccagatacaagatccattgtttaaagtggcataccttgttgagagggaattacaagttggctatttttatgttgttcttttattgttttattaatgccttttcatcaaatactttgactccaacttataaattccttggtatccactggctcagataaactataatgttatattctgaaacatcagtagataaaaactgtcagcatttcatcatgtgcttttaaaatttgaaaagcttatacaaatattaatgaatatttaaaatattacagtttcttgtaatatcatattgtttattaactaagctagagactaaagtttatctggccctgtaattgtttttaagaatcggtgaaaatttcccaacttttggaaagacatattttgtaaatttttattctattggcttttttctagtacacagttacagcttaaacattctaaaatattgaaagaaagtgttgttagtaataatagattaaaataaagaaatgtatgacatactttaaaaagcctatttaccaattttaaaaatatagtattgttattattcaattatatctgcttattatatatttaaaagttaaaaaaagcagaagaaaaaaagaatcacctctggtttgattatctagagatgtctactattaataaaaattacgtatttggggtatgatatctgattctagattctttaagatcacctcttaactttttctagtctccttaattctagtgtacactaatgtcaaataagataattattcattgtgaaagctttcataagaagatatttgttactctctgtaatttaatgtcctactatatattgtgcattgacagaaataaagcagcacttcaatatgcaaacattgagacccagctggaaagcatgcaatacccactgaggcttctaatgctatgtgaaatacacaaagggtggtgtgctaggctaaccttttcaaatggcagaagaaccagtccagaagactaaaagcttttctacttactttcccattcaattaaacatctacacactggaacatgggtgttctgatcatttcccatctgctgtgagatactaaggatgtaaactgaggttttaaacactagtctatacacagtctttattttattttattttattattattatactttaagttttagggtacatgtgcacaatgtgcaggttagttacatatgtatacatgtgctagctgttgtgctgcacccattaactcgtcatttagcattaggtatatctcctaatgctatccctccccccttcccccaccccacaacagtccccagagtgtgatgttccccttcctgtgtccatgtgttctcattgttcaattcccacctatgagtgagaatatgcggtgtttggttttttgtccttgcgatagtttactgagaatgatgacttccagtttcatccatgtccctacaaaggacatgagctcatcattttttatggctgcatagtattccatggtgtatatgtgccacattttcttaatccactctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaaatggtgtgagatggtatcattgtggttttgatttgcatctctctgatggccagtgatggtgagcattttttcatgtgttttttggctgcataaatgtcttcttttgagaagtgtctgttcatgtccttcacccactttttgatgggattgtttgttttttttcttgtaaatttgtttgagttcattatagattctggatattagccctttgtcagatgagtaggttgtgaaaattttctcccattttataggttgcctgttcactctgatggtagtttcttttgctgtgcagaagctcttgtgtttaattagatcccatttgtcaattctggcttttgttgccattgcttttggtgttttagacatgaagtccttgcccatgcctatgtcctaaatggtaatgcctaggttttcttctagggtttttatggttttaggtctaacgtctaagtctttaatccatcttggattaatttttgtataaggtgtaaggaagggatccagtttcagctttctatgtatggctagccagttttcccagcaccatttattaaatagggaatcctttccccattgcttgtttttctcaggtttgtcaaagatcagatagttgtagataagcggcattatttctgagggctctgttccgttccattgatctatatctctgttttggtaccagtaccatgctgtttgggttactgtaggcttgtagtatagtttgaagtcaggtagtgtgatacctccagctttgttcttttggcttaggattgacttggcgatgcgggctcttttttggttccatatgaactttaaagtagttttttccagttctgtgaagaaagtcactggtagcttgatggggttggcattgaatctataaattaccttgggcagtatagccattttcacggtattgattcttcctacccatgagcatggaatgttcttccatttgtttgtatcctcttttatttcactgagcagtggtttgtagttctccttgaagagtccttcacatcccttgtaagttggattcctaggtattttattctctttgaagcagttgtgaatgggagttcactcatgatttggctctctgtttgtctgttgttggtgtataagaatgcttgtgatttttgtacattgattttgtatcctgagactttgctgaaattgcctatcagcttaaggagattttgggctgagacagtggggttttctagatatacaatcatgtcatctgcaaacagggacaatttgacttcctcttttcctaattgaataccctttatttccttcgcctgcctaattgccctggccagaacttccaacactatgttgaataggagtggtgagagagggcatccctgtcttgtgccagttttcaaagggaatgcttccagcttttgcctattcagtatgatattggctgtgggtttgtcatagatagctcttattattttgagatatgtcccatcaatacctaatttattgagagtttttagcatgaagggttgttgaattttgtcaaaggccttttgtgcatctattgagataatcacgtgattttagtcttaggttctgtttatatgctggattacatttattgatttgcgtatgttgaagcagccttgcatcccagggatgaagcccacttgatcatggtggataagctttttgatgtgctgctagattccgtttgccagtatttcactgaggatttttgcatcaatgttcatcaggatattggtctaaaattctcttttttggttgtgtctctgccgggctttggtatcaggatgatgctggcctcataaaatgagttagggaggagtccctctttttctgttgattggaatagtttcagaaggaatagtaccagttcctccttgtacctcctctggtagaattcagctgtgaatccatctggtcctggactctttttggttggtaagctattgattattgccacaatttcagagcctgttattggtctattcagagattcaacttcttcctggtttagtcttgggagggcgtatgtgtccaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttctttattagtcttgctagcggtctatcaattttgttgatcctttcaaaaaaccatctcctcgattcattaattttttgaagggttttttgtgtctctatttccttcagttctgctctgattttagttatttcttgccttctgctagcttttgaatgtgtttgctcttgcttttctagttcttttaattgtgatgttaggtttatacacagtctttaatttatacacagacctgtctcacagttgaaatatacatttgcatttagcgtgggcagaaatgagcaaatttggcacttgagggtatggataatatatttggggagatagtagatttctgccggcatagaaatagtttggcagatagtttagaagttaggaggataattaaattaaaaattaaataaatattacctttactaatctcctatttactgaatcacatttaaagggaaattccttagaaaaataatctatggaaatgactaccttataaagttgaatatttcagtgcaaagacaccagaacatatctaaattaacaatcaggtaacactttagttggtattttaaggcatatatctaatctcaaatctctaattcacatttgtcaaggaattaatattccaaatatacaaggaactcaactcaacagcataaaaagaaataatctgatttaaaaatgggcaaatgatctgaatagacatcacttaagagaagatgtacaaatggccaacaagtatatgaaaaaaaaatctcaacatcattaatcgtcaaggaaatacaaatcagaacctacaggagataacatcttaccccagttagaatggctattatcaaaaagacaacaagaaatgctggagaggtcgtggagaagaaggaataaacataatagtgtttatttcttgcaaaattgtcctccttttgatgtattatacaaggttggtgggaatgtaaattagtatagccattatggaaaatagtgtggaggctcctcataaaactagaaatagaatggcaatcccactactgggtatctatcaaaggaaagaaaatcagaatgtcaaggagacatctgcactcccatgtttattggagcactatgcacaatagccaagatatgatatcatcctaagtgtcgatcaacagatggataaagaaaatatggtatatatacccaatggaatgctagtcagccataaaaaagaatgaagtcctgtcattcacagcaacattgctgagcccgaaggacattgtgttaagtgaaataagccacgcacaaaaagataaataccacgtattctcactcatgtggaagctaagaaagttgatctcatagaagtagagaatagaagagtggtaactacaggatgaaagggtgaaggggagagaaaatagggagaagctggttaatggacacaaaattatgcctatataagaggaataacttctaatgttttatcgtactgcagggtgactatagttagcaacaatatattgtatatttataaatagctagaagagaggatcttgattgttcccagaacaaagaaataacaaatgtttgaggtgatgaatttgctcattaccccaatttgatcattacacattgtacacatatataaaatatcacaccgaaccccataaatatctacaattattgtgccaattaaaattttttaaaactctaattaaaagatcatttgttttagtatttaaagtgaccacatatataagaattcatttaaaactttcttcaacaaaatattacactaattccatttggcaaatgcttttcatttccttatgcattttctctagttaaaggttatctttgccataggtgctagttagctaacaatcattcaatgatacatagattcacaagcatctccattaatctctggaaaatcaagtatataatatatataatcagaaacacatttattacttacaatattttttaatttaaaaattttgagaattacattgaaatatcacaataaaatcttttttcatgaaaagccctagttacagcaataaaatattaaacattattcaagaggaggataggtccattttgtatactttagaaaaactgccctcaaaaattttcattttttcaatccatatagaattgaaaagttgtttctttgcctttttctttgtctacagctgaacaatagagtttcttgcaaaattttcctccttttgatatattggaaagcgaggcaagagtccccgttgacttagctgccagaaaagacacccttctccgcctgggtttgttttgctccagtaaataaaaacaggattcagttgggctctgagcaaaatctgttcctgtatgcaattttgaagtccattacgggtgcccctactgagcacttagtttacctggccagggatgactggatatggccagctgacaactccaccccaccccactcccctccccgcatccctctcccgctgagaggcctacagcgagcggggtcgggtcctgggtgctctctggtcttgtctgagcgggcaaccttttctgaaggcctctgacccttcctttgctccccagacacccgggaagggcagaaaaaagggagaaaggatccggcgttatagtcctcgaagataattctaggtgggagtgaagggactgggagagtgtgctgccgttggtcgggtcgggacatacagggaattagaagagaaggactaaagccagagggacccctccggcgaggcgggatggattggggtggggcctgctctctaggggactctcaagctcttggaaggtcacgtgctcaaactcggcgtgaccgtgcctcccaggccctgtcccccaccacccaggggaggagaaggcggcggcggcatccacggatcagggtcaggcccgcggcttcgagcccgcgtctcctgctcctccgagagacccaagctcatgctcgggtgaagcggacgcagatctcatccaggccccagcactctgggtactggtggcgggggacgtcagcgggagaaaagccttggccttcctcctccggccgttgccgcggcaactgtgatgtctgaggcggagggtcgcgggttgggagcactgctccccctcgcggagcgcggcgcccggagcgcttagcgcgcctgcaggtcgggggaggcgaggaggaggctgacagggtggagggcgcctttctccctgccaccccctccagcgttgctatggacaccgccagggcaacctcacctgtacccgctgctccagccgccgccgctgaagtagaaacagcaacccgagctctcttttgccccagcatctcttccagggactctaacccagcagctgccaccgcttgtctcccacaaacaggaagtgagagggcagacgtccaacatttgtccttgttccattaccatgcctgcctttatttggctttccattctacattttgtatctcagcatcttccagagtaaatggtctagaggatggaaaacgcttccttttataccgtctgccacgcctcttctattagcagacagctggtttaattctacaaaacactgtcctgggccctatttaattatcagaagaaatatattttaaaagtagcgtgtttcttgtattacagcagatatgtagaatccctagttttcattagaaggatatatagctatttataggaatgttctcttgctgctaagcacccctgaaataaacactttttgacaaatgagtagaacaattctgtgtcaggatatctgggatacatagtacgtaaaaacgagctgtttagaaaccccttcttttcccatctcatttccagttctatatgccagtgctaaaatctcttttctgggctctaatccatctgtgtttgaggtcagtttttgactttgcaaggggatttatttccacatggctctgtttttgaactcgagggtggggggtaaattaaatattcgactacttacactcagctcaggtgcaagatttagtgcatagatgcatctctactgactaccgacgtaaatgcacttagtaaaaaagactctccctgattagagcaaatggaggcatctgtgatcttgaattgccagccataccctggcaggctctgtgaactactgttggtcacaaccccttgctctcaaatttcttttctgttgagtgtatatatggtaaagctttcattctctgaaagcaccccggtagcttttgctactgataatcatgagtttccttacatagttctgcaagtttgaatagacaagccttttcagctgactttgatactacctctttagaaaatcccaacaatgcaagataactatttcttttttttaaagctgataggtgggatacttaataatttcattttgtcacactttctgtgtcatggtgttttcaaagccactaaaagagattttgatatagtgcaagccctaggtaaagctatgaattcgaaacatgtttatcttcaatgtcctatctaccctgttcctacctctcccaaaggtcacctggattcctaaataccaaatcgaatggtccctttcatttgtcatcctacttaacctcttataagaatttgacgctcttgatctaacttctcattttccttgataatctcttcccatcttcttgtgctctctgacctatttgaaggtcccttctcagtctttttacttttctcttttccttttttgatactgtattttgatctgcttttttttttcattctgcatattttcctgggccttttcatccacatcaattgttttatctgccatcttattttcttgtcttctaaatctgtgttatcttgtgcaaacttttctctgagctctagaccttttttctgagctacttcatggacaattctatatatcttacctgcaggcatctcaaattcaacctgtgactcactgaactattttcctatccaaaatttgattttcttattgtattttctatctcagttaatgaccctatgcccctacttacacaagatcagaagcatgagggccatttattgaggtatatatttatctaatgaaattttcttactggcatctaccatatgccagacagtgtcatgaagcttaattctagtagaaaagaaagattaatgtatttatgaccaagtaatataattccagcttttggtaaattctactacagaaataagccaggtgttatatgataaagaagagctgagaagagtactctacacaggatggtccaaaaaagttttatgtgttaaaccaaaatgaagaatgagaagaagccaaacatgtaagttgctggagaaaaaaaacatgtcaggcagagataatagcagtcacaaagatcctgcagtgggggagggcctcctgtattcaagaaaatgacgtaaaagccaatatacgtgatgagaaggggacagtggggtgtagtgagtgtgggaaggaggcaggggacagattttgtatgactctgtgggccatgatgaggaatttggattttatactatgtgcagcaggaagccattgaatgtttttattaagagtggctgaactgtttcatacttatagatgatcattaggctgtagggtggagaatgaattggaatggtgacagtttggaagtggagaggatattaatgacaatggaagtgttccggatcagcgatgacagtggtatggaagtagagagggagacgagtgaacagacgtgaggtattttcagtgatcttttgtctttatcactcactattgtgtgtcagtctcatttctgtccttagagcactccatgccatatggagctttccacatcccaagtccttaccgataaatcctatttttatggttcttatacttttagaaccttaactgaatgatagttacatgttacctgacaaggagaaggtagagaacaatagttaagaaagtaggctccagagttaagctgccttggttcatagccatgctccaatgacttactagcagtgtcacttgggcaaattgtttaacctttctgtttcattttctccagctacaaaataggaataacagtaataataattatttacaggatattatggggattaaataatgcatataacacacagtatatggcaagtctcagtaaattttagattatgatgttgctgctgatggaaaatgatagaggatgtaagatcttactctggtaaacattttaatataatgcacgggaagttctgcagcctttccttgtaacttgttagtaagactaagaatcagaagaggaaaggcatcatgtctggcatggaaggaaatgggaaatattctgacaaacaggcatccaaaatagttgctcatcaaatctcccttcttggggaaacccttctataggaaagcattttctgttcctttctgatttcttaatcttgctttctttgagcctgcattaaatcattttgtttttcttgttacagtgattagaaagaaaatggatatgaagtttttaatcatgacaagaataatagaatacctttaagctggaaaaagttgagacttgctactacttggtgattttctttatgtcttgctaattcaataggaaacactccttagtacaatcttgtcctgcataataatgttttggtcaaggatgagtagtgtatatgatgatggtctcataagatgataatactatattttacataccttttctatatttaaatatataaatacccactgtattaaaattacctacaatattcagtaccgtaacatgctgtataggtttgtaacctagaagcaatataccatgcagcctaggtgtgtagtagtctatgccatctatgtttgtgcaagaacactctatgatgtttgcatgataaggaaatcacctaacagtgcatttctcagaatatatccccctcattaagcaatgcatgactgtaattccaaacttcagttttcctgcattcacaactaagccaatattgactgccttgttttatcaagttattagtatccttcatgaatggtctgtatctcataattttccaactcagttatcaaggtttctctgatttattgaataaatcagtgattctttataaaatatacctttcaacatttttctttcttttcattgttgttttcctctgtctaaattagattctcatatttttcaaatatatatatatatgttacatttttaacatctctctgaccaactttcacgtatttgtggcagatttattttttcgaagtatggagctactcttgtcatcctttcattcaaaaattcaaaaactctttactaagaagaaagttacaaattggcaaaagattcgtattcagactttatagagaactataagaaaaagggagaccagccaataaaatattgggcaagtgactaagagagatattcaacaaaagagggcgtctaaataactaataaatgtaagaaaggatccacaacctcagtagtcatcagagaaattaaaattaaaaccactatccacacatgtatcagaatgacaacaatgaaagagaatgccattccaaagagtttgtgagaatgttgagcaatcagaatgttagtatactgctagagagacatttagttaacacacccacttgggaaaaactatttagcacattttacaaagatatatatatatatagcaatagtatatgacatgagtgatgggtgcacaaaaaaaacacgaatgaaaccgttatagcagtattatttctaatagttaaaaaacataaatgactctaatgtttttcctgaaaaaaattgttaaataacttattgcatattttactatgcaatactatgcaacaataaaaaaagtacttctacacactacagcatgtatgaatcccacaaacataatgacataacaaaataggcaacacgagtctatgttgagaagctaaggtagtagctatctctggggagataagcaagattagtgattaaaaaacagtcaaagggagcttgtaggggtgctgctactcttctatttctggaacttggtgatccgtatgtggaagtgtttaatgtgtacattcattaaactttatacttatattttgtgcattttgtcttagttatatttcaattatttttttaaagacttgtcattaactactgtattaagtcactgtcttcagcctctgcctgttggattttaacctgttttctggctgtttcctcttacatctttgcatgtgtcttacgttttcaacagatttgactagtaaatgaatttttcttcatattcattgttttcatccttttagtaatggaatcctctgaatgttagctggacacatgtctgactccttttggccaatcttctgactacattttctagcctgcctcagctctacatatggctgtgtgattaagtttgggccagttattcatagcagaagtaatgggtccgatttacttcctgtatgttactttcacttttacttcctgctgggaaatagcaatgtctgggaaaccttggcaaccacatgttctagatggcagagctaccatgctggctgtggatcactggactgttagatgaaagagaaattaatttctgtcttatttaagctataatattttgaggttcctttattacaatatagtctctgtcttaacacagtttgttataaatattgcaattcatatgtgtctctgtgcattgatttggctaatcactctttccagagatgacctgacctactgaaatgatctccaagaagtgccatattcactgatttatatcttgcagtgctttccatttcttagatatctgaccatggggaatgtattcatttatttgagtctcagcttcgttacctgtgaaatgggaataatagataattattatgaacactaaaggagttaatacttgtaaagtgtttagcagtctggagtacatattaagcactcaacaaatattattttcacctaatagttttaatgtaaataattgatatggaactgagcaatagcacaacaaagaaactcaatgtacattggaagaggatatgaattaaggacatttaagagacaatcatttcatgattcgagccttctagagatttgttattattttataaatattggaaatagtgtaatgttaatataaatataccttatgaccaagtaattctgctcctagtgatgtatcgaaaagaaatgagtacatgggtatatgaaaaatataacgaaaatatttatagcagcattacctttaatagaaacaactggaaacaaccccgttgtttcctacacataagagcaaaactaactcttaattttggcaaatttattttaactgtcccatgcttctctttcttcttaaaaattggtaataatagttcctgactattgattacttaagaatatgacttatctattacaatgtgatttggggaaaaattgctaaaagtctctaagttattaaaaataaattgcacttctatttttagtattccctttcaattatcttctagcaattttcttttgtctaagtacttcctttaagtcccttcattagggtggtaaatgtttttggtgtgtttgccagaagaaaaccctctttcttgcacgataatttttctgattatataaatctatatttttcagcatttgccctcagagtcgtgaagctattattgtattgccttctcacttggtgactattgagaggtttgctgtcggacaaactcttgttccataagggtgatctgtctcatctttctggctgttttttcttttaatataatcagtttgtggttatctgcagttttatacatagtaatgtatgcaagagtgaatttttgcaaacaaaattatcctgtgtaggattcactgtgtttcttaaatctgaggtctcatagctctattaattttcctccattgttttcccaaaagattagactattttgttttcaaaccaagagccaaataaacctaagacacatcacctggtcatgtctatttacaagtagttcattcattcactgcatgtggacatttttttaagagtcctatttttacatgaacatttctgtttcaagtcttgtggcccattgctcacatgaccctagaaatttacctgactttatcaactctgcattttaaactatgcttattagtcattctttctagttgttttataatggaagatttctttctttttaaaaataacattaaaataagttaatgtttcatttcctatccttggcagatttttatttttcaatatgaattgttttgaaaaaaaagttaatgatacatgcactaaaaagggatacaaagatttcgttattatattttaatttaatgtgaatttttcattttttcaaattgatcaagcatagtttacaaaaaattccttgagctggttgtcggtccactagaataactttcctctgttgccgcacaggacagcaaggctttcactcctccaaagagtatatccttttccccctctcattttaaatagacttcaggtttacagcaatactgagcaaaagtacagagtttccaggtatcccctgccctcacaagctcataagcacccctgctatcaacatcctgcaccaaagtggtacattggttacaatcaatgaaactacattggcatatcattaaaatccaaagtttacattagggttaatcttggttttgtacattccatgagtttggaaaaagatgtataatgacatgtatctacccatatagtgtcatacagaatagtttcactgccctaaatatatgttgtgctttgtctattaatcccccccttcccataagccctggcaaccactgatctttttactgtctccttagttttgccttcttccagaaggtcagatatttggaaccatatagtatttagacctttcagattggcttctatcactcgataatatgcatttaagattctttcatgtattttcatggcttgatagttcattttttagtgctaagaaatatttcattgtctgggtgcaccagtttattcactcacctactgaaggacatcttgtttgcttccaaattttggcaattataaataaagctgctataaacatctgtgtgtaggtgttcttgtagacttaagttttcaacctctttgggtaaatacaaaggtagatgtttggtggatcatatgacaagagtatgtttagttttatcagaaagtgccaaactttcttccaaagtgctataaagttttgcaatcctatgcacaattaacgttctttttgctccatatcctcaccagcttttggtggtgttagtgttttgaattttggcctttctaatagttatgtagtggtatctcattcttttaatttgcattttctgagtggcatgtgatgtcgagcatcttctttggtgaggtgtctgttcagatcttttgtacattttaaaatcagtttgtttgttttcctattgttgaattttatgagttatttgtatatttcagataacagtcctttatcagattttcttccagtctgtggcttgtcttcttccagtctgttgcttgtcttctccctctcttgactatgtctttcatgatcagaagttttgaattataatgaagtctagcttatcaattctttcattcatggatcatgactttggtgttgtatctaaaaagtagtcatatccatgcccaagtcatgtagattttctcttattttatcttctaggacaaaagttgtatatattttttgtatttaacatttagtctaggattcattttcagttttctttttgaacaatgtaagttctgtgtctagactccttttttccacacgtgcatatccagctgttctgcaatgtttgttaaaactatcttttcttcattgtattgctgttgctcctttgtcaaagatcagttgactatatttatgtaggtctatttttgggctctctattctatcctactgatactcgtttgttctgttgccaatacatactgtcttgattaccacagctttatagtaagccttgaaattgagtagtgttagtcctatgactttattcttctcctttaatattgtgttggctatacttggtgcctttaaatttccttccacattttttgagggcactattctcaacattttcttcatgtaataggcttagtcatatatttgaagggtaactaacacttacagataactaacatttgttgagtacttattaaattctgggcaaaattcaattaatcataaattaaacagatatattatataattatcatcatattttagatgagaaaaccaaggcccagggaaatgtaagaaaattccccaaggcaacttaggtagtaaatagaggaatacgatagtctgcctcaaagggacataatgtggtatcacctcccagtacctacagcattaactaactttcagcaaggaaattcttcaaataaaccaggttatagaggtataaattctacttcaattgaatatttgctgattacgtactatataccagggacaattctaggtattccattttcaaaataatgatcactaagcattttctcttaatgagttcattgtgtagagtgtcatatagtgaacagacaagttaaaataaaatagtagctttctccaaagggtgccacactggaatcaacctagatggtcatcaactggagaatagaaagacaaattatggcttcatcatgcaatgggatattattcatcaataaaaacatagggtatgatgataacaaagttttgatatctctctcacagatcttacttgctaaatcttcatgtttacttcctattaaaacactatcatagctattctgattaatttagtagtgaaagaataatctttctttctaggcttcaaatcctttcccttgtatttaggttaaaaattcttactttgtggccacgtgcaccctaacaaagttactagtcccagaattttcccaaaataaaagtccttttattttctgggattattattcacaagattgacccttatctctgaaggctttaaagatttttattcttttggcatttctttccaatatactcatgtattacagattgttggctatggacaccagaaatattttgacctatttttaatcattaaaatcactatgaatattagcatgtctcaacctaatttttattttctttgctctgcatcctatccccaaagctatgaaaaggaatttactgctctatcacacaatgattatgcctaataattaagggaaaatgcaggaagatgtaattgtacttctcaattgcagtcaaacactgaattagccacaataactaaaaaagatagctcaaatgattaaatcttcagaggaaccctatatttatattaaataattcatttctcaaggaaaaaatagtttgtatatatttttgcaagaagagctaactatcctaaatatatatgcacccaatacaggaacacccagatttataaagcaagtccttagagacttacaaagagacttagactcccacacaataatagttggagactttaatacccccctgtcaatattagacagatcaacaagacatacaattaacaaggatattcaggattggactcagctctagaccaagcagacctaatagacatctacagaactctccacctaaaatcaacagaatatattcttctaagcaccacgtctcacttattctaaaactgaccacataattggaagtaaaacactcatcagcaaatgcaaaagaatggaaataataacaaacagtctctcagaccacagtgcaatcaaattagaactcaggattaagaaactcactcaaaactgtacaagtacatggaaactgaacaacctgctactgaatgacaactgggtaaataacgaaattaaggcagaaataagtaagttctttgaaatcaaagagaacagaaacacaatgtcccagaatctctgggacacagctaaggcagtgtttacaggaaaatttatagcactaaatgcccacagcagaaagctgtaaagagctaaaattgacaccctaacatcacaattaaaagagctagagaaggaagagcaaacaaattcaaaagctagcagaagacaagagataacaaagatcagagcagaactgaaggagatagagacaaggaaaccccttcaaaaaataaatgaatctaggagctagttttctttgaaaagatcaacaaaatagacagatcgctagccagacaaacaagaaaatagagaagaatcaaacagacacaataaaaaataataaagcagatatcaccactgatcccacagaaatacaaactcccattggagaatactataaacacctctatgtaaataagctagaaaatctagaagaaatggataaattcctggatacatacaccctcccaaaactaaaccgggaagaagttgaatccctgagtagaccaataacaagttctgaaattgaggcagtaattaatagcctaccaaccaaaaagacccaggatcagatggattcacagccaaattcttccagaggtacaaagaggagctggtaccattccttctgaaactattccaaacaatagaaaaagaggaaatcttccctaactcattttatgaggccagcatcatcctgataccaaagcctggcagagacacaacaaaaaaagaaaatttcaggccaatatccattataaacattgatgccaaaatcctcaataaaatactggcaaaccaaatctagcagcacatcaaaaagctaatccatcactatcaagttgccttcacacctgggatgcaaggctggttcaacatacgcaaatcaataaacgtaatccatcacataaacagaaccaatgacaaaaaccacatgattatctcaatagatggagaaaaggcctttgataaaatttaacaccctttcatgctaaaaactctcaataaactaggtattgatggaatgtatctcaaaataataagctgtttatgacaaacctgtaaccaatatcatactgaatgggcaaaaagtggaagcattccctttgaaaactgacacaagacaaggatgccctctctcaccactcctattcaacatagtgttggaagttctggccaggcaatcaggcaagagaaataaataaagggtattcaaataggaagagagaaagtcaaatcgtctatgtttgcagatgacatgattgtatatttagaaaaccccatcgtctcagcccaaaatctccttaagcgcataagcaacttcagcaaagtctcaggatacaaaatcaatgtgcaaaaatcacaagcattcctatacaccaataacagacaaacagagagccaaatcatgagtgaactcccatcacaattgctacaaagagaataaaatacctaggaatccaacttacaagggatgtgaaggacctcttcaaggagaactacaaaccactgctcaaggaaataagagaggacacaaacaaatggaaaaacattccatgttcatggttaggaagaatcaatgtcatgaaagtggccatactgccgaaagtaatttatagattcaatgctatccccgtcaagctaccaatgactttcttcacagaattagaaaaaaaaaaactactttaaatttcataaggaacaatatagccaagacaatcataaacaaaaagaacaaagctggaggcatcacactacctgacttcagactatactacaaggctacagtaaccaaagcagcgtggtactgctaccaaaagagatatatagaccactggaacagaacagaggcctcagaaataacgccacgcatctacaaccatctgatctttgacaaagctgacaaaaacaagcaatggggaaaggattccctatttaataaatgatgttgggaaaactggctagccattgcagaaaactgaaactgaaccacttccttacaccttatacaaaaattaactcaagatggattaaagacttagatgtaagacttaaaaccatgaaaaccctagaagaaaacctaggcaataccattcaggacataggcataggcaaagacttcatgactaaaacaccaaaagctactatataaactgtttaataggcactagagcagtgaaataatgacaaagcagagaaacatgcagcctgaataaatggctagtcagtacctcaaatttgaaaattacttgcattttaagggaagcaacagcaagtgtaagggatgcaatggaaagtcccttggaagacaatatccaacaagtaaagctcacttagccagcatctgcacatatggccaagcagtgtttttctagtcttcttttcgcatggggattggccaactagtaacatggactttttgtgctagaaagaagatgaatattctatgtaaataactgtgagtattttatataaatatatatgtagtctcactgaagaaacaaaaacttggaattcagtgttgttttcttgggtaaatcattaattttggaaagagtagatgtaaattttatctgcttttgcaaatgaattgctggtataaaattaataatttttgtatatgtttgcttttcacagaaacaaattttttgaagtatttcaagttaaaaattgagttagtttttcttttatgctactgttacttagtactgttgtttcttttccccgagataatgttcatttaaaattcttatgtttttcttttcctttttaaaaatagtaactcaaatacatgagaagatgtcaaggaatgctgcatattaaaaattcttagagttataaacatactatttgtgaaaattagattatttacagatgatctctataaattcttgagtttaggactcttgaaaattgaatgctagaaatttatatttattttattatctcctcttttatattatgtcattcttttatttgttgtttataaattaggaagtttaaatcatactgcttttatttgtaaatgttttactaaaattgctatcaattacatgagctactttataatgatgattttgcccattagaatatctgattgataatacttaagactagaaaaggtaataactattttcattcattgagtcctagaaggtaaaattgctatattgaccttagtttgaattctctattacaatttccataaaaacctttcagtatatgtttgatatatcaaaattttgactttcaaatattatttttaattaattggaaaatgcatgcaaactatcctgtttcaatctgactagtataattgagcaatataacagtgttcttgtctgtcaatatcttgccaaattacctccaaagcagatacagtggcctgtggagaataggagttaggaagaagttcaggacagtgatctactccataatggttatttctgcatcatttcttcctgtctgttttcctcatactggtgaaagtccagaatttaaaaagaagttgaatttgaaactcagaaaaagcatattccaagtagatcctataaggagaagagtcatggagaactgcatgtcagccttttaacgtaaagggcactttgattttatcgtaataaaaaagtatctctaagcatagtgtctctcatttgacaacttcatacaattgcattaaatttttatatgcatgtatattatcttaccaattggcaattagtgagaaaacgtaaagttaaataaggggtaactcgtttttagcctaacttttctttccttcaatcatttcagtgtgttaatataatacaacaaaactttaaataaacccatcattttgttgagcacagacttgctatcactaactcgatttacaaatttggttagtttttctatcaaattagctttaatgtaaagttttttcagtagtagctatgtttttcatagcaccctgaggtgtcacattagatgagttagttttttgagttcttgttctttgaagctttttatgtcaatagttgaccacaggaactagtctataaaatcgtcactgaattcagtgaatctgtcatttactcatcttgaatgacataaaaatgttgatatcctggagctggattgtactaactcatgagagctaacaggtaactttttggaaattttgcaatccatttatgaaacacagcaattaccaaaggttgaatgatataaacttattaagtaattaatattaaaagggaatatgtgctcaaaactcgtcatgaataattatttttatatagtgtagtattgtctatactcttgaggtggttcatctggtttatagtatcattatggtgaaaataccatataatggaggattattgtgattctcttttcaacttcacgttcagtgatttcccactggtagcttgaaagaagcaatgatagaagtatttatacaacatagaaattagcaaatgacataagtcaggacagatttatgattttgtccattgtcttagtagagctgaaagaagtttcaggttttttttttttttttttttttgagatggagttttgctcttttgcccaggctggagtgaagtggtgcaatcttggctcactgcaacctccactccctaggttcaagcaattctcctgcttcagcctcctgagtagctgggattacaggtgcgtgccaccacacctggctaatttttgtatctttagcagaaacagcctttccatgttggccaggctggtctcgaactgctgacctcaagtgatccacccgcctcggcctcccaaagtgctaggattacaggcttgagccaactctccaggccagaagtttcagtttaatgaataaaatttgtataagagtgagaaataatttaacagtaaatcacataccaaatcaattacaaaaaaatattgagaaaagtattcaaaagttgtatggagttttatttgccatatcatagttcaatcaaaaccataggttggctagatatacaagggttcagcaaaaatcaatgaaagtattctgtgagaattggtcacttatatgaagtttatagtaagagttattacatattttattatttataaattatatgttacacatcttttatatcagtactgtttataaccttatgtattatgtatgttttcaagagacagtcttaaatagttaccagcacactctcataatcaccactgtagtattggttgagccacttctgttttcactccgcactctactctacattgtggattgtttgaatttggattgcatgagctcctccacttggtttcttcccttcccttcgcttcccttcccttccctcccctcccttcccctccctcctcgttttattaatttttacatccttgaactcaaaatccaaaaccattagcaactatttattttaacagctttattgagctagaactcacattttttaaaggtttgtaatatttttattgtactgttatttttcctgaatatttttgattatcagttagttgaatctgtggatgtggaattcatagataccaagggccgactgtattgcatatttcttatttatttatttatttagactttaagtactagggtacatgtgcacaacgtgcaggtttgttacatatgtatacatgtgccatgttggtgtgctgcacccattaactcgtcatttacattagatttatctcctaaagctatccctccatcctccccccaccccacaacaggccccagtgtgtgatgttccccttcctgtgtccaagtgttctcattgttcaattcccatctatgagtgagaacatgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgatggacatttgggttggttccaattctttgctattgtgaatagtgccacaataaacatacatgtgcatatgtctttatagcagcatgatttataatcctttgggtatatccccagtaatgggatggctgggtcaaatggtatttctagttctagatccttgaggaatcgccacactgacttccacagtggttgaactagtttacagtcccgccaacagcttagaagtgttcctatttctccacatcctctccagcacctgttgtttcctgactttttaatgatcaccattctaactggtctgagatggtatctcattgtggttttgatttgcatttctctgatggccagtgatgatgagcattttttcatgtgtctgttggctgcaaaaatgtcttcttttgagaagtgtctgttcatgtcctttgcccactttttgttggggttgtttgttttttttgtaaatttgtttgagttctttgtagattctggatattagccctttgtcagatgagtagattgcaaaaaattttcccattctgtaggttgcctgtacactctgatggtagtttcttttgctgtgcagaagctctttagtttaattagatcccatttgtcaattctggcttttgttgccattgcttttggtgttttagacatgaagtccttgcccatgcctatgtcctgaatggtattgcctaggttttcttctaaggttttcatggttttaggtctaacatttaagtctttaatccatcttgaattaatttttgtataaggtgtaaggaaggcatccactttcagctttctacatatagctagccagttttcccagcaccatttattaaatagggaacctttccccatttcttgtttttgtcaggtttgtcaaagatcagatggttgtagatgtgtggtattatttatgagggctctgttctgttccattggtctatatctctgttttggtaccagtaccatgctgttttggttactgtagccttatagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcctcttttatttcgttaagcagtggtttgtagttctccttgaagaggtccttcacttcccttgtaagttggattcctaggtattttattctctttgaagcagttgtgaatgggagttcattcatgatttggctctctgtttgtctattattggtgtataagaatgcttgtgatttttgcacattgattttgtatcctgagattttgctgaagttgcttatgcgcttaaggagattttgggctgagacaatggggttttctagatatacagtcattgttagacaagcaaatgctgagagattttgtcaccatgaggcctgccctacaagagctcctgaaggaagcgctaaacatggaaaggaacaaccagtatcagccactgcaaaaacatgccaaattgtaaagaccactgatgctaggaagaaactgcatcaactagcgaccaatatacccagctaacatcataatgacaggatcaaattcacacataacaagattaacattaaatgtaaatgggctaaatgctccaattaaaagacacagactggcaaattggatacagagtcaagacccatcagtgtgctctattcaggagacccatctcatgtgcagagacacacataggctcaaaataaagggatggaggaagatctaccaagcaaatggaaaacaaaaaaaggcaggggttgcaatcctagtctctgataaaacagaccttaaaccaacaaagatcaaaagagacaaagaaggccattacataatggtaaagggatcaattcaacaagaagggctaactatcctaaatatatatgcacccaatacaggagcacccagattcataaagcaagtccttagagacatacaaagagactgagactcccacacaataatagttggagaatttaacaccccactgtcaacattagacagatcaacgggacagaatgttaacaaggatatccaggaatcgaactcagctctgcaccaagcagacctaatagacatctacagaactctctgccccaaatcaacagaatatacattcttctcagcaccacatcacacttattccaaaattgaccacatagttggaagtaaagcactcctcagcaaatgtaaaagaacagaaattatagcaaactgtctctcagaccacagtgcaatcaaactagaactcaggattaagaaactcacttaaaactgctcaactacatggaaaccgaacaacctgctcctgaatgactactgggtacataacaaaatgaaggcagaaataaagatgttcttggaaaccaatgagaacaaagacacaatataccagaatctctgggacacatttaaagcagtgtgtagagggaagtttatagcactaaatgcccacaagagaaagcaggaaagatctaaaattgacaccctaacatcacaattaaaagaactagagaagcaagagcaaacacattcaaaagctagcagaaggcaacaaataactaagatcagagcggaactgaaggatatagagacacaaaaaaaccctccaaaaaatcaatgaatccaggagctggttttttaaaaagatgaacaaaattgatagagcgctagcaagactaataaagaagaaaagagagaagaatcaaatagacgcaataaaaaatgataaaggggagatcaccactgatcccacagaaatacaaactaccatcagagaatactataaacacctctatgcaaataaactagaaaatctagaagaaatagataaattcctggacacatacaccctcccaagactaaaccaggaagaagttgaatctctgaatagaccaagaacaggctctgaaattgatgcaataattaatagcttaccaaccaaaaaaagtccaggaccagacagattcacagccgaattctactagaggtacaaggaggagctggtaccattccttctggaactattccaatcaatagaaaaagagggaatcctccctaactcattttatgagaccagcatcatcctgataccaaagcctggcagagacacaacaaaaaaggagaattttagaccaatatccctgataaacatcgatgcaaaaatcctcaataaaatactggcaattcaaatccagcagcacatcaaaaagcttatccaccataatcaagtgggcttcatccctgggatgcaaggctgcttcaacatatgcaaatcaataaatgtaatccagcatataaacagaaccaaagacaaaagccacatgtttatctcaatagatgcagaaaaggcctttgataaaattcaacagcccttcatgctaaaaactctcaataaattaggtattgatgggacatatctcaaaataataagagctatttatgacaaacccacagccaatatgatactgaatgggcaaaaactggaagtattccctttgaaaactggcacaagacagggatgccctctctcaccactcctattcaacatagtcttggaagttctggccagggcaatcaggcaggagaaagaaataaagggtattcaattaggaaaagaggaagtcaaattgtccctgtttgcagaactcacatattataaaagtaatcatataaagtgtataattcaatatttttagtgtgttcagaacgttgtagaaccaccatcctctaattttggaacattttgtccctcctaaaagatactttgtggctattaacagccagtccttatttttttctcctccccagttctaaataagcaataaactactgtcattatttttatttttatttttttgaggtagtttctcaccctgttgctaaggctgaaatgcagggacacaatcacgactcactgcagcttcaaccttatgggctcaagtgatcctacaacctcagcctcctgagcatctgggactacaggcatgtgtcaccatgcccagccaatttatttatattttttatagtgatgagggtctcactatgtctaaaactcttgggctcaagagatccaccttctgcagcctcccaaagcactgggattacaggcatgagccaccacatctggccctatttctatctatatacatttgcctattttctacatttcatatgaattgaatcatacaatatgtggtcttttatgtctggcctctttcatgaaacttaatgtcttcaaggtttatccatggatgaatcagtacttatttctctttatggtagaaagatattcctttgtatggttatgccacattttgcttatacatttttcagttcatggacatttgagttcccactttttggatattacacatatgctactattaatattcatgtataatatattttgggtgaacttattccttttgaatgtgtgtatgtgtgcgtgcgtgtgtgtgtgtgtgtgtgtgtgtgtgtgtatttcgtatatacatgattttggcttaccaagtcgtctggtaagtctatgtttaactttttgttactgccagtctgttttcaaagcaactgcattattttgcattcccaccagcaatgtatgaggattccagtttttccagatccttgccaatacttgttatttaatatagcaatcctagtgcatgtgaagtagtgtttcattgttattttgatttgcatttatctaatcacgaattatattaagcattttttcttgtgcttgtttgtcatttaaacatctttttggagaaatgtctgttcaaattctttaacagtttttaaattgggttatttgactttctattactgagttgtgttttcatatattatggatgtaagtcctttattaggtatatgatttccaaatattttctcccatttgtatgagatgtcatttcactttctggtggtattatttgcatcataaacattttaaatatttttgtagttcaatttataatttttccttttgttgcttttaattttgacagttatgaggactttgcgttacccaaggttacaaacatttacttctgtgtaaccttgtacaaattttgagttttagctcttacatttacattgatcatttaatttaatttttatgtatgggttgaggtagggacctgactattccttttcatttgggtatatagttgtcctggcattatttgttaaattcttttcctactgcattgttttgacatgtcttttgaagatgaactgaataaatggaaggctttatttctgaagtctcaattttattccactgatctatatgtcaattcacatgccaataccacactatctaataaagactttagtgtagtaagctttgaaattaagaagtgtatgaactccgaatttcttttttttaaaggctattttggctaatctcgtttccttgaatttacatataaattttaaggccaacttgtcaattttcatgaaaagctatttggaattttggtagtgatttcaatgatcctgcaaaataaggtttatattgtcttctagtctataaacgtaaggtgtatttcagtttatttagctcatattaaatattttcagcaatgttttataatgttcagtgtataagtcttacaccttttttaacattatatctaaattattcctaagtattttagtgttttgaaacccttataaaagaaattatttttcccccttcattttcagattgttcattgctaataaaaactacaattgatttttaatattgactggaactcatttattagttctaacagttttttaatggattccttagaattttctatatatgagatcatgtcattcgtgacacacaaagcatctacaaagatatttttacttcttcctttccaatttggtgtattttctgtcttttccctgattaattttcctggctagattcaccagtatgatgttaaatagatgtggctagagcacacattcttgtttggcttttatttttaggaggaaagcattcagtctctcacaattaaataagatgttagttgtgggaggtttttgtagatgtccctcatgaagttgaggaaattcctttctattcctaatttacttagaatttttgtcagggaagtatgttggcttttgtcaaatgagttttttcctggatctatggaaataataatatgcttgtgtcctttattgtattaatatgatatattaaattaattcatttcattgtattaaactaaccttgcattcctgggataatcctacttgactgtggtatataataacttgtaaatgtggttggatttggtttgctagtactttattgaggatttttgtatctatattcataaaatatattgttttgtatatcttttttatcctgtgatatatttgatttttgtatcaagataatgctggcctcattggataatttgggaagtgttttgtcacctattgctttaaaagagtttgtgatgaattccattgattctttgaatgtttggttcagtgaggctgtctgggcctgggctgcttctgtgtgtgaaaagcttttttttttttttgagatggagtctcactctgtcgcccaggctggagtgcagtggtgtgatcttggctcactgcaagctctggcctcccaggttcatgccattctcctgcctcagcctcccaagtagcgggcactacaggcgcccaccgccacacctggctaattttttgtatttttagtagagacagggtttcactgtattagcgaggatgatctcgatcttctgacctcgtgatccacccgtctcagcctccaaagagcagggattacaggcacgagccaccgcaccccgctgtgaatagcttttttaattactaattttgtctttatacttgtgataggcctataaattttttgtcagccattatcaataatttaagtctttctaggaattgttaattttatattattaattctaatttgttgacatacacttgtttatgggtttttgtgattcttttatttttgtaaggtcaataatgatccttcttttattcctaattttagtaatttgagtcttccctcctctttttacatttttatataagtagagcttaaactttgtcatttaaaaagttgttttcacatattgccttttagttttgctgattttgtccattgttttctactctccatttcatttgtttcacatcaagtttttacatattctctcccttctgctcgattttagtttactctttttctggttactaaggtgaaaagataagtctgatttgaaatttttcttattttttaatacaggcatttagcactggtttgggcatgttgtgtctttgttttcattcatctcaaagtatttctagttttcctttggattcgtctgaccaattagttttcagaagtatgttaatttctttatatttgtagttttcccaaatatccttgtgtcattaatttctaatttaattccattttggtcataaaacatgtaaaatatattttcaatcccttaaatttattgaggcttgttttatgatagcatgaggtctctcatgaaaaatgtgttactgttttgtagagtgttctatgtatgtctattagtttttttttaaattttaagtattgttcaagtcttgtatttctttatatatcttctgcctaattgttctactttggaaggtgagcttttacgtttccagctattattgttgaattgtctatttctccctttaattctgtttttgcttcatcaatgtgtgtgtgtgtgtgtgtgtgtgtgtgtgtgtgtgtgtgtgtgtgtgtcacttggagtctcttattgggtccatatatgttgatcgttgttttgtctgtctggtgagttgaactttttattactatgaaatgagtctcttttttaattatatttttaaattatattttagtggttgctcttgagcatacaatatacattcaaaattatcagaatctacttcagatatatagtatgttggttacaaccaagtaaagaaattttaattttatatagctatatttttcccacttttttgttctgtgactgatatatattttgttctatggctgataagtcataaaactgacacacacatgtaaaacatctatatatgttaaaatacaacaatatattgttataactattgctgtttataatcttatgtgttttaaagaagctgagggaagaaagtagaaaagtatatatatattttgaggcgaagtctcactctgtggctcgggctggagtgcagtggcgtgatctcagctcattgcaacctacacctcccaggttcaagcgattctcctgcctcagcctcctgagtagctgggactacaggtgcatgccaccacgcccagctaacttttgtattttttagtagagaaggggtttcaccatattggccaggcgggtcttgaactcctgacctcatgatctgccttccttagcctcccaaagagctcgaattacaggcctgagccactgagcccggccaactttcttatttgacctttttggttctctttctttctatgtgtggatctgcatcaccataaggtatcatttccttactccaaactccaatacacctttgtttctgccccttttctctgttattgtcaagtgtgttacatttctctatgttattattccaataaatcaattacctattgttttatccagttgcctttgaagtcattcaagaacaaatatgcaattatactgtctttaacattaatatattacattacattatattaatttgtattatattatattatttttacctttactggtgttctggatattttcatgtgaatttgaattactgtctgatgtcatttaccttcagcccaaataacttcctttagcattattatcatatgttatgtctactagcattgaattctctcagttttgttcatctgggatagtgtatttcactttttttttttttttttttgagacggagttttgctcttgttgcccaagctggagtgcaatggtgtgatcttggctcactgcaacctccacctcccaggttcaagctattctcctgcctcagcctcccaagtagctgggattacaggcacgcaccaccacacccagctaattttgtatttttagtagagatggagtttctctatgttggtcaggctggtctcgaactcctgacctcaggtgatccacccccctctgcctcctcccaaattgctgagattacaggtgtgagtcactgcatctggccttcaccttaatttttgaaagataggtttctctggctataagattccttgttgacagttttttacatttagcaatttgaatatttcatcccattgcattctgacctcctttgtttcttttgcgaagttaattgtaattggggttaacttatatgtgatgtgtcttttatctcctggtgctttcaagacttttgtctttgcctttggttttaatttctactgtactgtgtctatttactttttttttttttttgcgtttttgaaactttgggtttgttgagctctaagctcattaaatatatttcttccagtttctgaatgacttaattataccttactgtctaactcatgatatttggctgatttatatggtagacctaacctctgaaggcatttttgatttttacttatagagtacaggtgtattgtgcttaaatcatagttgagagtaaacaggtccacataacaagaagataatagacaattttcctccacaaatatgtgattttaatattatcctgacaaacactgaacttccaatttcttgagacaatgttgactgttaagaaatgcttgtgaaacttttcaaatgtatgctcctatggcacaatttgtatctcctgtgctctaactcatacccattggtagttggttgaataatggccaccctaagataccaagtcctaattcttgaaacttgtaaacattatcttgtttggtataaggacctttgtagatattattaagcatcttgagaagattactttggattatctgattaggctctaaatctcatcataagggtcctcaccagagagaaaaacgcagaggagagatgcacagaagagacaatggtaatataatgcagcctcaagctgtgaaatgctgtaaagcaccagaagctggaagaggcaaagaatgggttctctcctagagcttccagaaagagtatagctctgtggacattttgattttggacttctggcctccaggattatgagaaaataaagtactctttttgaaaaccactcattttgtagtaagttgttagagaatccataagaaattaatatactaccctagcaaccatttctttaatacctattttctgcattaaactgtaagcttcacaaatgcctcaattatctgtcttacacatcttgctaactccagctactagcagagggtttagtagtatctgggccttgttgaatacttattgataaaatgagtaaataggctgtgatccccacatcactcacagttgagtatttagctagataaatgagtgaacatgtgaatgaattaaaggacaaatatatatttattcccataaacaataaatacagactaagtgtaaaagattatcatattttttgtttttccagcaaaggaaccctctcagttcctttgctggagactgtacaaatttcatggctgggaacaaagaagacaaagttttatgggtggttttactagtgggtacagttagaatttgagttttcagcctaggaaaggtggttattctctcaggtataggggataggtcaggaggaggcatatgaaattgtgtttttagctctttgacctaacatgtgatttcctatatatagttgtctgaatatgttgcttcagccaccactactcacaaggcttaccatgtcagaaaaataaatgaataaataacaaaaaactaacagaaagcaccaggtgacttacttttgtttttgcagtgagctcagtctgctggggttactgttcaaataaactcttgccatctcactgcataatgattttgctcagattaatcactctcttgtgctgtatgctggggttaatggctatgttatgttacttcaaattatatcacagggtccaaataagaagtgtgtgtgtgtgtgtgtgtgtgtgtgtgtcggtgtatgtgtgtgtgtgtatgtgtatgtgtgtgtttgcaagcaggaagccctttcatgttgcagtcatgtaagattaactttattatctcattccaaacttatttcttactcctctctattatccatgaaaactctttgttctttgctgtacttcccagcaaaatggcttttgcctggctccaactccaacctgtgttaaattatatttcttcctggaatctacttcaacagaaggtgatattttctcttaattcttatagtactttgcatatttttatcatggtcctgaaaatgacaagagccaccatttactgagggttcattatgtggtaaacattggattacatcctttaaatatgtcatttcatttaattcttacaacagttttgtgtagtgggctctttattttataggagagaaaaactgaaatttagagaagtttaagtgatttgcacaaaatatgctgcttccaagtagaagatctaaatttcacatagataatttctagagctcatgtttttaacctttaccacatattgttctttagaccaatactgatagaataataaatgtgttttctttcctaggttatgcaataacctaggataactctgtatcatttttttcatttctcgaattacagtttccagggcccagcaactcaatattgtttggatgaattaataaatatctagaatttaattattacaataaaaaattactgggcctcaaaatatattttaaaataatttaagaaaatcgtactgatggcaacaaataagtcattataaaaacttaaaagatggaattgatgggtaagcatgatttattcaatattaactatgccaaatgtcttctctcatgtttttccaagttctgtatgtaagtaatgcataaaatattgaaatattcattcatgaatttttgacgtttcctatatagatgattttgttgaggttataaaaacattttgttttaaacaatttgtgtattaaatgcaaattagtttattaatcttatgggtttttgttgttgttgttttgtttccaggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcagtaagttaaaaaagaaaaaaaaaagagcatgcatttcgagacttgatattatgtatccttgtttaaatgggttcgataattataaatattctatcttcaacataaattaggccatatgatggtcatgcccaacatttaaactataattattttggttgtatgttcactagtctattcatataatttaaaactgtctctagaattttcatattgttgcctttaaaaatgtataatatgtggtagtcccaatcaaatgtccacaaatggggacatatattatatattatattatgaatattatatattcaatgagtcatagcatatgaattatggactggaacataagaacttttatactaccactactgtcaacaattattttccatcaaatcatattaatatgtttaggtattttctagttcatagtaataataaagtcatgaggaatattttatgtacttttcttatgtctccttatattcaatgtatttatcctgaagggtatgtatttcttaattttccaggatagaatattaaaagatatgtgttattgtaatagatctaatgcccttgaaagtttaaaaatggaagtatatgatgtttttgtcataaattttgtaaaaagcagatttaattaactgctagatatcgaaatatatagtgtcaaaatggagtaatatattaatctaaagtttctaattatacctacagtttgatctagacactttaatctagctttttatttaattaaaacctttataaaatcatattactatagatatttcatcctgtctaggaaaattgaacagtaaattattcttctcctatatgagcaaaatgtgcatccgaattactttgtcagcaatgagaataatatcctttttgagaattcttattgaattttgcttttggctacctttatattaactgttttcagctatattgatatacaatatcagtctggatccatttttttttcagatacagaaaaatgtgtgaaatgctcaaagtttcaaatacaggtacctatgtttgaaaattagctactgagcataagaaatagcttctttttcataactattttttgctatatttccagggtcatattgaatctttgtagttgcataataacccctaatacatgttgtatttatccctcctcctctatggttttgtttcttggctgtttccaaattgcatggtttgtgggcaggcactattgtaagtttccttacataaatctgccacataaactttcttttgacttacacattccaggagacattcttttcatgactaatgataatggcctagcttcttgggatatttttatatagactaacattactgaacatactcattttgcctgtctcctaagccagggctattcctctggacagtaataggaaaaaataaatgtatattgatctactaatatcactaactgtgtaatcttataataatacattttcatgaaatagctacctgaactcgacaggactttgtaaaaggactttgctagggatgcataatttcaattgtattaaatgaataaaaacaaaaaccaaaataacaagcaaaaatcaagtggtttcgttgtcaatagtagtgtggcagccaaatctgtttaggtgccaaaagcaatttaaaataatttaatctttgaaatgcatttattatagacctttaatcaaaatgcaaaatgagtcaatgatttaaatccaaatctcttgccctgtgttttcttaaatgaaatgtagagaatctgatccattgccattatgcatgctaaacacttgtaataaattgataaacatgtttccagtgtacacaattttgaattaacattaggaagacattttctgcattttggggtagagatataacctttgaaagtatgtccagaatctgaaaccttatctaatccctcttgagaatgtcctatttgaatattctctcttttcccaagttttttctttgcacatctaaagtgttgtcaccttttcctgataccatgaaggttctttttggcctaaactttttccctctgatctctctcagttgaattctaattgggaaacatttcctttttatgcagtaataattcattataggaaagaaacaaaatatagaactgcttgcaatgccagtgaaactgtgcatgtgactctacaatgaatttaagtctaatgttaaaatttgatgtaagtgttcaattaatgaggcataaaactaaaatgtgatttgaaatagaacggtttagtgctattaaggccatagactgttgggccagactttaattcttaatactaatgctgaatttggctagtcataggtaggattagctagataactattgcaattataatggttcccattaagtttaagatttcttctaattcttaaacattagcttatagagcatgcatgatgattatgtttattgaccttctttttctcctttttcctacatggccaagaaaccatacttatataactaatcattaaagtgtatcatactgtcttaacaatattatcaatagatctagtggtcattttatttactttgcctttttgcaaatctttctatgttttcactctgcaggaaatggtggtcctttaatgttggattaacttttgaatgcatttgttttttctatctgcagtatatcattccttgaaatatctaggcatttataaagcttaaactttattgtaatctgatttgactttagataaaattggagggtatatatattatttcttatgagctcttgaaaatcccacacaaaatgacacattttaggaatatgtaaaggcaatcataatttttttttcaatcattattgaattatagtgactcttaggtctctttattgcatttgtatctgtgtatatattaactgttactggtacattgaatgtgtttcagtatatttgtctgtagtctactcttggttatctacatgaacaaaacggagaagaggtgtagacatctcaatatcactcatgtttgaacttaaaatatatccttttactaaaaaatataatctgaatgcagatgtggttagcaatttggaaagtcacttcaaaattaatgatgtggcattataaaaataacttgggaccctgttttgtcttccagtgtttaacttttctcaaattctgccaaaacttcactttctgtgaatacatcactgttttctggttttcttttatcaattgtattatatcacagggtaagcgagttcagacacatttcttaaattagggactaatcaaagggttaagtttcaaagctctttcttgctacatgtaaaataagactaactggtagaaatccaggaactaagagggaaagtcagtgttatcaatagagaaaacagtctgcatatatctatgtataaacacatacacacatacaactcatagtgtgatattgtaaacttatatgtattactcatatatataactgccaataattacattcaagtcaggagtggagaacatatgctatagctaaaaggaaataggctggaagccagactaacgcagtttcaaatttcaaatctaacactcatttcgtatctgtgccacttttggcaaattatttactctttttctttatatggtggataatgatatacattgtgtgctaaaatgaatgagttactatgtgcaaagtgctcggcatatagtaaacttgtgattggtgttacttctctccttctttgtccaatcactactcatgtttcacgtagaaggacaggcagcaaaattagcatagctctatcatttaccctagttacaattatggatctaatttcctaggcccgctctaatgcctctgtgttggtagacaggaatagtaataacttctcatgcaggcatttttttttttttggtgcatcctgtagatgtcactatccctggaagtccacggtttgggtttataagaaagcatgaggaaaggccagagttcttgtgtttaggagctctcctgccaaatgaaactcgtgagagtttcagttatttcatttgcttttcccaaagattaaatctgttaaactaatttcaaattaattttctggaaaaaaataaaattgtctctttttttaaaaaaatgcttttaatatgaatggaatattcctttccagagatatgctgtagaatagtaacatattcatgtagaatctctacagccttactccgaacattaataaagaaaatatttatactatcatatctaggacacttaaccttaaaaccctagttagcattattttttgcctagttctttttataaatatctattggttcactgtctctattgctaaatagaatattctaacttgcaccagtttctgctagtttgtcatgtaaaaattcccagaatttttgtcaacttataatgggactaattaaccaaatttgcagccatatggtgtggaaaagtagcactaaagtcaaactcaagaattctgaacaattcatgtagcctctttgtgcataggccacaattcactcacatatatgatataattctgtagtctaagacagagtttgtagagtttgcagatcttaacagtattgaaataggggtttatctacatacctttttgattcatgccaggaagtctttggtctcaagcacattttccttctgtgtcatagtgcctcaagttttacaattagaactcaatctatttgggttaaaccattgacccctgtatttttatataaaattcaaatatcattaggcaagagaaggtggagaatcaattaagctgccagcagtcattgataccttatatgatcatttaacatacttgtttctgtctctcatctctagctaaatttaacttaagtcaggagtgagatagaaagaaaatgtgagttattggcatagagcaatctattgacctcccagttagcataggacctgtctgatttttttttttttttgagacagttttgctcttattgcccacactggagtgaaatggcatgatctcagctcactgcaacctccacctcccgagttcaagtgattctcctgcctcagcctcccaaattgctggaattacaggcattcaccactatggctggttaatttttttgtattttaagtagagatggggtttcaccatgttggtcaggctggtctcaaactcctgacgtcaggtgatccgcctgccttggcctcccaaagtgctgggattacaagcatgagccatcgcatcaagccttgattcttatatgagtcctaatgtggcatcacacctaatagcgtttggtatgtgtttgacagttagaagttaagaagcatgtcatcaagatgaggaagaagtctcagcaaactccacagaaaaatctttattttcaaaaaaaggggaactatgtctattcaaaatatttaaaaatgttggagtatattttgaaataaatgaatatcattaaatgaaaaactgagaattacatacatttcttagaaaaaaatactctctaggcacaattcactcatagaatataaaaatactgtgtgtttgagtctctttcacttctttttactattatgaatttttccctttcttgccacggatcttagtgcaagtatagattgtctttgaagcagaggggctaagaaaatctctatcaggcttagaacttaatttcatttctgtagccaaatgctttaatgtagaaagaaaattaaggcaaaataacacaacagacaaatataggttcctgcctttttaatacagatgcattgttttttccccattttattattacaaactagagtaccttaaataagctgctgttctggatgtctaacagagatagaaaaactttaaatgaactattccaagttcaaatttttggtaaactttgtccagtattgaactcattaataatttacactgttacacaataaatttgtgatctagaattgtattttatagctagtttaccttagagagtttatcagtataaaatagcactcaaatgtagatattttacagataattttgttaggttattttgctttatgtctctctatataaatataaaatatctagatatatctatagctatctatagataaatagatctatgtctttctatatctatatagacatatatgtatccatctatctctctatatatacatatatatctattagatatatagatacatatctatatatacatatgtaggtatatctctctgtatctatatagatataaatatagaaagatgtagatctatctctctatatatattctcatatatatatagagaaccatatatatatatatatatatatatatatggttatcacatatataatgatatctcatttgaggtagaatataaacacattacttttcacattggtttatttatcagttacacacatacacacacaccccatatccacacaaacatatataggttttacacaagtgatttctaaatattagctacagctactgaatattattcagattattgtcagatgtgtacaacatctcagaaggaaacagttaaaaataattcagcatgataattaaatttattaactagcaatcctaaaacaaaagaatagcttactgccattcattaaaattgaattatatatctcatataggtgtagttgctcaccgcagtggccagagtaatactgcaaatctgttaagattcagaagctgtcttcttggtagtggagacaaaaaaaaaaaaaagacgtaagagcttatccaaagaagtttatcatcagctagtgtcacacaccacatcatcaataatttttatattaaattataatatcccagtgaatattctttgaaatataatttaccttttggagaaacttcattagttgtttatgacagcctagtaaattactactttagtgctccctagtggtgaaaaggagccaatgcggctttaaaaagtagctggttaatgcctcctagtgggtgattctcactcagatcgagaggtttgttttccttgctactctgatagtgtaaaaaaaaataaaatgaccaaatttcttaaagtgcctgcatgtatgcacctgtataaataactatataggtaatgaatttgcaatgagtataatagcaaggagatgtaagacatgggagactggcatgagattgtggagacagaatggtccagcattgatgccaactagacttgagtttaaatcttgatagtgtaagttctacatgtgtgatgttggcatgttattattttgtagggttgtttttagggccataaataatataggtaaagttttaacataataattgcttcaaacactatagatattataataatgtgactagaaagatggtttttttcttttaatatggagttgtttttggggtaacagatgttctaaattgcttttttccccctcttaatcaggtaatgaaaagcttacttctttttttgtgtctactattctccttagtgacctatggataacacccacccatgtcttcatttatgattttctcataaatttgagaatattattaactagctttatgagcagcagacttagttgtcttatgataagtaaagaaccagcttttacctatttttatccatctatctcttctgctccccatttccccctccaccctcattttcctgggaatgtcctctcagagtgaacactttcctcagctgaatttagttctttggttacgggtgaattctgaaagaaactgagtcagtaacctagttgctcttctgagaatttggaatttggaacaggaaatttctatctttctgtgctttttcttatcaatagataatacatagacgtgatatatttggtcagatatattcattagtgtctaattatttacatagtctaaagtgttatctctcaattgggctatataggccttaggggcagacaggtggcattgtcccaagtactccaggccttttgatatcccataatatgttaactttcagcaccaccaaaccccagatactgtaataaccaaaatgccttcttgttctctatttgcaaaagtcacctagtgagaacagtaaacactcccagttgagagacattttataaaggaaaccacatagccagttctctccttggtacctttgaaaaatgtgtttcttatttgccagttgtttagcaattcaataattcagacaactgattctgcaaccatagtgcactgtcgtcatctcacagactctgcactttgcctcttgcataaatacatgaacgatatgcaaattactggagtccctaacagaatgaagtgaaatcttcgccgtctttctctgtctccctaagatggctaattattgcctgctttgagtggctacagcaactgtattcttggatatgtgttcaaaaagaaatgcttgctccccacagaccagcagtgtgtaagaaaggtaaactttaacaaggggagttgcaacagaagtctaggaggttttgaacatgccaatgaactctagaccagaaaagtggcattctttgtggttctcccctagggcccaagggaaatataaatgtatcatattacacatactcttcaggaaaaatcaagacaggaagaggttttccacactcccatgtaagtacttgtgtcttttaatgtaattcttcatgtcacaagtaattctataaacaatgactttgctgagttatcttatttaatgcaatatttaggaattctctttattttatgaatagtgaacatgtatgaaaaagatctttttcattgcccatctacttattttttcatctaatataagaattctctgttatgacaatcttttccttagcagccaaatattcaatcataagaaataacagctgaatgtggtggcacatgcctgtgatctcagtgctttgaaaattaattataatttaacataaaccactttctattttctgcttgattaacttcagtctactaatgtatactgatatagtaccaaattcatctgatggtgccctagaatgctgctacctgtatatgttttcctcctctagtttctttatatcatatggtgaaatgctttgccttcttttaagctgtttttgcctctggtctagcacttgtaccatttccctatctttggagaatactgacttcctacctctgtagcacattcacttttcatttcttttactctgtgttgaatgcatttgcctcaaatctccaaattgtttttatccgtctgaaaaactgacttgaactatctaaaaatactcctgcctgctttataccttcttcagatttgcctacttttattgtaaatttgaccacatactcatcaaattctcagcaccacaaaataactttggatggacagagtgcattcctctgctttagaacagtgtttttttattagatgtcataatccatttatgactcatcaagttaatttagtgggctgtgatcacttttaaaaatgaaatagagaagagaatagaaatgatcagtttgattttatgagtgtgtatatgtgctagcttatgatgtaaaatgtatgtatacctgtgctgtcgatatagaatgttggaaagccttgctttaaataggcactatgatttcaagctgcctgcagactctccaataattgcttccacctaccctatcacttctgcttttggtatatccttagattttcctgacataacaattttttccaaagttaaaattaccttcagactcaagccaatattttcattcatattagataaatatagtctttaaggctgctagatttaacacacacaggataaccagttatatttgaatttcagataaacaatagtttgtaatacgtttggctccaatattgtatgtttatctagaattcaaactgaactaggtgtcttatattttatctagcaaacttaatcctatttaaaaatcaggccgggcgcggtggcttaagcctgtaatcccagcactttgggaggccgaggcgggtggatcacgaggtcaggagatccagaccatcctggctaacactgtgaaaccccgtctctactaaaagtacaaaaaaattagccaggcgtggtggcgggcgcctgtagtcctagctactggggaggctgaggcaggagaatggcgtgaacccaggaagtggagctggcagtgagccgagatcgcgccactgcactccagcgtgggcgacagagcgagactccttttcaaaaaaataaaaataaaaaaaataacccagatactcctgactgggctagatcacccatctcaactaggtaaaaaagggaagggtagatgaacgggtgggaagactgagggagaacatgatcagagaagaagggagaaaaagaaaatgtgggcagtgcttttctacaaatggtgcattggagtaatgctaatattgcctgagtcatggcaaaacaagcagtactgcaggattgataggaactcaaagaaaacataagaatcctccaccagggagtatggggatttgggggtgattgtgcaaatctggcagtttcctggttttgctattggaaacatcatttaggcacaggaattcttctggtctttaacaggcattcaaaggtcagatagatactctatctatagatagataagtagttaggattccgaagcaaaaatttttgagagatacagtgattacaaatttgtttaggcaggccagtatgtctgtcttttgtctaactgattgttgctagacaagaactttttatctgagagttttctttttgagtcctgattaaagcctttttcagagttgctttgaaactaatcaaataactaccaatagataattccaataatttgatatatccaggcacattaatgctgtagaaccatattgagtagtattcaggggtaattatggtgcctatgcattcaatagatatttgctgaataaataaatatgtagttgaaaatgtctttatctttgcaagactgtttccttacacatctctgcaaattaattatttcctctgcagtagtacaatgatgtacactgctaatcctttttcatggacaaatgggttaaaatatattttaatagaaaagaaaattattgtctgagcatttcaattttataacacatctagaaaactatcaaagtcatagctaatgtaagttatcacattatattccacttgggctcaaatgtgacagtgattgcataccttgtaaagtcctaaatgcaaagatattcaatatataaaacagaaaaagacagatgttccttgaattgaagatatgcatagagcctagatttattttcctcagatagaggccgctctggagtttggtgttctatatgtttatgaatcaggacacacaggcttttaataacatttggatttataggctctgttcaatttaatttcaattttatgttttacaaataaattttctatatcttaatttagttacatatattgcagagggtttgtgatacaaattttctcaaatctagtaagataaaaaaatttcactaggagattatttctaatttattctttatccatgatctgcaggatattgataagagaaaatgtcagaagtttggccttaagggcaaattcttttaggtacatacagtttgatatttgccaaaaactatggtgtccatataattattctagttaaataaagccattattgctattctctaaattcattttaaaaacaaaaggtggagaaaggtgattttaaaaatttgtgtgattatattaattattgtttgctctaaagttcagtatctgaaaaggagcacaatataccaaagcaccaagttacattttcaaactactgatatttaggaacactcatcatttttttattacactagtgaatttaggttaaaattgtataattttggttgataaatcttttgattagcttatttttgtttgcttgctttataaagtgattgttactactcatgatttgccaacgttatgtgatggctttatttcagctcgcacattagcttcaaatcttagaccaagaatggcttctctgctggcgaatttcttacaattagatgtcttgttcctttaggaagaggcagttatttacattcctctcctaaattctattaaaaatggaagtccaacgcatttactgactggctgctaaaatattacagcattgtcacaaagccatcattttagtcctcagttttgctggaatggaacagatggcctgttaattttttccaggcggagctctgtgttgttactccatagtctgacttgttcttgagaaactttgtaacctgagacaaggtacagagtgcttgactgacccttgtattcagaaaggtcaccccaaactagttagagcattttacacttataaagaacttcacaccagggagcattataaacattttagaataattaacctatgctgtgaggttaatatcccagctctttatggatgaaacagtctctatcttttttcaatactgataactaggagtggctgtaaaacagtggttaaagtgataggctttgaaaccacaatagcaggtgagtcctgtctcttgtacataattggcaaaatacacaacctctctgaagcttagctccctcatctgttacacagagatcatgatagtgatcatggtaatctattcgtgggactgttgtgaggattaaatgatgaaactcatgtaaagttctgattcagcataatccatttactaagtactcaattaatggaaaacaatcagacatagattgcttggtgacattttcgtccatgtaatgcagccaaaactagtaattgtcatgtaattaacgagaatcttaattttgaggattgcaaattctctaccatttcaggaaccagaggtttgcaggtttatatataatacaaactgaatagttagaaaccctttttattgaataacttagaaatgaaacattgttgcaattagagaggaaggatacttgggactgagaaaagaagacatggtcaaattctccatgttttaaaattattttccgttatttttttctcttaatttgcactattttatggcttgagttaaggagataaacttacgttacatacttatgatacacagtctgaaaaaatagagcaaaacaacaatttgttattaaatttttttgattaattaacttcttcaatttttctaactttatgttacttcagatccaagttggaaaggtcatttatttctgaagactctgatactaaaaaagaaaatgtgaaaaaactttagtattatatattattgaatttacaagatgagttttgcaaattagattgcttgtgattgcttttaaaatttcagatttttggataacttataagtttaccttaactgcattgtgttaaaggcgaaggctagtaatactcaggaatggccagtatttggctttatagttgtagggcttcttaaagtaccatttttttcttccgaaaagcagaacattggcaagtagacaagtatatttgtccgtgggattttcagtaaggtattcccaagagtttgcttgtttttttttataacccacagatggaagataggaaaccatgccctttatagaacttgatcattgagctttctgcaggtggataagtttgtcactggatcactaatgttgtgctgttattgctccagaggctgattttattgttcagtccatcaaaagaggctgtggttaaattacttttatatggaagtattgctatactttttggatggtagaggtcatttctacttctaatttatggaaataatttaatctattattttctgttttactgatgaattccagtcctaaaggacttagactgtaatatttacactgaaaacactatccatgtttcccaatactcaaatgaattaaggcctttacaagtggtaagttatgaaaaatgtaccttgtgccaaattcccccactccacaaccgtagataattctgaaatggcctcattgtctggggtgacactgaaattctttgtctcactgccaaggaaatcaagaacgtggacacaccaagggtgagattagagcagaaatttaataagcaaagtaaagagaacagctctctgctgcagagagaagtccccgaaaaagggttaccgttcttcagggaaatgcaagggtttttataagcaagttactggggagggagtatttcatctacatagggcgtaaaaaacctattaggactaggtgtgtcatttgcatagggtgtgacactctggcagtccccaccccaaccttttattgcccaggcaggtctttagcctaagttattccatgttgcttatcttttccccactgtgcatgtgctaagggggaggggggtgggcaaaaatttaaaaattagttgtgcatggtagattgtgtctgtagtccagctagtcaaggaggctgaggcaggaggcttgcttgagcccatgactttgaggttgcagggagctattattatgctactccactccagcttgggtgacgtgcctggccatggtggatgtgactggcccaaggtagttctttcgattggtgcagctgcatgcaccaccttcatgcaagcttccagcttccttactggtgtatgtccaaaaaaggaaaggaatgtgctcactagggcccacagtgcttactgggacccactgtatgcatgtgaaacttgctaattacacaggagactccatctttgtgctcgaacttgcttccttatctatgtctgcagcctgatcttccaggctgctctttgttagagcagaaattctgccgaggactctttgccctattttcctagctagtttcttccttccttctctctcaattcaaggttaaaaaataataacaataacaaatctttcccatgactcaagttgaagatagtttaacaaacactgaatttttctgtgatgacattttgatactttgggtttcttgaaattttttttttttgtctgctttccctgggcccttagcatttgtcttgtctgttggataagccacccatggtccattaaatttacagaaatagaccagtatttgggaaatccttgtttgacttccagcattttactttgccctctgctgtgtaacaacgacaattcatttcatctctttacagcagtcaaccaatttatcaaaaagttactggaaaatctgttttaaccatttgctaaaataatggtagtaaaaccacagtgaaaagtataacattatataagcataagaaaacaaatctagattcctagaaaacaacatttgtaagaaataaatttcccataattatttacttgataaataatgttaggtcattagttttaaggttcaatgtggccgtgttccagttcatccttaacatgtttgtttctgttgtgagcaatatatttaatatgtggtttgtcacatggaagttgtgatttttttagtgcttagttaagagagatcaagactaacatccattctattttgtgtcttatcactatcaagggacagtgtttctgtgttcataaacaaattctaaggaaatactctatctttctgaaatataaaaatatttttaagaatacattttcaagtgaaacatgttctcaccaatattctagaaaatgttctgtactgtatattcaaaatccaatttccatctagaagcagaatattcacattggaaaactgggtccaagacatttatgacatttatgaatgattatagtattttacatagttaattgtaatattagtagaatagtatttttagtatctgaatcaaaatctttttaaatttctgttccttctaggttttatttgcaactgctattacatattgcgagaaagatattaggactttgataaatgggctaccttgagggacatgtccctgagttttatcaccatttatgaacatctatttaaaattgatttaacatttcaaacattaattcccagcaaatgagaacaggcctttcattagggtaagagtcatagaggtacttaacataggcctcaagttggaagaggattggcacataggctttcaatgctgtctctgaattaggttaaataaagatgcccacagaatcaaatggcagtatttcatcataaaagtttaattatgaaatgtaattattcaaatataccataatttaagaattttccaaagacaggacactgttttaattttttttttttaagaggcactgtctcaccctgctacccaggctggagtgcagtagcataataatagctccctgcaacatcaaagtcatgggctcaagtgagcctcctgcttcagcctccttgaccagctgagactacaggcacacactaccatgcacaactaatttttaaaattttatatagagataggatctatgttggctgggttgtcacgaactcctagtctcaagtgatcctctagcctcagcctgtcaaattgttgggattacaggtgtgagccaccatgctaagaacttcagtaatgaagcttgtctaggatattttccttttttgctagctttattgaggcatacttggtaaatgaaaattgtagccaggtgcagttgctcatgcctgtaatcccagagctctgggacaccaagatgggaggattgctggaggctaggagttcaagaccagactgggcaacatgatgagaccccatcttcaccaaacaaaacaaaacaaaacaaaaaaagttgggcttagtggtccgcacctgtagtcctagctaattgggaggctgaggcaggaggatcgatcacttgagcccaggactttgagtctacagtgagctgtgattgcagcctgggcaatagaaagagaccctgtgaccctgtcttgagaaacagattttatatatgttaggtgtacaacgtgttttcatacacatatacattgtgaaattattaccgcaatcaagctaattagcatgtccatcacctcatatagtaaccatttgtgggtacatgtggtaacacttgagatttactctattaatgaattttaagcatacattacagaattatctacggttactatgctatacatttgatctctagaacttactcatactacatgatggaaactttgtaccctttgaccaatatctcctcattttcctcaccctccagccactggaaccaccattgtattctactctcagcttctatgagtttgactttttcaatttccacttacaggtgagattatgcttgtctttctgtgtcaggcttatttcacttaccataataatctccaggttcatacatgttgttgcaaatgacaggatttccttcttttttggggatgaataatatttcattatgtatgtgtagtgacatgaaatatatatgtatatatacacatataaaattaaatattgatatatattttatatcatgttttctttatccattcatcagtagacacttatattgtccccatatcttttttttttggggggggacagtctcactctgtcacccaggctagagtgcagtggcacaatcttggctcacttcaaactctgcctcccgggttcaagtgattctcctgtctcatcttcccaagtagcagggattacaggtacctgccatcacacctggccaattttcataattttagtagagataaggtttcatcatgttggccaggctggtctcgaactcctgacctctggtgattcacctgcctcagcctcccaaagtgctgggattgcaggtgtgggccaccgtacctggcctagttgtccccatatcctggctattgtgaataaggttgcaatgaacataggagtgcagatatctctttgagataatgatttccatttcctttggatatattcccagaaatggaattgctggatcacttggcagttctattttcaatttctaggggaaccaccatattgttttctataatggctgggttgatttacattttcaccagtagtgtacaaggcttcccttttcttcacatcattgccaatactttttgtctttgacttttttataatagcgatcctaacaggtgtgaggtgatatctcattgtggttttcatttttatttctctgatgattagtgatgttcgacattttttcatatacctgttagccatttgtatgttttctttagggaaatgccgattcatgtcttttgcctatgtcttagtctgtttgggctgctataatgaaataatctagactggataatttaaaagtaatataaatttattacccatagttatggaacctaggaagcccaagagcaagctaccagcatatttagtgtctgacaaggaatcattccacgtagatgatgctttctttcttggtggaagggcagaagagacaagcaagcccccttagacatcttctataagggcactaatcccatttatgagagtagagcctccaaaaggcctcacagcctaacactactagactggggattaagtttcaaagaaaaagtttaagaagacacggacattcaaaacatagcagcctatttttaaaacaggttgttttattgctatgaaattttttgagttctttatatgtttttgaaattaaccctttattatgtatggtttgcaaataattccctccattctatgggttgtcacattctatgtgtgcacacacacatatgcacacatttaagtctttaatccattttaagtttatttttgtataaggtgtgatacaagggccaatttatttcttccacatttggttatccagtttccaaataccatttattaaagagattatcccttctctttgtgtgttcttggtatatttgtcagagattattctttcttttttatagttttcattgtatatctcttttatcgtcttgattgaattgtttttctagtttattttatttttgatgctattttaaatgacattgtcttcttattcttttttgtatagttcattgttatctataaacattcagctgattttgtatcctgatttttttgtcctgcaactttactggatttgtttataagttctaacattgttttggtggggtctttaggattttctgtctataagataatttcacttgtaagcaaagaaaattttatttctttctttcaagtttagatggcttatctttttctaactttttattactctgactaggacttctagtaccatattgaatacaagtgacaaaagtgggcatccttgtcttattcttgattttagaagaaaagttttcattttctcaccactgaatatgacattagctgtgggcttgttacatatggcttttattatattgaggtacatttcttctatacatatttgttaagagttttaatcatgaatagatgttgaattttgtcaaatgctttttctgaatctgttgagatgattatattacttttatccttcattctgctaatgtggtgaatctcatttattgatttgtgtatgttgaaacatccttgcatcctagtgataaaacccacttgactatagggtataatccttttaatgtgcttttaaattttgtttgctagtttttgttgagtttttcatctatgttcatcagagaaattggctgtaaactttttttgtagcgtccttgtctggctttggtatcaaggtaatgctgacatgaacttggaagtgttccctcctacccagtatttttttttttttttttttttttttttttttttttgtgggagggcggggatggaaggagtttgagaaggattattgttaattcttcttggaatgtttggtagaatttaccagtgaagccgtcaggtcctgggactttctttattgggaggtttttgattactgatttgatcccttactcactatcgatctgtgcatatgtcctgctttttatgattcagtcttggtatgctgcacatttctaggaatttatgcatttcttttgtgttatccgatttgttggcatatataattgttcatgattcttgtgattctttgtatttctctgatatttataatatctcttcatttaattataattttatttatttgattcttctctgtttcttggtctaggtaaagttttgtcaattttgtatatcttttcaaaaaataaataactcaagtttcattgatcttttttattgtttttctggtctctaccttttttatttctattctgatccttattatttccttctgttaactttggccataatttgttcttctttttctacttctttgagatataaagctaggttatttgagatctttttttcttcttttaaaaattaattcattaatattattattgtttttagaaacaggaaacaggctctccctctgtcactcatgctggaatgcagtggcatgatcatagctcaccgcagtcttgaactcctgggttccagctatcctcccacctcagcctcctgagtagctgggactacaggtgcatgccaccatgcccgacgaatttttactttttataatcttttttagagacagaatctcactatattacccaggcttgtttcaaactcctagcctcaaatgatccttccttttcagctacccaagtagctgggattacaggcatgagccaccacttctggctctttttttttaatgtggcatttattgctatacacttccctgtttgaactgcttttgccgtatttcataagttttgatatgttgtgttcccagtttgttgcactcaagatatttctggatttcctgtttgatttcttctttgctcaggagtgtgttttttattttcacatatttgtaaatttttcaatttttcttctattattgatttctagtttcataccagtgtgctctaaagatttttcatatgttttcagttttttaaaatttgttaggacttgttttgtggcctaacatatgatctatcctgaagattcttccctgttcacgtgagtagtatgtgtattctgctgctgttgggtgataagttttgtatatgtccattaggttcattcagtttctagtgttgttcaagtctgctgtttccttattcattttctatctgaactatctatttactattgaaagggatatattgaagttctctgctgttaacgtgttgctgtttgtttatccctcagttctattaacattggctttatatatttaggtgctctgatttgaggtacatatatatttaccattgttatatcttcttgatgaattgactttatcattatttaacgaccttcattgcctcttgtgacaatttttaacaagcaccctattatgtttgatgtgaatatagccagccctgatcccttttggttaccatttgcatgggatatatttttctatcctttcactttcagcctatgtgtccacttatagctaatgtgatacttttgtagacagcatatagttagttcttttttttttaaattcatttagccactctgacttttgattggagaatttgatccatttatatttaatgtaattattgatagataaggacttactactgccattttactaactgttttatgactatttttcttttcttcctttcttggtctcttcctttgtgatttgatgatgtttgtgtagttgtatgttttgattactttttcttcatcttttgcatatctacttacagaatttttctttgtggttaccatagcacttacataaaataacttataacaaactattttaagctgataacaacttaacttcaatggcttcaatacttggtgcctcgagtgtaatggagggcctgttgctagggtccaaagtgaagctgaagttgagtgctcacttcactctccttcaaccatgtggagaacttctttctccaagttgtgctgcatgggtttgagggagagttgacatatataatgtgaaaccgtcttttctaccttattcattgagtcttttcttatttctatgctctactcaggtgctgtaatcacttacttggattccttagttgttgtgaaggtatttttgtgcatggatggttattcaagttcatgtttctgtgaggggacaaatgctggaaactcctatttcaccatcttggtgactcctgaaaattccaggactcttaatttcgaataggcctgggagaaaagattctgaatagggaaaaaagtttttttttttttttctttacgtgcgttgcaggagaaatattttttttcagaaatgagtatgagatgtgaaaagcctgcttggaggatctttcttccctgtgcataggaggactctgtggtctgtgggccccagtgaatatgaggtggggaagaaaagattcaaggggagtggaatgccatggcaggtgtccctataacatgaattctaaacaccaagaaaactattcccaaataagcgcttttatcttatgtaatagatagtgacatggcaagtactatgttagagccataccggaaagaataatatgataaaatatttgcttaaaaatattttctaagatacaaagtgggctttgtattatttcatgcacacatgtatacatgaacacaaacatttttgaccattacatgtagtatttttcagagtaaagctataaaactaatgtgatatgattattaataatttcaagaaaaattgatttggggctaaatgctgctagacaagtcataggattgattcaggtcaatgataaatctatcctgaagggttttctacacaagtgcttcattagcatggggaaaagagaagatttcagaaagtatcaggaccgtggaagccaatggagtgtctctccaactccagcacttacctatctttcaatgaaatatttctcttttataaagtagataaaaaatttaatagaaatctagaaaaaccaatggagcctttacctaaaatcctacttgataataaatttactggtcagacgcattagttctaatggactataactcgatatgctttgaaatataaaatataaggatgaagcatgcattatagactttttcttctgaattagtataaaatatttcttcagagagtaagaaaataatgatctctaatgaaataagtcagttagaagtgtttattccctctgtaaaaacagaaaaataggattcaaattcatatatgctgtgtgtgtttatagggaaagagagagaaaatgaatgagaacctaaattatatatatattttcttattaaataatataaaatttttcacaaaatagtttagaattgttctgatcattttcctcacacaataactgcatagtctgaagcagtattttttgaaatctggatatcttactctgtcaatataatatttaaaaataagagttctatatttcaacccctaagagtgttgaattttaatgacctgaatatggattatcaatggcagattttaattgtaagcctgtttctcctcttcagtattcttatggcttcttttcccttaaagtcaataggataggctatgtggtataaactgattttaatattaaattaagagaaaaatgagctttacaattttggatcttagtatatggggttttctcaaggctaggcttctgtagcctggctaagcaaagttgactccatcaccactaagagaactagcacccatttgcactcaattatacatttgttgcacatttcccctcatttttactaatttaaaatacatcagtgtttgtaagggctatagatgcacctaagaaatcatctgtggcatttatgtcttatttgcaactcatttattcctattgcttatcttatatttcatgtaaaatgttagtgctatggtggaaaactgaagcccggcatcagacttcttagtagcactgtctgagtcactgtcagcttttatttaaagatattcaactatctatcagtttcacataaggaattatttgctttgatgagagaacttggttttagaaaattaatatttataaaattactgtaatggtagtatggatttctaacttgattctagattatggttctgaaaacaaagctctatataggccacagaaaaggcttgctctgacagtcagtgtgagctattatggacatacattataaaaaattgacataaaatgaatgaaataggtggcctaaatgcatttccagatgtgtcattttctgtggaagggatgattcactgcagtaaatatatacataagttctgtttgaatttattttttattctcacttaaaatattttgaaaagcaacaatgaagaaatgttcattgtgcaaaatccagagtttattgctcctacttggggctaaattacaaaaaagagtatttaaaattggatacaaatttgattgtgctagcagtaagtttaaaaacaatgttggcaatgtttaataataaggaaaattcactaggacatctgtacactgtgattattttacctaaaagaaatgcaaaatataaacagatgcccatcgagatgtggttgatttttgtctccacatggcattattggcttttattaaaagacatctaatcaagtttgatagatatttcttgaaatgatgcatggtatgcaatgcatgctttcattgtgcttcctgccattatggaataacgtgtcttatttggaaatacaatgatcatttctgttaaatcatgctcagtgagcttatataataacacctgtattttgtgaatcatttcagatttcagagagctatgccttcctaccaagagaagcggtgacacgatttctaatgagctgctcagagtgccagaaaagaatgcatttaaacccagatggaacagatcataaaggtagctgcagtgtcaaatagtgagatttaaagtaattttattcataatggccatttgtatctcacatttttataaaaacgtggtagactgaaacagttcaacaagtcagatcatctcatttattcaagtaggaggcagtgaattttgaatatccacttacaaagtaattcagtgcccattcttagaagaaagacagtttcagctgtggcaaataacatttttccctgtaatcatgttttaattttcatttattatatgtatttcatgctattttagatatattcagcaaggaaattggtttctatcaatgtctttttaaatctaccaattccttatttctaaaaattatgaataatgtggagtttctttactaaaaaattttacattaaaattatgatttggatttagctctcattaaaattattgaaaattatttagctaaatatgacttcctctcagagattatatcagtctcagagatacattttttgctggctcattcctgtgtctcgaaggttaaatcgaatggccaaaagcaaaaaattgagcagatttccttcggcattcaaaaaatacatatagaaagtaaagcaaagaagaaaaatacaaataattgtgttagtaaccacattaggtttatttattgttattcaggatgtttaaaagttcccctgcatttataaataatttattagtactgttaaacagtgtcaatacacctttgtagaaccttactagttgttttttctaccgtccaactataatgctaccatgctttaagacacttgatatctaaaatcctgtttcaatttggagaaatagatcattttaaaattacaggtagaatgcagtattactttcattacccattaaaaatgttttattacagataatggaaaacctcccactttggtgaccagcatgattgactacaacatgccaattaccatggcctacatgaaacacatgaagctgcagctgctaaactcacagcaagatgaggtaaaataaaaacatctacatttgtattacttacaaattggaacgaagcttgataaccatgactatcatattaagcatgatggcattttgaagacagtaatttattttttaatgaatgaatctcaccacagttgcacagatgggaaaagtgagcagaaactcctagtccacaatacagagcccctgcttaacacctctgtcttagtgttatgtgggaatttgtttgttcccaagaaagctacattttccttagtagaccatcactgagctggccttggtaaagtgctacaaagttcagagggggtaagttcacagtaaagtatccgaaataattgagattctaaggaaatttaagtactaaggctattttgcatggcaatcagaaaagtagagttaatgggtatttcaagtattatcatttctccatcattcaaaccttatgtaaattttaaagttattttttaattaactgctattctatatattatttatttacttctgtgcatttcctagagacaatctgtggtcattcttaattagaagtgttttgatgttttaagttatcctatttaatttgtatagtgaaaatttagcaacatgctgcatgtatagacactaaaaacatatttcttaaatactctgtaggattctagttagctagccattttggttgaagctatgtcaaagcagggactaagttatatatgtatggtttatattctccaaaataaataacaatagcagatatacaataggtgcttagtacatccttgttgactagttaatactcaatagatgcattcaggttatttatattagaaacaggttcaggtcctcaggctaataaattatcttcttgaaatttctctaaaacaggaaatgaggttaaatgtttgtttttcaaatacagaattatttgctaagctatgattgcattcttttaaaattactttgttgaacttactttattcataaaactcaaatcaagtttttagttttcctctgtatttaagcagttttaacctccaagctatatttataaaattgtttgatctcaatagatgttattcagggtatactccatacaaaaattcatattagtgcagtggcaatattggattttatattgccatatggctacatataaataattgaataaatagtaataaaatcattgggttaaagatatcaatgacaattaagaaaatactaatgtccttccatccctgagaatgataaaaaaaaactatcttcatgattcattatatagttgaaaaaaatttttaaatgtctcattaactagttagagctgtcagattatttgtaggaagctcatttagatgttgatatgtttattactaggccaaaatgtaagaagatccactttgtgccaacaatgcgcccacatatgctgatcccttctggcttctaaaaaatcataagtattttacacaaaagaaatagatcctttaaaatttataactagattagaaaaataactcttatccttacattttgaaaatactaaattggatgtcacgcttccttaaaatatttagataaatgactagttagattatttgcaaaatttttagaaaattgtgtttattgaaagatgaaaaagaggttaagtaaaggaagtcacattaaaatggaatgtaagtgaaatattcctgtctaacaaattatatttaaatttgaataagcattaatccaataagttcaaccaatatttattcagtacttacatgtatctggtcctcctgaagaaaaacagtgaataaattgagaaaaatctttgtcttttgtgggggtaaacatataataaagaaaataatggccataggtatataagaatatgctaaaggctattaagagaaataaagaaggccagacatgggactccctttagaactagggaatcacaagtttaaaaggctttattaaaatgtatcatttgaatagaagtgaaggaaatgtgtgcatgtagcagagggatatagtgaaaacttcctgaggcaggtatatatctagtagctgcaggaacagcaagacagtcaacatggttggaacagaatgttcaaggaagaggaaaataggagaggagtttaaggagatagtggaaagccaagttatatagagtcttacattttaagaacttttaaattttactctgagtaatatggggagccattagaaggttttgagcagagaagtcatgtgatctgatttatattttaacataatgatgggggctgagaatagattgaagaggaaaaaaaaactggatgcagggacaccagtagaaggttattacagaaatcagtgtgggtaaggagttaacaaagctctattccttcctgcatgagaaattggcctttgaataacttttggagtttgcgctccacaaaactgctaacattgaaatgataactctgttactaggcaatgttcctatggcaaaaatgattccaattgataaactgtatcagaagactagaaatatctggttagaatcttcagatttccttgagttggatgatttttgcaattggcatgtcctttgtgaggaccttaagttattaactgtggtgtgataagagatttttgtctcttttggggcatggggcttctctgctaagtttccaacctacccagtatgattactgctttcttgtacctgagctatatcacaggaagagctaaagaaaatatgtctaattaactatgtgaatttctacatggcccctgcaagggcttccatggaagagaaacacctgatgctgccctactggcaagagtttcctttgctacatgtttctagaagaagctaatgccaagggttttcaatggtcctcttatgagtatacattttagttggatttaacaaaagcttctgatggatgtttcaggaaagaagataatagtggcttggatcaaagacagtggtttaggtagtgaaaagaggtgaaattatgaatagattttaagttttgctgacagattcgatgtgaagcatgaaagtcaagaggtagtaatggctccaaggtctttaatctgaacaagtagggtagaattggtattaactagtgtaagaaaaactgtgggtagaaaacatttgaggaatgatactagaagttcatgtgagctcttcattagaaattcaagtatatttaagaggtttattagagattcaagtagatttgtcaattagacagttggcatgtgtaattaagagcaaagaactaagctagacataaggccaagcatcatcggcagatagtgtgtgaagccatgagactgaagatactaccaaggtagtgagtgtagactgaacaaacaaagcccaataactttgatttgggaaattccaatgttataacatctggcagatagggaggaaccaacagaggatactgagaaagagcacccagggtattaggagaggcaggagagtttgtgaactagaataaaactggaaaaaggtttttcaatatgtctacagtaatgtattatgtcaaatcaagtgataagtcaattatactgaagtctgaaaattaaatttgtgtttagcctggtggaagtcaatggtgttctttacaagagcagtttttatggggtgctcaggatgacagcagcaaggccattgaagagtttgctatgaaggggagcaggggaaagaggtaggagatggagggagcatgggaacaggagttttttattatatatttttttctaaaatcagagaaattatagcatatttacatgttgatgagattcatgtagcagaggaaaataatgatttagaaaagaggaaggagaattgatgaagcaatatccttggcattaataggtaggatttcttgtacaaaattggaaaagttggccttagaatggagcacagacaggagggatcagatagaggtaggcgaatggaaatagtggtggagattatggaattgttctgctgtttgctcctaattcatcagttaaaaaaaaaaaaaaagcaagactaaggatgtttgagaaggtggtgaaagtttgagaagaggagaggatgtgagaagtagaaatctagacagtgaggagtgaattgaccaggaaaatggacctcttttgagtttcaagtaaagtcatttaaataattgctcatctctatgtccagctatataggggcatgggtagaagacagtaagggaaaaagagaattactcacattttgggtcttgtcaaaagaatagaagtgttatataagggtatgattaaaatgacaagccatggaattctagccacataagaatataagtgagatcatgagagaggtggggcgagagcaggggaggtcaatgcaaaagggttagagggttagaatcaaggggtgataaatatcagtgggatagaaatttcatcggaatactagaatacatgcaatactagagcaagtgagctgggaaatttgagctgttgtgtagagagtgagatgcttaaaatcaaggttttggaggatgtgcagttgctggtaatgaaatgcatagaacatgattatgagagcaaaatggttgaagaaaggcagaagaccagatcattagggaagagttcatgaaagtgacaggtcaggatgtttccagagacactgaagtaatcagggaccgaagcatgcgtagttgtctttttttttttttttgagacaaagtctcactctgttgcctaggctggagtgcagtggcgcgatctcggctcactgcaacctccgcctcaagggttcaagcaattctcctgcctcagcctcccgagtagctaggattacaggtgcccgccactatgccaggctaatttttgtatttttagtagagatggggtttcaccgtgttggccaggctggtctcaaactcctgacctcaggtgatccacctgcctcagcctcccaaagtgctgggattacaggtgtgagggtgcctggcctgaaataatatttttaaacagtttgctaagactgtcttgtgaaaaatgtcaaaacatgttcaaatatcaaaattctattaaattactctttttatgtacacatcaaagaaagaattgatgtggagagaaaaaacacacaggaaaatttaggaaactggccgtaaataatttactacttagaaccactgacatgctgctctacctccattttgcagatggggcaccaaggtttttagctgataaaacttgccctaatgattaaactggtagagagaagattggatatttgaacctaggtttaaataactttggagcccaaaatcttcctactgtgcaacacatccacttaaaattagtattaactatttgtttttttaagcaacaaatcaatgtaaatagaatgctatggtgtagctcaaaggggagaaattagatgtttttcagttttcttttgctatgtaccacccctaaaacttagtgtcttaatacaaaaatgatttattaatactcattattctatgggttaagcagttagccaagaacctctgggtgatttattttgttacttctggcataggctaggatcatttactcagtgacattcaattggtagctggacctggctggatagtccaagaaaacctcacttaagtacccggttccttgatgctcctttatgctcctttacgtgacctctcactctccatgtggctggcttatgcttcctcacagtgtgctggtctcagggtagtaagacttcttaactgacagctttattgtatggcagctggcttccaagagacaggaagtggaagctccctgttgttctgggactgacacagcatcacttctgccatatttctattgaccaaagcaaataacaaaaccagcctagtttcaaggggaggagagagaaatactgttccttgatctaaggagcagcatgcatgtaaggggcagtggggaggggaagggatccatggtagccatctttggaaattatccactacatggtcaatatccataaaaaaaaccccaacctcctttattaaccaaaataaaattttaatgaattaacttgttatttgaggcttactgcattgagaaagattttacaaaatactgtatccaatatgagatcatttgaccttcttataaactgttggtgagggtttaaactcgaacaaactttctgggggatgatttgatgataattattaaaaacttttcaaatatatttatattacttgactagaaatttatcctaaggaatgtgatatatgaaacaacaatttatctattaagatgtttactgtattgctagtagtgaatgactgagtatattttcaagatttcacaacaaaggattgtcagttatgcactgcctaagatggtagtcattagtcacatgtgaatgtataagtttaactgaacattaattaaaattaattaaaactaaaaattcaggtcttaagtcacactaaccacatttcaaatgttcaacagccacatacgactagtatttaccttattgaatagagaatattatagagcaattccatcattgcacaatgttttcttgaacagcactggactgggcagatagccagcattaaatagctcattgagctacatgttgcaggacaccaccccaaagattctaattctaggtctgatatgtgggacctggggatatgaatttttaacaggatctacactcatgcacactgagatttgagatgatgaatttcatagagatgctgataatgtaagctttgatttgatttgagcagatgataagttttaaaaaatcaacagaagagaagattggtgggagtggtttttaagcagtcttatgggaaaccgtaaatatttgattgaatagcatacacattatttgataaacaatggatagggctgcaaatttataagcagagaagtgacatgttcagaaatgggaagattaatttggcaattgttaataggcaggactggtgtagagaaattggatgtggataagttaactgggagactattactacatagtttaggaaatggcaaaatgcaattttgaactaatcaggcaggacaatagcaggcgaaatcaggaggtacatggtagagaccctttatagataatatctggaacttgaaaactaaaatgaaatatggagcagattaggggtctccatttcaagcaacttctgaagatagaaataaaagctcaataacaaaggttttgagaaataaataagtgccgtgtttaaaagggaaaagactgaaaagaaaattatttgttacagttaaattgttctaatattaaaacattaagtttcaaggaggcagaattactatggtctctggccatgactttcattatcatgagattttagtcatgtaagaaataagctcacacagtatgatgtggagagtttttttctggttgtcaaacaaaatagattttcatagaggaaaggaattagatgaatggtctagagataatcatgaataaaatacttaatatcagatcagtcaagttttctgattctttattcttagaagccttcagtagtttcttcctagtgtaattagtattttatctatgttggtaaaaaagcacaagcttatatttcatatacctctgctaacttttattaaaaacaataatttaatcaattattaactaaactagaatatacagaatgaatacatgcacttagtctcattaaagctcttaacaaaagtataacaattgaattctaataaggaatgtaattgtgaaaatgaattatatttcatatgtagtagtggaggaaaatatttaaaatattctcaatcattaagccacttatgatggtaaataatttaacatggtttttttaattacaaaaatacataagtatacatttggttacataaacattttaatctctcatctgaatttattaaaatgtatgctggcaagagtgtcagcatacattttagtggtgataaaaaatatattgattttccataatatgctgtggctgtttttacaaccatttcatagaacagaggctgtgacttgaatatttatatttagctcttctttaaacataaatacacacacacatacatatcctcatatacatatacattttacatatttatatgccatataaatgatattttactagattacttatagttagctttttgtgacctttataacaaatacttataaagactgtttatatgtttatgtaaacacacagctactttagtaacacattttgtttgcctttaccattatattgaaatgtgttatattttgttgtatatgttcatatactgtaataaatgtgcataattttatatactgtagaatgtattgtatattccatatagtaatattaaaccattttattgtgcttatcatgtacctgacattgttctagatactttaaatatagtacacgccctcactccacatgtgactctgtgagagcagcacaatttttatttccattgtatagataaagaaactgaggcacagtaagttgaggtaacttgcttaaggtagcatatctaataactggcagaatatggacctgaatctaggaagtctggcttctgagaatatcctctaaaatactatgacatcacagaaagtaaatatagtgtatctaatagatatctgtatcatctatcaacgtgtgtatatatatatgtatgtatttgtatatgatcaacactagtaacaagtccacattgttatcactgataatgtcagtccacattgaagtctcttatttttgcatacacacacacacacacacacacacacacacacatacacattagaatttagaattggagtaaacataatgtattgagagagggcatgcaactaagagaagtctatgtggctgattgtccatggatctgacacagtggcatttccttactgacttaatgaagagctagtgctactcagtgtgcccaagcatgacccagtctttgataaaggaaagacaccacagccaaaaccaccaagcctgatataagaatcagaatgccaatttattagtctaccaggatagtcttgttcgttaataatagaaactcctttgctgatgccaagatgtcatttatgaaaccagggtaattcttcctattcaaatatattgtttcctcgagtctggatgacttcatatgactaccggttctagtatataatagcagggaaaatgatttaacttctctgtgcctcaatttcttcatctataaattgtttgcaaatttatagctaattcatagttgtgataaaatataaagaacaacgtgtgcaacataaatagcagcactactactgctgattattatattcgtgttaaacgttcagatcaaacatttacaaattaaagtcaaagctagagattttgattaaacatttacattttgcacaggtttcccgggccttccagcctgtataagtataccatttgtccaaaaatcagttctccaaacgaagtttgcttcagaaaaatgactgcaataatatatcctagatttggtttaacatttggaaagttttgataaattggccattcagcaaactggccttttggtaattccattttatgaactgacttttagtaaatgtttcatgcacaattttacctagaactcctctttgtggttgccgtgcaatttatatttgcttgtaaagaaagaaagggtgtactaagattagcttgctctccattacatgtggactttgaacctaatatataagttggctatattagaatctatcctgtttgccaatgaaaatttttttataaagccctttctgcattctaagatttctgcttacaacattttttggtcatttagttttaaatcaaaacttgtatttctctttatgttacattttatgattaactcttttagaaagtatttactataaaatcattctttatattatttcacaagtcttgaaattccttgaagggagaaattattccattgtttttttgtttgtttgtttgtttgtttttttgagacgagtctcgctctgttgcccaggctggagtgcagtggcttgatctcagctcactgcaagctctgcctcctgggttcaagccattctcctgcctcagcctcccaagtagctgggactacaggcactcaccgccacacctggctaatttctttctgtatttttagtagagacggggtttcaccgtgttagccaggatggtctcgatctcctgacctcgtgatctgccctcctcagcctctgaaagtgctgggattacagacctgagccaccacgcccggcccattgtttgctattttaaacatctattagtttgtaacatatttttctgaattctgtaaaaatttactggttaaacttcaattgactgtgtagataaaatggttattatttaaacgtattatacgttaaaatgcttgatgatattttaaaactattttcaggatgaaagttcaatagaaagtgatgaatttgacatgagtgattcaacacggatgtcagctgtgaactctgatcttagctccaatcttgaagaaagaatgcaaagtccccagaatcttcatggccagcaagatggtaagcctttcagtttgactaaataagcaaaacaacagcaaaaaaatgagtcagaatgcatggaaacaacaactacctcttaattcttgtgtcaatttttaaaaatctacccatttctatgggaacttttctctatgtatttaggttatatcatccacttcactattttttaattcaaaactgttcaaaaccaaggtgttagactgatttataagcagatattggttataaaattcaagttaattcatgttttgctccctgaacttaaaatatgtgttatatcaatacagtttggtttctgtgatattttctagctttgatttcttgggctgtcattcttccgactaaattaagcatttaaatatgatcaaaagattaatttggatgtttatcttttatgtaaaagacaagtttcaactaagaatcactagatattaaaggaaattttaccagagcaatagtgctgagtaagacaatatttgctgtgatttttgagctactttatccagctgttaaggaaagaaagttcatgatctcttattcctgggttcatgaaagatttctgaatcagcctattcttgataggaagaaagctagatatgtagagaaagtagatgtcatactaacattgtaggcctaatatttttggagatctttgaacactacctttgtagatttttgtctttgtaaatatacaattatgtatacaagtcaatgtgacttattttggtaattgctgacaaaaagggttttaaatagaaggaaattggccagttatattcaaaatttgtgtattatttctgtatttaacaagttcatatgaactttttgattgaagagttttgtacttacatttatagatactgaaaaaatctttgctttctctgacagttgctattacaaactggttgcaaaagattgctgtatttctagctgctatttgtgttctgtttgtgttggcaaggcttaagaaatccctagttttaagcataaaaaacgtccaagaacagaggggcttttctttttctcacttcagattaatcttaaaagatgctggtgtccttgttagcatgagttataagaaaatgaggaatgcattgattatcagtgactttaagatagtatcttaattgctacgtgctataatagctattgtagtagaaaagcaatttatttggaaatattataagaatgaagtttttctgatttagatataaattttctcttttcttctaaaacatgagtaggcattcctcagattttgtatttttttaatggccattgtatagtaccaagatcatagagtaactgaaatattcttagtaatgtatatcactccattaatttgcttatgcatttaacttaggtatctccttgccgtcttagtctatatataattttagggaatatagataatgtagagggtgtatagagaatgtagaggatgtctctcatcatgcaaattcattgtttacttgactgaagttgcaagctgcaggtctttggctatggcacaactgctgtgatataaatctatattgattttaatcaaatgcagtagaataactccaaatattatatactcttagggaaaagcactttctcatgatatattgatgatattctaacctaggcctaacccttccttgccttacatgtaagatacttttttcttacatttcttgctgagttttctcttgcagtgatccgtcctctttctcctgcatcagaggttttccccactctactggattattagaatctacatacaaacataatttgataaatatcttctttaaaatgcctcgattgattatgtctttttccgtttctgctgctacagcaaaatacctgagactgagtcatttataaagaacagaaatttatctctcacagttctggagtccaagatctgggagtccaagatctaggtgccagtaggttcagtgtctggaagagcttgttctcccacgatagtgcattattgctgaatcctcccgagggaaggaacaccatatcctctcatggtggcaggatccaaagaggggcaaactccttctgtcaagcccttttgttttattttgttttattattttatttttaagatggagtcttgctctgttgcccaggctggagtgtagtggagtgatcttggctcattgcaacctctgcctcccgggttcaagcaattctcctgcctcagcctcctgagtagctggggctacaggcacacaccaccacacccagctaattttttttttttttttttgtatttttagtagagatggggtttcaccatgttggccaggctggttttgaactcctgacctcaagttatctgcccgtctcagcctcccaaagtgctgggattacaggcatgagtcactgtggctggcctatcaagcccttttataagggcacctaatcctattcatcagatgagactgacacatcctaaaggccatacctcttaatactgctatgctggagattaagtttcaatatcaattttggatgggacagaaacattcaaccatgtcatatcccattgcacctcttcattcatcaccctatttctctgcaccacccctgcaaaagactttatagtgaaactctgaaagagttttcccgttatttccactctatcctttttggctcatctcaagtaggctttcatccttgccaccaacttcacttgttcttgtgaacatcaccagcaggcttcttattgcttaattcattggtcaacccttagtcctcatctccttcaacgctaatgtttaaggacaatgcctccccccctttttttttctggtgccatttctgtctcattcatctctgtgggctccttttctatgttctattctatagatgccagagtgcaggcttcaactccctcttcctttttctcactccctagtacactacatctaaccatgttgctttccataacatctctatctagatgaatcccaaatttatttctccaagccctgacatctttcctgagctcaggactatctccccttacctatttcctaattgttaacattcttcagaggacttatcactgtatgaaactgcattatttttctcaattattagctgtttctcttctagaatgaaaataccatattaattaatgagttttcacatgcttaaagttttcctttcattggcttcatttgagttagttcttacattctccatcatttaaatgattaaaatataactttttaccataattatattttgtaacacaagttttacatatttatcttcttttcttctgtccttccttctgacaatggtactctcctaggtaatccatattgacaaccttctgtaaaatttctttttttcctgtttacaaatacacacccatatacatactcagaaaattttgtcatcaaaaacctagaattatgtcatttatgctcttctgtatcttgatttatttgtctaacattacctttcttttagagcttcctatattaggggtgtgtgtgtttgtgcgtgtgtgtgtgtgtatcacagtaagaaaaaaaaaggcatgggacctacctcatataacacacaattttaaggaatgtatatcaaactcagtgttgccactattgacacacaactctttgttggagagggatgtcctctgcattgcataatgtttagcagcttcctggcctctacctgctgcatgttcttagctccccttctcccaactgtgacaaataaaaatatcttcagatgttgcaaatgtcccttgtgggacaaaattaccctaagttgaaaacaaaagaaaagcctaggaatcagtgcccagttgtctttctgcaatctcagaatagttctttagttacactgtccaacttgatagtcgctctccacattgtggctattgagtacttgaaatatggctagtgttactgagaaactattctaatttaattttaattcaaatttaaatagctacatgtgaccggtggctactgtgtcagacagtgtagatatagatcattattttattttgactggcagttaaactctgttctctgcagccattggttgaatgtgtctgaagtctggaaaaactatagaagaaattcctattttaacagttgactgaaatccctgtttaatattttgaaaatctaaacaatacaaattattttaagttaaattaaaatttttttttaacattaagtgattaagattttatttagagaaattgaagtaggacattatgatttttataaatccttcctaataattataacaggtaggtataaaaatgtccttattgggtaccatataaaatgaagagtaaaataactttttttacaatttttatttcactatggttatagaaaatttgaaaagtattcattaaaaaccaagggaaaagaagactatcaaatgtgcgttgtgttggaaatacatatctggatatatagatatgtatacactcagaaaaggtgaaaaagaagaaaaatatttttccccaggctagataattagataaaggtcaaaaagacacaaacctgaatgaagaatttgtaataagaagaatgcttcaggattaatgtatagtattctgcttcttttgccttttttaggtttataatatttccctaactcaataaaaacataaaggcaaaaaatgcttagaaactgaatcttcgcataaaaagtattttaccctcatttttggttttgaggaaactaagttgagctatttaaatttttttttacagacttaaaagaatgtttttaagttaaaatcatttaaaggttatatatacgtctgctttactcatgaaagcatgagtaaaagcaaaacaccttgaaggtgttgtggaatataagggacttattatgaaggaagttttgctatgcaatggctgcggttcacagaatttcaaaaagcatctcgaggactaacagctaaaggcatccttcaaatattcagcagtttgtaagcattcttcttgttctgccagccatttaaatggattagaaacagaaattttgtcacttgagcttctgtgtttgaatctcagatcctagtcatttatggaagcatggattagctcaaaaatgtattccctttcctaaatcaattacttactttattatgaatttgtaccttctaaaacagctgatgttcattccttgtctggggttatttttaaaaaatatctggcaaaagaaaagtgtcagatttagaaacagacttaaagtttcagttcaaaataagcattttacttcattttatagaaggatacttttctaagaaccattttaatcacttttctgagttaacactttaatgtaaactattgatattttgtaagggagtatttgtgcttttttaagcacaaataattagaaagattattagatattaccaatatatttatgtatttttcaattgcaacaatttatatatatatatttgcattttaaaaaaagataataggaataaaaggaatgttgaggcatacccttaaattctctgtatgtcagcttaatcagctataaaagctattaagaaatccatttaaaatatttctatattaaatattttcccatggtcctttgagccttttggcctccatagtaaaaatctttgcctcccactaagacacatatgatatattaatagaattcaccaaaaataggaagcatattcagaggctaggtagtcaaaaaaaaaggcaaatgtaccattcagagatataattctaaaaggtaactcacttggatccttgggtatacttaggacaagggtaaatgatgtgaggtccaatatttcattattcactcaactaatacatattaaattctagcataagttggacaatggatttacaagcatgaacattgcatattagattaaaccatatgaaattgccatacttccttgatttgaactgatggttcaagctttaaaatagcttaaactagaatatgaaagatatggaaacaaagtgtttttgaaattgagatgcatttctgtttcagatagcaatgatgctcacatatgtacattgtgtatctcttgacttgtacactcgaaaattatcacaatcctcttttcagtggaaacatagaggggagtaagttaacaaaaaatagcaatctgattgtgagataaataagtacattaacagatataactgttggagtttcactttttcttatatcctaattcagattatgtgctaaactggcctcctgaaactcctacattgggaatttattttaaaaatacagattcatgggacccatctcagatgggatgactaagacaattgtgtgggatgtaagtatgggaaccagtgctccacactatgcttgtgaagatattctttactattctacctagctgttctggagtgccaaaatggcaataggtctaaaggggattaagtcacattggtgcacttcatgctcaaatgttgtgaccagtaacttctgagttactttttgaatgaggaatagcatgtaagttcattcctagtatatgtatgtgtttgtatgtgtttcaattagctctgttttcttagttatgacaattgccacatatgacagttcttttgtaaattttgaaaatgctcctattctactctaagaaattttacagtctgttttcagtcttatgtatatgaacactgcacacactggactttagaacacgcacacaaacacacatgaaatactcctttgaaatgctgtttttactgcccagtttatatgtgaataaaattttagtaaaaatatgcttgtggctaaaattgaatttaatttggttgaataagatagttttatgtaattattaaagtgtataaaccagcagtaaaagcaagaactatgtgctgttcaccatttaatttcattggaaaatctaataaaacatgtttttaataaaagtgatgtaaaacagtatactgaataggaaattaaattcagtggttaacttttttgtgatggtgaattttaatcagaaaagctattaaaatgtttttcaggctgaacaccagattccctggagagattatgttgtcttgtgtaagtcattttctttcttgtgcaagtttgttttctttcagtgtttacaatttcttaggaaacttgggatagagcaaaaattgttaaaaggatgttgattcttttatacaaatgtaataaaatatttgacttcaaaattgaattcgttcctaatagtgtttttactctcactttttaatttgcatacacttctggacttaaaatacctaaaaatgatacaatgctgctcttttttcttaattcaagttgttttaatgcattattaaacctaattcacatgatgaatttgtttaaatattctgaattgagttagttaattcgatgaagcttttagaaaactctctttatggcagttgctctataaataattgtataataatttacagaagtataaactacctttataagtaatataaagaaaacaagtaatttgaaggaatgttactatgaattggaggagattttgattattaaatccattcataatattgttatttgtgtgtatatgtgtgttcatgtgtaagtatttaatcatttgaaattgcttttaagcagtaattctctgtttccaaaagcagaagaaaaggcaatttgacttacatataaaggataggtatgaaaaatgatgtttagttgtatatttatttaaaatgcatatctagggaatgttatttactttttacatttaagatcacttatttgggagtttgctctaccttttttagtgacaattctgcctttcaatactttactcatattacataagtgtgttttcatataaacgagtgcttgtttagagaattagctcattgatttcaggctcaaacttgccacaccctagagaccagtcccatcttagctaggttctgatcctctgggaaactaggggaaatcggcttggttacatgcttgctttggagagtctaatctgatcagtgaaggacgtcagattaatttgaaattttactgctgggttagttctttgttttgagatattgctcttttggttttgtcactatcttcttgacagtgtttgccagtccatgaatgtttatgtggatccaaagttcaatcagtttcagcacctccaggagatgccaaatttctgttaggaccaaatagcagatgctagaccgtttaatccttaaatatggatttctgtctgtctgttaaggcataaataaaattaagaagcctcataacaactggagagatgttagacaatacatatcctttctgaatttattcaaataaattttgaacctattgatttatatatccagctatattatagaatcagaccacctgcatttccaacttgaaagtcttgaacaactgtcttttttgtctatttttgtttttgtttttactatcacctggctagcctttataaactcttaccgtaaactgaacaccatgctgtgttcctttataactttcttgtactaatttgggtcagctagctactacttcttttaaaaacagctttagcctttaggcaaagcaatttcagtgtttagtagggctttgaagctggtgttgcatgccagctgtgcagacagataaatcaactacaacgtaggggtaaattggccatgaaaatctttatttactaggtttatagagatcctagttagattgtgggtgatataaagaaagaacagttggaaagtattgaagaaaggggttgaaaggatatttcattataattattataaatttacagtgtaattattttcttaccagtctcatttctccacttgactgggagtgctttggggacaaaaaacaaagtatatcttatgtatccttgcatattctctttggagccacacacagtatttgaaatacaataaaatataaatactttttaaattgaaatagtattttgaaatttcttccccatctgcttacttttatagtgaaatgcactcaacccttagactcagttattcttgccaaatattatataggcagttgctttccttatcctcgacgggcggggcctccctgttacaatttcagcatccctagccaggggtttatggacagaactctggtatccctgagaagagcccctaggaggaagggcgaccgcagtatcttggatcagcagccctagtctttcctgtctgctagctctggagagtcagggcagcccagaggagggggattccacccagcccagcacacccgctccaccaaggggcagccagactgcctatttaagtgggtctctgatctggctcctcatgactgtgtgagacctcccaacaggactctccagacacctcatatgggagcgttccagccggcatcaggtcagtgcccctctgggaaaaaacttccagaggaagaagcaggctgccatctttgctgctctgcagcctccactggtgatacctccaggggcaagagggacccaggtgaatagagtccagagtgaacccccaacaaaccgcagtagccctaaggaagaagggcctgactgctaaaagaaaaccacacagaaagaaacaacaacaacgtccatggatgaatattctgtcttttttatatcttactttggggttcctgaggcctgtgaattcttccttttctacaaccacaatctactatgaagcaataaaataattagtagctttggtatgttaaagtgaattcattaagaagacagcataaaagacctctcagccataaatattgacactagctcggccagtaactagttctgcaacattatttaagtattattgacaactttggacaaccttttctatatttgtaaatgagaagctttagataatctctctctaaactttattatagttccagaaccatctgtgtgttcaccctgttagggttctctttcttgttcctaacattttatcttgtctcattttctgtacatctctaaactggtttagtgctttcttaaactagagaaaggaattaaaagcaatggagacacccccatttttctcccagctggcccttccttagaaaaccaaggtgattcctgaaagaacagactttccactcttctagtttctccctcccatcctggctgcgagagtcattcagagttgtttcctcctttttcctcccaatctgccactccattttcaagaaactatagtcaacatgaaagctcacaaatattgccaaaatattgtgaaatcatcacttccttctttttcctctatgaagaatctcattcataagaacccttatccctaatccatcttgaacgtacatgtgtatatatgtatgggtatgtgtatatataaagacagagagagagagcaaaatttagctgtttcaacaataatttttaatttccactcaatcacttttcataaaatatttcctgaggttttgaggtactggagtatttcttgggatttccttcaaccactgcattgttatgtctttggcaaccttaaatgttcatatacattttagaaattttgagggtttctggcagtcacatatcatcagtcagcccatctctccctatgaggttaattcactaacatgtcattattgttatggtgtaacaatgttagggagaatcattcctggtgccatacagaataaaacgtgcaactcatcactgcttagccctgtctttattcaaatctgtgatgaaacaaacaagagaaatcaggttatcagcatagggacagtggagtttagtgcactgaatggtgatgtggggttctaaagtggtctctgtgaggacatgcctactctcttaaagcatgccagcagaaccagtagtttgtttatctaaaatattgtgtgcatgattctattttagagtcaataaaaaccatataaactctcattcaattcaaccatataaaatcaaattatttttaaaaggcatttctaactcaaaggacagatgatgacgagaactaaaatttcttgactgtttactgaacgctaggcgctgtttgaggaataagctttttaaagtttttactagagccatttgaggtggacactttttttttttctttttctggtatacaagaggacacggaggctaatttactagcctatcatcaccacaactactaagtagtagaaacaggattggaacacagccttctggttctgatgcccatggctttaagcatgagtttctaagttgccacaagcccagctgtgtaaccaccgcatttattatatcctatagtttatgcttgctcacacctattgttttatgctttgcaggctcaaccattccattatgttcttattttctaaacagaaaattaataatatagctaatatttttatatagcttgtgcttttataatctgtctataataaccacttgtagatgttttcctgtaacttcctattatcatgcatgtatcctctttgtttctgcattgttataaagaaattaaaatattatttgtagccattgaaatgtattggttctgtctagctctctaaaacaggagtaggaaacctaaattctgtttgttcagtaatctctcttgacaataattgccctgtgtttaaaattcatattttcttatatctgttaaatatgtaattgacttttgacagtttctttcattccttccaattctcctttgtctggaaaggacaataggaaaatgtggctgccctctttggctgcatttattattttgtatcttctcatttcattttactgtgctttattctaaataataagaccaagctatgatggaaggaaaagaaaaacactcttcattcatgaccatccactcatgtcaatagtgatgtaccttatcttataagcttattttataactattcagccttgctttgtgtgacatacaataaaatatatatgttattgatgaagagtgccattttcctacataaagcattcagaaaaataggctattttcagctatcaattatacaagtcacatgtcttaaaataacatacattatataatagtgatagtcatttcaatctaataaaatattttaaaagaatattaaaatgtgtataatgtggaaattatccagattatagttaagtagacttatcaaatatgttcagtcctacacaaatgtgagcaaacttttcaaaataaaatgccaaacttcaaaagaagttttaatattattaattgaagttacttgcatttgtggaaataaagaaactagaccaataacattcattaaaagtacttaaaagatattgtggtcctgagaacttatgtttagtaaattgagaagttaataatagaatcagttaccacttaggcatattttctgtctaacaattgtgaatctgtaaataggccagcttctgcatttgcatcagtagataaagggccatcttctaatttcttaaaaagaagactgcagaatgttattctgggtatgaaaattttataaataagttccagatagactagatactttggctttttcctttgaaaactgtttttttacccattgaggtactattacaataatgactatcatgtagtttaacaatcaaattagtatcttatgtcacacattattcccatttcaaagctaaaccttacattttattttctttccattaaactgtgcttctttttgccattaacaatgatgctttacccagttaaacatgtgttttctaagacttctttataaagcacatcctaactgttattaaagatgatgatgtttgtggccagcctgggcagtgtagcaagagcccatctcttaaaaaaggatgaatatgatggacaaggatgtggtacaatggacgtagcagtggcccagccttcacagtatcaaagtttagatcccagttctgtgatataacctgtgtgccctggtgcatgccgctttttatgttagcctatgagcccttcatttcaattaggggtaatatatgccttattaacatcggagtctataggaacttattagataataaagtcatttacaacagaatgttattgaccacctactatgtgccagaactatatgcagggctggagattcagcagtgtgcaaaatagaagaggcccacaatcttgcagatgatatgtaatctggttgcaggggtgaggccattagataactataggaatatatgtataactacaaactggaagaggagtcttatgagagagtctagcagtggctacagtttgacctgaggatggaggagctgcaaatgcttctcaatgtaagggacagagatccagaggatgaatgacacatcacaggtgacaaaaggcacaagaacatgtaaggcagaagcaataggatgtgtcaaggcctcgtgccttctaaattgttgtggtacaaatggggcaatattttggtattaggtatgctttgtttttcaatgccttttacttctgcttaccacatctcctttaagcagaattcaggattttcccaatgaacagcccttaggctaagtctggtatagaaagaaacaacaatcaattgcttggcttttgagtgtttaagtagatattttaaaattaatagcatagttatatatctttaaaaccatgactttgacttgcaagatgcaggcaaagaacagaattctaaaaacttggctttaaataggagcaaaaacctaaaagtctgaatgaataaattatagaagagacaagaatgcataattacataagaactttttttttcttccaaaagaagttaatcgttcaatcatatgtgtgtgggaaagagcaatttggagaaataagatgtgatgctcactgggaaaagcatactggatattgtccctgtggcagggtagttggtatatggttgaaggtacaagatcggagcaagtgtgtgtctcattactcaaggtgtagtcaggaaaactgctagcctcatttgtccaacatggcacctgaagggttcagcaacaatggcatggggtatttaggtacttacactaaaggaaaatctcacagatacacactccagcctaggatggggtggcaaggagaagcagctgggaggtttggtgaactgggagaatctccttaactggagattcaggacacagaagtcctgaatctgtcacctggaagccttgacaagttcatggtcatcatcagcagatttaacaatgatagacatatgatgcgaaagttactcttcgttggggataattaggggagaatacacttgcctcctttttctgccaacccacacttccaaagcctcacaaaatatggttatttaggttcctagagagaaaggagtggtggtagaatcctgacaaaagttactgagttttagcgggctaaactgagttttagttggctaagcgagcttcatttggccccggtttccttccctgaccagaagtggggcaaataaactagattcaattaaaaagaaaaaatgtcttctatttttgtacagttgagttgatgaccatgtgaatttatgccagtcctacctgaagtgcaagtgttagtaacaaccgctaaccttaggtttggggcagaggccagaaattaccatatctagagcttcacagctaccttaaatttatcatcctgataaatgtctctccttttttaataccttgtagtaaattggatattatgtttattatatacctatgttcttttataagtgatcacgaggcattttagaattccttctctagagcaaaacattttaaaactgtgtttgctggatatagtattttgttcccatgtaagtaattattgaattattgttttcatattggcttgccattatagatacaccaataagttatcttgaacatgaattattaaatgttttatcttctcctacacttccccttttgaaatgatttgatgatttgtaggaatgaaatgtattgttacttgtgggaagtaattgatctgttgaagtgatggcattgaggttgtccatcattgtcctatggaggtaatttttatgtccatgacatctagtttcacatcagaaatggcgttgcttaaagacatcctttacattttgacaattgtctttactaataaaggtgaaaagtcatccttcaataacaattacttaaatttaaaagaagggaattaacttcacttcagacacaatttatgtctccctaaaacaaatttctgtgatgtgaccaatgttgatagggttacgaccaccatcctctgaagctaacattcatttcattctaaggtaaagataaatacaagtatttatttatagctcacatatttaaattttgattaaaacatcttgacatcaagaaaatgccaacatattgtaattatctaaaaatgagagaaagtaacatacagatatgcaatgggtttctctttcagttcatggaaattttatgatgagaaaagtgaatttctaaaattaagcatgtataaggacttttcttaggtgtaaaaattattttatttgttagtttgtggttaacttattaagttagtttaattgttttgctttgttttccaacctacatgagtaggttactatttgtagtattgccatgggaaataacattttggcacatttgaaaactgttttaggtcacagaaagcagtaatggagagtagtaaaattatcagttactctaataaccactagaggtctactgatatcaaatttctgtcaatatatttcctttctacaaatattttaaattaattatttcatatgaatgaaagtgaattttctcttctttgttttatgtattttttattctgtagactttaattccacttaaaattaggatctttggtaggttttagtttgttttgttgtccttgcatgttgtgtttaaatactatattatgacttatatttaaagttaatcgttaggtgctttgtgggaattaagtactttaaatatgtatacatatatatacatgcatatgtgtggatatatacacatttttatatgtgtgtgtgattgtgtgtgtgtatatatgtgtatatatctatatatatgtagatatatgaaagcattagtaaaagagaaatatttgtcttgatttttaattcagtagacaatatgagttccatttgatttgttttgtattgttttgttttgttttttgagacagtctcactctgtcacccaggctggagtgcagtagcatgatcacagctcactgcagcctcaaccactggggttcagatgatccttccacctcagcctcccaggtagctgggcccacaggggtgtgccatcatgcccagctatttgttttgtattttttgtagagaccgggtttcaccatgttgcccaggctagtctcaaactcctggactcaagtgatccacccacctcagccttcgaaagtgctgggattataggtgtgaaccactgtgcctagccccatttctttctaaggcaagaatttcctgcctggtgttagatattttcatgctaacttgtgaatgcacccctgggaatttgtagatgtgtgtgcagatcaaatataagcagagagttcatcatttaaagactcatgtttatcagtcatgttgctaaaaagagacattttctactttattataaatgttactagcaacgattttgtagaaaatttgtgtctaagaattctggaagtattaagggttactttgctattcaatatgatttaccattttgcattcttttacataaaagaaggtagtaactcgaatctgtgtgaaggaattaaggagcccatctttgaactcggacgcataggaggagctcagtacaaattgttcaagtgacttctgttcctggagtgggactcaggtgacatttgaatcactaagaaacaccctccagtctgagggtctcctgcaactgcagtactttgaacagtcccagctttcaaagcttagtaggaatatcattttcatcgttctttcaagtctaagggtaacttttgctcagtccagttaatgggcagtattttttgtcacattgttagataatcatttacactattcaggatgacctttggagtaagtagaataggccactgccaatgtgagggatttggtggatgtcagaaatggttcctcctggccgctccgtatgggtataataaagtgaaaaagtttgtgcgcactacaaagctgctaaccatggagaaagtagaggcccattctaggtcatgttctgctttgccaagccaactttgctagtgggaagctgcatttgcgtaggggagagggaaccttttcataattcatctgaccagaggaagcacctttcgtaaataggcagcccttctgtaatttactcacagatatactctatgctattgactgtcctctattaaagtgtctctcattcacctatgatagtatttaaatttttaccatcataacttggggatctgaaacttcttatattttctttcttataaaaaatttatactccccccacaaaaaaataaagccttagcaattataaatgaacacctaaaatgaaatgaccaattagtaactgggaaggctctgcaggaacttagaggttgttttctgcttttatggaaatatatatatatttcacatacaactcatatacaaaaattcaaatgcactcaaagaaagtactagaatatatgaatgtactcgtcttccagctgtaacagttatccatgtgaaaacttttcaaattggaggaagaggaacataagagaatgtgttttgacttttcataattttgtctcaccttgaccgtgtctctaatgtcatgacttgcagtaagatttacatggagtgtagcctcttccccacttttgttcaactgtgataaacatgacataggttgaacattcctaatccaaaaatatgaaacccaaaatgctcaaaagtctgaaatttttgagtgccaacatgatgccacaagtggaaaattccaaacctgacctcatgtgacaaatcacagtcaaaatgcatgcacccaacacaatttcttcagtattctcagagggaaaaaagacccttggctctattcagtggcaatatatattttctgcacactcctagattctctcacacacacccacaaaggttaataaaattgttcaatgtacataaaattgaatgcaaaaaatgatttagaatgttgggtaaagttaacttcaggctctgtatacaaggtgtatatgaaacataagtgaatttcatgtttggactttggttccatccccaagatgattcattatatatttgcaaatattccaaaatctgaagaaaaacctgaaagttgaaacaattgttgtcccaagcatttcaaataagggatactcaacctgtataatgtacgaagaattttttcactcttggaagcacttcaaaaatttcataaatatgattgaggagacaattgttaatatactgagttttaaaataatccatccatttcttaattattaagtacttactatgagccagacatttgtttattaccagggctattgcaataagcaagtcagacaaaagatactttgttaactgaagtcttaatgacttaatgagtaagccaattacataatataagctaaaacattaaaccctacatatgagaggaagtatagaaaagtaaaaccattttgtattggaacaataacagaaatactactttattctcttaagaaccatttttattaaaattgtttgataaccagaagagaaaagtccaaaaaagtatctatctgtttattacactgtgccctaatattcccttaattcttggtactcgtgaaatatcatcttccttgggctatgaaacttattcctcttccccattataaaacacatttttattattctttatgcttgcattagtttcatgatttgtgatatattgcttataaatttagataagcataaaaaatggatactataaaaactgacaattcaaagtgttatcagttaagtaaaacaatataaaaacttgcaaatttcttagtgtatgtattttttgtttgtgtttattacacaaggttatatataataccacaacaatatgaagagtgttatctctaaaatacattaaatatgatttttcttttctttagactttttgtatttttcaaaaattctataatgagcttatatcattgttaatttaagttttaatgaaataatgcatataaataatttacaatctcagatattaatatgtaatattaaaaaatatgaatattgaaaaatccaattatttgagatttacaatgttaaatattaccaaaatattccaaaaatatgaatatttaaaaaatacaattctttgactattctccttttttcttattctacaaaagtaattacttcaaatattttagctgtttcctcttattttctaatgtatttataagtaacttcttgtttttgctatttcttgattttttccttagttagacattatatattggctttttatagcattcacccattctttctcccctatcctcccaatttagtcataccacattttttggttagacattatttaattgtacattgctttggctatgtaagtgttgtccatagatgactatgccttctttcctataaaagtttttctattgtttttttcttttctggaagaaacaaatgcctagttttttatttgattgcattactatatccctattattttgtagcttcactacttaatatatacaaggctatttacatttactgttcccttttgtcacaagtgtgttttaaaagtattcagccctcttcatccatgggttccacattccatggattcaaccaactgcagatggaaaatatttattaagaaagaaatggttgtctctgtactgaacatgtacagactcattttctgtgtcattattccctaaacaatataatataacaagtattcacaaagcatttgcattgtattaggcagtttaagtaagctagagatgatttaaagtatactggagtatgtgcataggttatatgcaaatactacatcattttttataagagattgaacatctatggattttgggatatccatgggagtaccagttcccccacagagaccaaaggacgactatcacctctctattttatctaatttgcctaatttattggcttaaagtgttcagaataacactttattgtcctgtgaatttctgtagagcgtgtagtcatatcacctttcattcctgatattggtaattgatgtatttttctttttattattttcctgattggttatttcaaggggttatcaattttattaatattatcacaaatgagcatctagctatattgtgctttctctgtattttgtatgttttgtatttaattgatgtcacacttattaacttaggatttacttcattctgttagtttgcatttaatttgttttgtccctggctatttagttttaaactcctcatagctaatactagcatataaaactatatatttctttctaagcacaactttagcttccttacacatgttttgatacattttgttttcatattaatttaagcaaaaatattttacaatgttttgtgatttcttacttaaccaatagattatttagaagttggtgttcaatttccaaatatttggttttattttttagattttatattgtcttctatatataaaaaacagcttaaaaatgaaatgacggacaaaggcatttaagtagtttaaaattttttgtaacttgctgtatggtccagcacatgacctgacttggtaaatgttcgtgcgcacatgaaaataagaggtattacacagttgttttgtgtggtattctgtttatgcaaactaagtcaacttgattgatagtgtcattcaaatatatagtctttttctttttttcatctacttgttctattaatttgccataaagacatgttaaaatctcaaactacgattgtgcatttatctacttctctttaattctctccatttttgcttcatgtatactgaagttgttattaataatatacacatttaaaatgatgtcttcctattaaattgacccattggtctttatgggatgtccctgaatatctctggtgcattttgtcttgaaatctgctttgtctgatgctaatatagccacaacagttttcttatgattagggtttgaatagtgtgcctttgtctgtcattttatctttttttgtttgtttgttttttgagatggagtctcgctctgtcacctaggctggagtgcaatgctgtgatctcagctcactgcaacctctgcctcccgggcgattctcctgccttagcctcctgagtagctgggattacaggtgcccaccaccacgcccggctaatttttgtatttttaatagagatgtggtttcaccatcttggtcaggctggtctcgaactcctgacctcatgatctgcaggcctcagcctcccaaagtgctggaattacaggcgtgagctactgcgcctggcccctttcattttatctttaaactgttttgtaatatttaagatatagctctgtaggttatcatatagttaggtacattcccccctcattatgtgcgtaatatacatatactgatgctccttgtcttacgatgtgttacatctcaataaacccattataaattgaaaatattgtaagtgaaaaatgcatttaatacacctaacctaatgaacatcatagtttagcttagtctagcttaaaagtgctcagaacacttacattcacttatattagcccacagctggtcaaaatcatctaatacatggcctattttataataaagtgttgagtatctcatgtagtttattgaataatctactgaaagttaaaaacagaatggtcgtatagatactcaaagtatggtttctgctgaatctgcatcactttcatacctctgcaaagtcaaaacattataaactgaaccatcgttaagtcagggatcatctgtgtgtgtgtgtgtgtgtgtgtgtgtgtgtctgtctgtctgtctgtctatttgtgtatatcttcagcctgacaatctctgccttttaacgggagtattttaaactctatttttttagtggttgtctgggaatttcaatatgtatctatattatagcaagttttgaattcatacttcaccatattattttactttttgtttactaaaagagctttgttcactattttgttttaaattaacacaatctttgtacgtatttagtgggtacaatataaattttgatacatgtatacattgtgtaatgatcaaatcatgttttttggtatatccaccacctaaaacatctatcatttctttgtggtgagaacactcagaatcttctcttttagttaccttgaaatatacactgttgtttactattgtcacccctgctatgctatagaacaccagaacttatttctcctaactgtaactttgtacccattgaccacaccattttattttaatgtaagaattttaaaattatatatttccaattgtttcctttgttctttgtgttattgattttatatattacacttgttcataaattataagattcatgtttatattgttatttttgcttataatagccttttacaaagagtaagaagcataaagaatctttatatatacctatgtatttattatttctttcaactttcttttaagctatgtttctttctgaaataatttttctttatactgaaaaatttaccttatcatgtcttatagtgcagcttctactagtgacagattctctcagccattgtttatgggctgtgtctttattttacactcacttttaaaggaggatgttttcactgactgtataactctacactgtgaacatgttttccgagtactttaaagattgtgttcctttatgttctggcttaagttgtttatgtgcagtcagacatcattcttatggttgttcctctctatattatgtggaaataaatgaaaatcaacaaatgagaagaggcaaagtctatttattcagggcttggtataacaagggagtcagccaccatcacgttttcatttgtcagagactgaaaggcaagtagagatgtggtgaaactttatagtgtaaaaaaggcaaggcgggccgggcgcggtggctcacgcctgtaatcccagcactttgggaggccgaggcgggcggatcacgaggtcaggatatcgagaccatggtgaaaccccgtctctactaaaaatacaaaaaattagctgggcgcagtggcaggcacctgtagtcccagctactggggaggctgaggcaggagaatggcgtgaacccggaaggcggagctttcagtgagccgggattgcgccaatgcactccagcctgggcgactgagcgagactccgtctcaaaaacaaaacaaaacaaaacaaggcaaggctacaggtatgctctaattgaagactgttggcatagcgaagctggaggtgggctacctagaactggggtatcttatatgattagtgagggatgcataggactttctctggttggtcctaagttggaggcaggactaaaattaggagatctgtctgttattaatcaagtcttagccatttgggaccaattatttcagatgtttttgtttgattttgtgaaatggttgctagagatagtggtctgacttcatacaagtctgacatggaaagtaagctggcttcctgagcgggttactgtggataatgggttggttttctggactggttgctgcgattgtgggtttgtgtatttagtctctcagtcatgttcattttgtctctcttcttttaaaattttattttctctttggttttcatcagtttgcctatgatatgcctaaatgcattaaaaaaaattctgcttagtgtttgttgagcttcttagatctatgggttgatatttttcatcagttttgttaatttttcagttttctttctagaaattatccgtcttattttctctcttctcctcttttgagattctaattacataattgtatgtgtatttttgaagtttatgccacaggtcactgaccatctgttttccacttgattttacaatcttttttctcatgttttagtttagataattccttttcacttgattttaaatccacttattcattctttacccatgtccaatcttttgtaaaagggatccaatgaattttaatttcagacacttttttctacaactccataatttccatttggtgttttcttagagtttctaattttccaactaaatatcccattatttaatccactatatccatattttgttgtcaattgtttcacacatcaataatggttattttaaagcccagacatgttaatttcaataactgagttatacatgggtcttattctttttattttgctttacctttattatggataattttttccttcatgtatcttttagagttttattgtattctgagtattgctataaaagaatgattaaataataatattttattgtttttgtttatttcccagataataaatcccttttctttcaccatagttttaataatattgagttcatctttgagttgccaaacctctaatctcccagacatagctttttaaatctagtcagtacttgaactgagaggatgttgtattgcaattccagatatggttattcactatttagtttaaattggaaaagcttttggaatacaattactgtgaggatgctcagaaataagcaattctctgccaggcgcggtggcttatgcctgtaatcccagcactttgggaggccgaggtgggtggacatgaggtcagcagatcgagaacatcctggccaagatggtgaaaccctgtctctactaaacatacgaaaattagctgggcgtggtggcacgagcctgtaatcccagccactcaggaggctgaagcaggagaattgctagaaccagggagttggaggttgcagtgagccaagctcgcgccactgcactccagcctggcgacggagtgagactctgtctcaaaaaaataaaaaattaaaaaattaaaaaattttaaaaaaagaaataagcaattctcttagcattgttcctccttcactgctgctgttttcatgttacaatttagggaggaagaattagttgacacactaagatatttgtctttatatttggggctattttccattttttaaccattttgccacagtgaactgtcacctagtcttggctgatttccccagccctgcaaagcctctccctctgtagcaggtctgcttctccattattcatgcacattaatgcccacttcatgtatggaagcctaagagggtctttgctcacctcctaattttcctcccacctcactggcttttctttctcattttctttcttaattttttctcatttctcccatctctttactttgcagtgccttgtggcttcatctttggatggtttttgttgttttatatacaatcactctcttgatgatattgtctagacacatctttaactactgcctatgcactgatgactcatgtttatatctccaaaccagacccaccccccaaaccaggcttatatacccaacaggatatttgacagtaccattcaggcacaaaattaaaaaaaataaacacatcccaaactgagcttatctctttcactaaataaataaataaaataaaacctactccacctgcagtcctttccttctcaaaggcaactccatcctcccagatgctccgaccaaaagacttggatttataactcccatttttcttgaatacatatcattctgtgcatcagaagactcttatgtttgttccttctgccttcataatgtacctaaaatctgaacacttttctccactttcgagtctctaccctagtccaaaccatctcatcatttgcctggtttattaaagtagcctcatacctgatctccttgcttctactcttgtattttttcctatcctacagtagattctaagcccgatgattcttttaagactggagtcagatcacatggctttttttactcaaagccctttcagggtttctcatctcttagtgtaaaatttaaagtcctgtaaatggcatagctacaacagcctccctgctgctcctcaaacatgccaggaatacactgacttcagagttctttttgatcattggtacttttgcctaaaattcttttatctactacatttcttgccccattgcctttttcaagagtttgctcaaatataatattccaagtgaaatcttctatgattgctttctttaaatcgcaaatcctgtacaccacctccattttatgttctctataacacatcttttcttctatctatataacttactttagtattttgtttattttcttttttcacccattggaatataagtaggatgaaaaaatatattttctattttctgtatgctttatccatagaataatgcctgacgtataaaggtatttttaaatgtgttaatacattagtggctgattctttattagtcagctattgagttgtattaccaacgagtctaaagatgaagagccttctttgttttatagtaattcctgacttctttctgattattcttttacattaattatatatagagttttggaattattgttagagatagaatagaaaaagccaacacaattttcttgaacaaaggttaaatgttatcttaggaaaggaacatacacttatacttcagtgttgttttttttttttttagaagaaaagctttggaaataagaaacttttcaaatataataaattaaaatattttgtttcatagacagttttggaatactttagtactgatttgacatgcaagctttctactagccactacatgctgctttgaaaggttggggtgtacagtgtaaacatatttgaacattcaagttctatgtaaatagttcaatattgtttgtaacagatctccagaatattttctcttcatagcaaatttaaggctatattgtagtaatattttaagcagctgtgaagactcttaaataattggacacagaaaaattaagagtagctgctcacaatttaagaatggacataagaaactttctattttaatgtaataaaatgatagcatctcttgagagttgtttgataattctcaagtgaatgaatcatctgtaataaagaatgactgttttaccatataactttgcagaaaagaaaatgatatttcaagtttgccttctaaattaaattatttatacctattattttttaaaacttacacagaaattacattgaatcactgcatataaattcccaaaacaaatttaaatttttatttttgttgttagaatatatacttcaaatcaatcctgtgaacctgcttataatttttgagattaacaatccccaagtcaaattcgtaagggttatattttgaaaagctatacagatatttaaaacctctcaaagtataataactatatgccatttattggcaaagatttgaaatttcgacttcctttttataatagacaaaaatctcctctaatattcagccgaagtcctcaactaaaccaaagaaacaggtgttttgaaaattcttagaaatcaattacttagcatttaatctcttatcaaaagtttttatgtacctgtaatgagactatgtagttaatagattattcaaagttttaaaagttattatactatgtactagtgagtagacatagatttgcatgatttataataaaaaaataaaatgaagcttcactacaatttctgtgcattttgtaatgtaatgacagagaaatccatttaaaaatgttttgtgtggggtggggctcatttgcatgccagaatccttactagtagcacaattgatttaaaacattctgcattttagccttaaaaaatgaagcattgctttacatgaaattattgggtagttacttttacaatacttcatctttctctcttttagtctctaaattgtagaatgcactgtgacatcattttaacttcaataggcaggtagggaggatgcatttaaccgaaagggtaatggaaaccagtttatgtgagggttaataagctcttactggttcttagtttctttaacattttaacctccagagaaaattaataaatattaagtgtcaaaggggctacacaatcaaatgaatttatgagatgattggggatccttgagagaataaactaaattatatgtgtgtattctctttcaagcatttgctatctcttctaggctggatttctatgctagtttctaaacaagactaagctcctttctctgctaaaggacgtagtgatatcattatctaaccctttttattcaagttgactgcctgtttttattgaattgctttaataaatccaaaacatttctatagattgtttctatagattatgcaagtaactattgtatatttttcttttttggcataaaaacaagacacatatgatgtgtgtgtgtgtgtgtgtgtgtgtgtgtgtgtgttaaaaaataccatagggaataaaactcatggtttttgaaatttttatgcattacagtaattatagtaagctcctttagatagaaaatatagaacatacttgtaagatttgcaagacttaagtcaactgtatcaattttggggatactaatcatacataaagacaaaccacagaactttgtgtaatgattgacttacattgctataatacaactgaattatgtgtcatagagagtactactattaactactgcatatttatttatcattttagaatttcaaagggtagttttcataataataataatctatgagcataaattggtatttcataacttggaatgcatgctaatctatcaggataaactgtaccatagtatatgatccttaaagaacagttcccctttttaatgattagatgtagattctgcaatttctctgatactatttcagacgaacttctgaatggagggtacagggcccaaggtttttataatgttgtagtaaatgtggaggaggaaaaggacatgtgctctgaggctgcatacaatctcagacaatacaacgagtacaactgcagtattatttgcatagggtattgatggcaatcctttgttgtagctttcatttttctttattccttgacctgcttcattaaatttcagcaaataagaaaacttggctaaggatagattgtttagtcctgtggtccctgcttcactttccttggactcattctatctttcaataatgctcaccttgcaccaataaacgagtcagaatgctttgtgtttcataagtgacaatatgccaattgtattctgtaggttatatttgatttcatatgatggtctttgtagtctcataattgttaattatttctaaacacaagaaccactcaattataccagtcagtgtgtggcaaggaaaaataaatgtcagcttccaacttcataaatagagttaattgttttctctagagtggtgtaatcataataaaagcacttttgtagaactcctaggatgtgttcttttaagcaatataatatcaccttgagagaaaataatctatctttaatgtaatattcagtgatatactactgatatagtttatatatttattaattattatcatataacaaagcaacacataatatctggaaacaataatgtttgtttatatttttgtttcacatcatgatttataaagagaatgtacagacattattttatttggtcctaacaaaaattctttaagatcaacagagggttggttatgttcacttaacagataggaaagctcagatttgaagtgctgacttgtgtccaataacacattttaagtgcaagagcgaaaacctcacgtacttcattttaatactgaatatttattcttctacattgcaatttctgttgtcagagattgtaaaatttttattaaataattttgattaattatagtccctaaaacatatattttaggggtaagatggagtgcaaatggaaggggaaaataagataattagtggatattaagtaatgggatgataaggactgaaaattccacttaatttattttggaaaagcaaaatatttgcccaacacatattcctataagggagtacttgtgttgagacctttggctcagtggttctacattgctgctgctgatttcagggctgctgtccatttggctttatttcccatagtctgatcactcctgttggatcaagtcaagagatagctgtggtttctcttctccatttacttcatttgggttcagtttttcatctttcatccatacctcacccagcaatgagtgattgaggaatgagtgagatgtaaaaaatatcaaaggtaaatcactcttctctaccttttcagaagcaagggttcaatgctaatagaaaagacaatatagcatccataagtaaattctcccgtaattctatgatataaagttgattgaatgattaatggcattatatttgacaaatttgaaaatgtccaaccagttctgtatattagcaacgtttttggtttgggattttcatttacttcaaatattcaagacattttattctggatatagatagtttcttatatgaatatgcactatggctttctatctgctagtataaaagtccaagtggctttcttctatgacaatagctatagacatattttccatctacctgcctatttttattttgatatacaaaaaagttggacatttgagtaaaattgaatatgttattctatttttaaaagtcatataaccccttctttaacacattctgcattcaaaccagattaaatttatttcttagaaattttgaaaatttcaaatggggaatggaatggaaatggcaggcattattgctgctgcatgttatacacttatgaagaaagggtcatactgtacttctttagctaatttataaattccagaagaggttcggcaacttcccctccttgtcccttaggtgaagctcagatatttgagatctaattattcagtactaaatgagatctagcattattcagtgttacatttctggttatctgaagtatataactaatatctcttattatgtctcttctaccaaatttttacagccccttttcttcttttgttcctttgagtctttctgttaattattaacagcacaaactttgatatttggcatcttttaaaaaaaaactttttttttaaagttcagtggtacacttgcagaatgtgcaggtttgttacgtcggtgaacagaataccaaatacggcatgttctcattgggcatttcttattttgagtcttcagttgcttcctttgaccatttcccttagcttgccaagtcttatctttacctcacttttatctgtgctcctgctatatattttttcctatcttggtaggcttaacgtctctctcagtatatgtcattctgaataatacacagttatttcctttggtaattgaagaaagaggtagttcctgataacatgactagaggagtgtagcaactatgataaatattgttaactgcctactgactgttcaatcattctggatattaaaagaaatacaatagatatttaagacgtgatccctttatctcaattagtttataatattatgaataaaaatattgcccaatataaaaataaacagtaaatattataataaactgactatattttattgtctttcatttattcgtggttcttaggagttattactccaccatttaggagttattactccaccagtgtggaattaatgaaaacaacaaggtcgtccttcctgagccaactttataatcaacacagtagtgtcattcaagctatgttgtatatgtgccttgaaagaatgtgtttagcttgactattggttgaccttttaggtaatattttaaagccctggccaccatcccataagctcattttgtgtacatgatatttttctgaagggctctgaaactgtctcaacttataatcacagtaatgagtattataatagattaacagattaacagtgatcttctttccccatataattaggtctacaggatttgcatattgtcaataacacctcattatatttttcttacccactgtatgtggaagagtatcattaagaataatgtattccttcaacactaattcagcaaatatctttcatatatctatgatgaactgataactaagccaaatacatgtatataaacctagattttaactatgttctctcttacatttttatatcttataacatttaagtgagtgctacatgataatataaggctgtttttgttttatataaaccttggggtttctttttctataaaactcacactcttagggcgtgtcagcgtcagacatttctctaagtaattttgaagttctatcttctgaagaaaaaatgctgaatgtctgagaaatacctttgtgacttgcactacatcaagcagcaaggcaggaatgatgtctttgtgcatttacatagcacttttatttttaagaggtcagggaatttcatatggatgatctttttcacccagattttccttctgcagtagttgccaaaacatagaggaatgaaatttattgcctcaggttatgtagtccttcttaggcaccacatgtgaactttctctaagtcctggttttctttacagtgttgtctcacagatttgtccatttcctcctaaaatgaatgaattaattcaaacaacaagtattgagcatccactgttactagacactgttctaggtagttgggagaaatcaatgaacaaaacaggataaaaaacaaaacaagatcaagcaaagcaaccctttctttgtcctcctgaaacttatatttcaataatgggaagaagggtgtggggaagacagaaaataaacaccacccattaataacatacagtattttaataagaaataaatgcaatggaaaaataaagtaattatgaggaagttaggccatgtggttgggatatgtaaataagttaagccagttgattcagaaatgatttaagttcccaaccatataaagcaatatcattaaaaactagttcaaaattgaaagagtaaacacaatcctgtgtttacatattcaaatggagaataattaaatttattaattcaatcagtagacattcattaatgaccacttggtagaaagtgctgttccagggactgtgagtatgggggtggatatagtgtagattcactctcaagctgttcagagactgggggacaggatattataattacttattgctaattaaaaataaccatccaaaagcatagccctttaaaacaataaccactttagtatctcttgtgattctgtgagttgacacagcttagctggtgatgcttctgcttctcccagtgttggtgggagctgtagtcctccgaggacttgacttgcccggactgtcagaggtggctcactcaatgaccgatgctctggtgggggaaggctggaaggctcatctcggtaatgaatttgggatactagaccatttgggtctgtttctctccgggtgtcagagcctcttcctcttcatgcgacctctccctacatggtctctgcacatggtttctccagcagatagtgagacatttacttggtggctcagtggtacaaaaagtgctaaagaacttgacagaccttcccaagagttagttccagaacttacacagggtcatttcctctatattctactggttaaagggagtcccagaccagaccactccagatttagggaggttatttcacaaggagaaagttatgggtttcacagattatttgaagccatttttggaagctagtgatcccaagcgacagtgtttacaatatacacaaggtactgtggaaaccctgaagaagataatctatcaatctgggtgcattcaggtgaggcttccaagagcaaaaggatgctgagctagacattaagaaaaaaaatcagaattaaccagtcagtgaggaacaggatatgccaggaagagaaacagcatgagacatatacaggacatggcatcagaagagagtgtggtgtgtccagagaacttccagttatttaatatgagagtgaggtataaatcctttcagtaaatgctgagaaagaaggctgcataagacaaaactttgaatcgggggtattttataaaatgaagacagtactctcacagagagttggtctgaggactaaattatgtcaagtatctggcacatataaactaagcatgtgtatatatatatatatatatatatatatatatatatgtatatctatctatctctctatatatatgtgtgatttttaacattttttgtcatgataaagggtttgaatttcaaccagaagtggataggaagccaataaagaataagatttgcattttacaatgacccctttgtgcagagtccagagaatttatgagaaagatagatgctgaagaaagaataatcaatttgatggctttctaggtcaacagaaaagacatacagaaggcagaggctgtggaaaaggatttgagaaaaaactagaaattgtaagttaaatacacaacttgttttagtttccttttttcctaacatggtagatccatttaataattcattcattattgcaatatgtatattcatattttttaaggtctctcacagtgcaggcactgggttaaaaactgtggatacagtttctagttgtgagatacagctttacattcatgaagttcacagatttgttatgaagattgcaatattaatgataattacgatggaatatgacaggtgcttgctagacgtaggcacataggagtctcattacacccagatggtaaatgtctgtgagggtttttccagtaaagtttactcaagacatgaaagccagcaggagaaaattttagaaagataaaggcctcacctagcaggacaaagcaggggcaaaaacaaagagttagaaataaggaggccgggcgcagtggctcatgcctgtaatcccagcattttgggaggccaaggcgggcagatcacgaggtcaggagatcgagaccatcctagctaacatggtgaaaccccgtctctactaaaaataacaaaaaattagccgggcgtggtggcgggtgcctgtagtcccagctactcgggaggctgaggcaggagaatggcgtgaacccgggaggcggagcttgcagtgagccgagatcgtgccattgcactccagcctgggtgacagagtgagattttgtctcaaaaaaaagaaataaggaacaacaggccagcagaggaagagcacaatatagacctggagatgtgagcaggcctgttaaagtgaggagctggatatagcatagcatcattatggccagaacttagtatacaatgaagagaatgggagaaatgacatttatgagaaaaaataactggaaaattatcaacagctgaaatcaataagcaaaaaagtcatttacaattcctgaaatcatgctctgcattttttaaatccatgaagtgcagaataatcatagaagcttaaagataaagtaggcaaatgtgttagtaacttacactgtgtaataattaatattaatttttatgagcagtattttatattaacttgctatttccatagcaatgtgcaactagagctgagatgtataaggcatgattcttaccctcaaaatctttcaagtgcaacttccttcaggaaatattccttgaccatccagtgcatgtaatcatattctaatttgtatttaacaaattgcctagcaagtaatattgtcaatagatactgttacttattactattattattaataaagatagatcacagatctttcagggcaacagcagatgccactgataggccatttacccacactcctgaaattcagttctactctcattctagaaaacagatttgattgagatgttgaccaggtcaggacaatggcacgtatacaaggcaaagaacattttagttttacctgggcttaaccttaggagcccaatgtaaacagaaaccgcatagtttttcaatatagcagtattctttatctgagcaccaggtgaataaatcatgtgccaaattatgtgtgctcgtgagtgtacatatgcacatgtgtgaattttggaggaagagaggatatatgtaaatataagtacatggtggtggggaggggtagatttctttagattctcaagaactccaaacagtgtaaaatccctgccttaaggtgatgcttaactgaaattcctgctttaaggtgatgattaatattagaattgccctgtttctaagcctttaagagggacatgtcagggttcattaagcactccaggacttcctcctatgcctgaagctagagaagaaacaaatcttcctaagtcaagggttgtattgcattctactaaagccttgttcaatgttacttttcagtaaccaactatcatctttaagtatttctcagcatttcagttaaaactaaactaacagaaagtgatgttggcaagatggcaaaccaagaggcccgaggccctaattccccccttgaagacactgagttaacaatatatggaccagaatccctttttaagaactctgttgaccagttaagaagtagcggcacccagaccaatgcaaaaccaaaaaaaagatcctagtaaagttcagagaattttgcatgcccatgtccttttcttgagtcagtgtagcatagtgcacactggaggaaacattccatacaagggctcttcttttacaatagcaacaagagagtggattgtgagtcagatattctggtttgtctaggggcttcctgaagtattggtttctatatcatagcactgatgggaacagtagcagagtttggaaaccactgaaaaaagaggcaagcggtttggcatggtgggtcctcagagctgcagagattctgtagttctacaggcagatgctagaaggagcaggagattatgagctcctgagaaaaaaatgggcaggctgcttagggaatttgagagaagtaaagacatacacgagcccagaggagaaacatcctcagaaacgttttgagagtctcccaaacatatagctaggctcattgatgaaggccgttctctgcacaaatccagtgcataatggcttgggcaggtgaatgtgttctcaaatgcccaaatctcaaatatcaagaaatatcacaaggcatgcagagaaacaaagaaatgtggcttgatgaaatgtacaaaacaaaaccttggatatagaacctaaagaaaggcaaatcactgaactttctgacaaataattaaaaacaactattttaaatatggtcagtaagctcaaaaaagaacatagagagatgactaaacaaaatccagaaaacaatgtatgaacaaattgagagtatcagtgaaaaggtagaaactataggaaagaatcatatagaaattctggagctgaaaaatataataactgaattgctgaattgaaaaattatttagagagacttaatagcaaacttgatcaggcagatgaaaaaatcagtgaactttaagacaggacatttgaaatcattgagatagcggagaaaaaaaaaggaatgaagaaaagtaaacaaaacttaagggacttatggggtaccatcaatcagaccaatatacaaattatggaaattcaaggagtaaagagagacagagagagagataaaggggcagagtttatttgaagaaataatgacaaaaaacttcccaaatttgaggaaagaaacggatatacatgttcaagaaactcaaccaactgcaaccaggacgaatccatagagactccaccaggacccattacaatcaaactgttgaaagtcaaagagagttgtgaaagcagcaagggaaaaaagactcatcatgtacattatagcctctataagattatcagataatttctcagcaaaaaccttataggccaaaggaagtgtgataatattattcaaagtgtttagagaaaaaaatgctgtcaaccaagaatactacagccaacaaaataattcaaaaatggagaggaatttaagattttatcagacaaatctgaggaagttcattctactagatctactgtacaagaaatgctataagtgagtccttcaaagaatgctagatgaaaatacaaacttcagtaaagaaaaatacatggccacatataggaactagtattattataattttggtgcacaaatttacttttaattcttatataaaatttaaatgacaaaaacataaaaacaaatataaatatatgttaatggatataaaatacataaagatgtactttgggacatcaataacataaaagtagggacaataaggagtagagtaagttgttagtagtttaaaataaaatgttataatttgtttaatatgttatatataaaatatatataatatggaaatatgcaatatagaatatattaatatataacattatatagaatgttatgttacaactttaatgttttgtctaattgcaacagtaacaatgtatatgaaaggaaatgaaaagaaagtcaaagcatgccattaccaaaagtcaacaaaagacaaagaaaagcagtaagagaggaaaggagaagtaatagagctacaagacacacagaaaacaattaacaaaatggcaatagtatctccttccctaaatcagtaatgactttaaatgtaaatggattaaactccctgatcaaaagatataatttgctgaatggatttaaaaaatcaagatcaaactatatgctgtctactagactaacattagatgttaaggatacacataggctgagagtcacaaagattaaaaacatattctatgcaagtgataactaaaaaagagcagaggtgctatactaacattaaaaaaggagactttaaaataaaaatggttagaagagacaaataataatatcacataattataaaagggccaatttgccaagaaaatatataatattttataaatattcgtgcacccaatatcagagttcccaatagatgaagcaaacattggcagaattgaaggaaggaacatacagcagcacaataatagtaggagacttcaataccccacttttaataatggatagaacaacaaccaaacaaaagatgaataaggaaatagaggactagagcaattctataagctaattggacctaacatacatataaagaacactccagtcattcttctcaagtgcacatggaacattcttcagaatagacctcatgttagggtacaaaacaagtcttaacatatttaaaatgattgaaattataccaactatctagcatttaaaaataattatgtgagaatttgcttgcatcacttacaagtatgtgaatttccagtattcatctttaacattcactttcatcttactcataaacatgagtaaataaaaaaatgaaaccatatccatgttgaagtatacttgattgtcagttgcagtcatcttgattgtcactgcctacaaatataatagtttggtaaaaatcaatgtgagtattctgaaagaatcaattggatatattaaatttataatagagtattgaatattttataattcaaaaactgtgttaaaaatcttttatatcagtataattataatattgctcccccttttttggaaactggttattaaacatttatcagcatagaactgatattaccatttatctgtttcctatatgttcctaacattattttcttaagtatgtttcttaagtctggacattatgtatgaaaaatagtagagtgataatagagagggtcttaggaatgttatctggctcagagacaattttccatcttccagcagataagggggcacagatcatttgaattaaattaagtattgaactggcttgatgctgggttttagttcttataataagcttttttctccatatgtttccttccactcatagggtctaacctactggttgtcccagctgagatccaggactcctcataaaagctcttcctccctaatggtccttggctttttagtttagaactgagagtacagcaaacactactgtatttttttttcaacagttttctgtttgtctcatttgtcttttgctcttggcaatttaagagtatgcaaagccttaaaggcaaatccatagaatggtggtcttacttctctgctactaccttctctctgtaatcttgactacttacatcattgctaccatcttcaatctgaaatccattttttcttcagtattttaagagttccaaaagttctctacctattagcaatgtatgttcatattcttcgtctctcttttcacaccaaaattggtgttttccctgagggaaaaagctgcttacagaatgttggttcacatttctctgatgtccttccctcagggatcttgggctctcaagtcctagttctctcttagctgtctgatgcctttaaatatattttaatcatctatatttcaaaattagcttttctggttattctcattgggaacattggactgctccaatctattccattatgactgtatctacatgcttgttatatgatttcataagcctacctccctgtaccaggaaaaagttctctcctagattctctcgtagcattctgtgtataattttataaaaataattagcactttgaatcataaagtcctatgtttttgtccatctgtactataatactagaccatgagcttctagaaattaaatactatcttatttttctgtctattcctaatacattgcacatgattgctgctgaataaatgattgtttaataaataatttaaaagtgtgggaatagatttgtagatttctggaccaaacagccaattatttacctgacagatactccaaagtttgttttcctctatgtttgtgtttaacacattttccttaacttctttcagtacttgtacagctttttaaaaaagagttaaatgtttaagccatctggaatttattttgctgtacaaataaagtgagttataattatccttctttagttgttttttatcttagaaaaaaaaagacaatggtgtcaaagtaagggcaatttacttttacttttatagatcaaccatgtattactccacttgctagaataacatgctttttaactaaaggaatatttttgagcattgtaaacctataatggattagttattagacaaatttctatttctgtcctgatactttagtatccttagatagtatttattcactttgttttattagatattaaattatatagatgatgtgagtaaatgctagttaatatgcagataagaacctttttacatatttaatcctcattagatttttactactccctctgtgaagccttcccatattccttaggagagagttggccactctttttcctagttgcatggtgctttctttgtggctcttttatggcccttatcaatttgcattaaatgtatctttttaaaattaaaattttatccctatttctactgcctttcttattccaaaatttgaatttattttcctctgaagcactaatacttaaaatacattcatttcccctgccggaaaacacacacacacactctctcacacactagcagggagaaacttccttatagtagacatttctttctgtttggttcactatcatacccccagcacctagagcagtgtctggcacatagactatgctgagtgactgtatgcttcctgcattaaattgtgaactcactgaagacaggcacagtggtctaagcctttgtatcccagcacctactacaatatctaataaagcagatgctaaatcaattttctaataagtgataactcattctcttataaaactaaaggagatgttattgttattcacagtcaaagataatcctacttatgttgtttacttattgtttagcaaataattcttaaactataaaaagtataaaagaacaagaaatatttaaaatttagttcattgattacttgaatacatatttatttattgaattttataaaccaataataattatgtagacagatttacatttttcttctgacacatttagaattctaaagtattgtctattcactttgctttattaaatattacagtcatatagattttattaaaaatatttattttcatttattaagtatatacctgatagcagactttgtattaagaacaggggagacaaagctgaataatatttagtccctgtcttcaaggtcctaaatgacacctaacatttacatagtattttcaatatgtcaggcattattatgagaaatttatacatatttactccttgaattctcataaagatactcttattatgtccattctgatggtgagaaaactgaagcagagagagattagtaatgcagtttgtcattagagtctgtgttcagtgtctagccaaagtctagaggctgtatccaagcctttccatgaaaggcggctttttagaaaaaaattgttctcaactccgcatttgttccccttactatgtaggctccaatatttcagtctttttactcagaactgccttggggtttatatttaaaacttgttttgtgaaaagtgctgtttttcctactctcattttccctatttcccataagacaaacatattgttttaatttaccagatctgctgaatattatgttgaaaaattagggctcataaaaataatacatgaggaaaaatttaaaaactatagaatttcttgcagtagtgatttctggcattcatataaccttagttgtttataactcacttttaacatccaaatctaagttgtggcacactcaccataactacttaaataattttttctacaaacaatattgtcttcttggggaagctagacaatatataatatgatcgatgtccaggtagtcagtcctaaaggaacagcagatagtaacattatctattatagcagtaaattatttcaacacatttttaactaagaaatgatttagaaataattctggttgattgattttgaaagtaaaccatatgttgtttacatgtgttggcatttatccagtttccctgaatatgagagtgaattttttttttccaaaaaatgaaagccctttactaattagataataatgaacataatgaaaacaggtgctataactttttgaattatgagaatgcatcttcagagcaagctctgaaaagaggatcatgaagggaaaattatctgcatatattgtgaagtgggtacatatgtatcctggagatatattccaaggcacacattagcaaaaatttaacagcattttttactatgatggaaataacaaatacaaatcaaaatgagttttaaaatatgctgtctcttttaaatgaactactaaatgtaaatacatgcattatgtgcaataatgagattctagttaacatcataaagcttttcaaacgcattagggtgacaagcaagaagtaactaaagatagccctatgattttctagaaggccaatgtggcattgaatctgactaacatatagattctcacacctctgagtgacagcgacatccataaagtcctgttcgctctcagcacttgaaagaatagatgtagatgatatagattccattgcttcagccacaaaggagaataattacagacagtgggggaagggtggtatgcaggaatagatgctcctaacataaaaggttgagaaatagaaaagattacggggaaattaaggagtaaagaggacaggtcagatgactccctgggtgagaacctgaatcagagtgattgagtaaactgaacctctgctgctgggaggggaaaacttttcctgccctgtatctttccttccaattgaaaaggatgtactcatttgaatcgcagtaatgtttctgaagaaaaatgaatgttcaatgttcaaaatagtcagaactattacagtatactatcaactgtttaaaatatatattaatatacgtgttcattattttccagaaaatttaactgccatgtttgaaaataacgtatgaaatctgccctcctacaatgtggcttgatactagatctcttctgctgtggcacaggcacttaaattccggttataattatttttctaaatgattagcagttattgtgattattctctggataatatatgtatgcaaaatgtggctgcaggatttgcttttgttagcatacccctcccccaccctgaaacctcaaggctccagacgttgatgctggagagagaaaatggatgtgtgtgtgtgtgtgtgtgtgtgtgtgtgtgtgtgtgtgtgtgtgcgcgcgcctgtatctaaccttcaagttgatacaatggtgatgatatacaaacaaaaaaaaggtaaagcttctccttgatagtgccattctcaactcattgtaatcattttaaaaaatctaaaagtaagcaaaatgcttttaatttaaagggggtagtgttttaacaagctacacagagtatttaaactggaaaattattaaaactgaaaatggcacttttattaaataactctgtgatcttccagccatgttcttaaccagtgatctccctgtagcaaaatgtacagataatcaacaacccagtctgacagtaaacttgttgggagattaaatcctcaaggaaggagcccatagccctggaggaagactgagtgcatgtttccctgagtctttgaaggctcatctcagtagtcccactgctagaatgtgctccgttgtcatagcaacaccatctcctgcttcatacaggaaagattagctcttactgtgcagaggagagaatttaggggaagtcagactaatccctgggtgcacttcgagagaaaggttggacctcgcctgagggatgctggatctgcaatgatagaattggcctgccacagacattggtatttaagttgaagagcagaattcacagtaagtgtcagctcctccagagtagaatattgatgaatgaggtttgtctaagtcttgttgaagactgtcccatgaagcagtagaatgacaggagtagactctgataaatgccaatgttttcctagttcagttgttatttaaaggtctgaccagattagaaacttgaggaaaaattttaggtactttttaaatatccatctaaaatctcaggagcatggtaaaattagataagcaaaaagaatatattatatgcttttggcatttaatttatttaccctagattgttgtgcatttaaacctaaaattccatcaagagagagaaaaaatattcatggacaaatctgcatgtgtaagcaagttgtgtttcttcaacaccaaaagtgatgaaatttcattttaggtttgtaaatgtccttttctaattatgcatacatattttaaaaatccatttagaagtatgcaagtggtgtggttttttaggtcattataatatgatgaaaaggcatttttgagtgaagagcaattaatatagctattctgtttggtgctggtacttcaacttttcagcataaggcatgtgcaatgtgtatacctttcaggattttttgttgatcgcctcagatggattttgttctggggggatgtctacgtctatgtgggtttgttcattttcttttcctctttggtttgtgcttacacagttccttccccaattcttatgaagcatatgatttttagcttagaagctagaaaccttgtatgaattttaaatatttgatattagtgtctattgtgaagatatctagtctttcaaaaacttaattacctcaaaagacactttaatccacatacaaaattgaaaagaatttttcaaaactatgtagattttacatattatattaatatataacccttgtgtttatgactatcaatgggtattcccctgaatgtatttatttagtatttaaaatattcatgatgaaaattgtatcaggctacatccgtgatacatgatgttttttaattgtttccatcatgtttatatatttataacatatatttagaaactgggattgtttcccctgtgtaaaatcctgctagtaatgtactacacactacaaataacattacagtctacgctaaatatagctattatcataaaaacatttaattgccaattgaagtgtgctgttttaatttctcagaatagacagacttgggtgttgctgcaaaaacagagcacagatcacacatgcacttcttttccctgaaacttaatgctagaagagaccattggtcctagagttgaacaggtatattaaaatgttggataaaattattatcttcatatgttaggaagtacacacaaaactagaagggttatactttgcttaatagcatttgggttgtaactatgcagaacctggtactcttaagaaaatggagacaaagcaggaagtcagggagtccctctcaatgaatgatcataaattattccaacaacctttttggtgatttctattagtagttcgggataggacccttaaaaattacaaaaggaaagaggtaattgtgttccttttgtcctccccagagaacaaattaaagtagcttatctcccttcatagattttggatagcaaggagacaaaccaatgactttatttcagaaagagtgaaacttagagggtcactgcagaaggcagtgagcagaattaacaaaataggactaggaaagaaaaagaatagctaagaaaaaaataggcaccatttattgagatagcagagtaaagtacatatacatatatatatatatatatatatatatatatgtataagtaaatagtaaattttaaaaatggtcagggacttagccaatttactaccttaaccaaagtttttcaataggtattcctaaccagttaaaataaaattttatatttcttagaattctccattccctgtcttctgtgcttatgtcttttgaaaatatagtggtggctgacctagacacaaatgctggctgtcaactgaagactggcagggatttgtaatctatcttaggcaagttttggtttggccccgtctgctcttctaaggtattgcttggtgaggaccaggtcatcctccatcgtcagattctctctcgaaaggcaatgcttcaggaatctaggaaagaagttgatctattctgaactggtctcagagtttggaatggcatttggaaagtccaggagtcattttaagagtaaaaatcttcaggtcgccaaggtcttctgaaagctctgggattattaggtgatatggaaatggtctgaatttttgcatgggaaaccagagtacagaaaagggcaagaggaaggaatagacaggaaatttacaacagaaacctctgctagggaacactcaacaaacaaacacatgaaacattaatatatatttgcataatggtataatggtctgttacataaactaaggagagtttctaaaactgcccattgtgattgatggttgatgtgtgtattttaaaatatattgaaaataaaaatgttattcagcacaagagataatactataatatgaacacgttttgtatttgcttttaaaaatcagattaatgtttgatttgagcatatttgattcaatactatgatacattgttaagctagaagggccactttagaggactgttaaatagcaacaatttctattttctttcttaaattttgggatttatgctgccatgaaaattttttatctatatgctataagtttgacttcatatgtctcaggaaaattatgtcagatgctaaatttatttgttttcttaaagttgcatgtaagcaaattgataacatggtgtgtggggatagccagagcagttgttgaaattagactgtagaaagaaaagaatgtcagactggaatatgttctttcgatgacatatacttttgagggcagataggggtcaatgggcatttgtgaaccaggaatgagaagtagaagcagtgctctgttaagatatatttattcttcaaatgttgagtaagatgaataaatggtaggggtaataactggggaaggcaattaggactaagagcctaaactagtatagaaacactagaaattaagaatagaaaataaatgggaaagaaatcataggcctataatctatggaatttcatttattaatttattcaaccaagatttatttgacagcccaggctcacggcaggcagtggctcatgcctgttagcccagcactttgggaacctgttgcagaaggatcacttgaggccaggagttcaagaccagcctggtcaacagagtgagcctctgtctcaaaaaaaattaatataaaataaaagatgattaatttggcttcatccaaataacagatgaaaagatagatgataagaaggacagagaaaaatactaatgttcaagatttcataaaaacactcagtctggtgagcatgaccaatggaaaattgtattattttgtagtgggcagtgtgataaagtaagcacagactatagtcttggcccatgactgggcagcattaaagaaagaaccttcaagactgaaagtgcatgggtgccattatagacataggaaagtcaatagaaagagggagtttttgaagagagtagtggcggtaatgggaggcaggaacgaatttgattttagacatcttaagtttgatctttaagtctttaaaagcatatattgcatttaattataataactaacttactcataatgtagatcattgacaaatgtctgttttaagttatattattgcataaaatttcaaagcatctttagcattcattggactactctatatgttgtttcctctttaatattggtatatagcatttagagtatatgaaaacttgtcatgtatttttcatttaaagtatacagcttcttagtataacaaaaaattgtcttttattactggagtctgacagttctaaaatttaataacttttaatttgggaagttttatacttttgatcttggcattaatatatgataaaaataaatttgaggcaaaggaaaaaagtaaatattcagctgagttttgggaaaagcattttgtagtaattatccaattagttaaagataaaagtattttattttcttttcatatggataattgctataattttatatcattgtggtcctgaaatgatcataattataataattacaataacagcatcaacaattaacagttgtttggtactttatagtttttaattgatggagaaataaaacaattctaacaaaagatccctctgtacctatttaaaagaaagagaaataacacaattttttatagagttaagtgacataaacgtgactatgaagtctgaacagaatttcatacacatacacagtaaagtgagaagaatgagcagttacaatttctctatcttcttgatagatatggatggaactctttttatttatcccatgagagagacccctaagctaattctggaggtatacatttacagttttaatggtcagaagtccctaatcttgaattagaaagtcaaaaggttgggccttttattcaggcctatatgttttcgagatggcaccctaaagaggaaaacacactgaagagggtattatgatgaagaggcaactgcctccctgattcaaagaaaacttatcccttaacccttacactgtgcaccctttaatttacattatctcattggactatcacaacactgtaagacacatataattactattatgtcccagatttatgagtgaggaaactgatgctaagaaagatcaaggaatatttttaaagcgatataactaataaagagaggctgattccagctcattctgcacctcacattgtcatttcttatgatgcattgtagagagtcattcttgtatcctacaagaataggtgaagaaaaaattatttttattgttttttcttgggtacctatgtataactttgatctctgtaaaaataagcagattattggtcatagtcggttatctcacaaaaattcatcctactctaggaagaggaaaattgtaaagatgattggagctttaataggaaaactactgtcttaggatgcaaaagattatccattcatccatctatacatgcatacatacatatttgcatacatacattaattcatttatttgtcattcattcaatgagcatttaataaacccccactatggatctgcttttgccaaagcacactgtatgtacatgaagaaaatcatgcacactgtaagtacatgaagaaaatcagaggctttctctcccttcaaatactaccttccttgatgtggaccaggtactgggctagctactctgcaaacatgaactcatttatttgtaacacatgtactgtaatgtaaatcctacagctacccctgttctccttataaggaaactaaggctcagagagattacgtccaaaccacacaggttgtgaatgacaggactaagttctgattatatgtttttctgactgccaagctcatggtcttaacctcaatgtgattcgacctatttcccaagtgtgaaaaatgtcatgatgaagattagtgcaagatgtagtactgacagaaaggagaatgtgaggacaagttggtagtgatcgtctgggaaggctttagcacatgagatttctcttatttgtaatatggagataactagttcatggaattgtttggggaattaaaggaaataactaatataaaggaacttgctgcaccggatgcttaataactgaaagcatccactcattatcacttatctaccaatttcagtttcaattactggtcacatttctttttcttgcctttcttccttctttgattggtgtttcagaagcatttagtctattaatatacatgctacctctcctacactttacttaaacttttggaatatgattaaagatcaacagacaacttgtcaacatttgatcattcatgtgaatccactgggatttgtaattgggataggaatcatggacatattcctctcaactttagaaaataccatcatgttttctggcacagttttattctttacttgcagatagaaaggggtttggtgggagggatgtcttcagagtttttcatctgggaaaatgagccatcattactggctagggagcttgcctctttgtgtatgtagccttattcaaatatttgattgaatgggttgcagagaagtgtatgaaaattagagtaaggaaaaggcaaagtgtatagtcagctcttaaaagagtcaatgaggtcaatatctgagcccaaacatcagaatttactaaagtatattcagaactttgtatttatagaaaaaagtcttcattttttgctcctgacttcatgcctatgtataattttatattgctgcctgaacctatatttttgtaaatcacatgcataacttcatgcaacagaaaactgtttaaagattattattttgtgatagaataaattatatcccataccttttagtaaaatctatctatagcaattataaactgtagccctgtataataaatattaagaacaataatcaacattacaatatggctaaatatgacttgtagaacaaacccaaggtgtattttaaaggtagaataagaaattaactttgattgatactgtctgtaacttccaactttgtttaatatcggtcaccccaactactaaaaggttaaaatttaaaaaggaagaaaaaaaagaaaatctataatgcttttctaatgctttgaaagaagtttagaaatttagaaaatcccagaagccagggctttgttaaagaatgcagcaaatgtgaattcacttcctagaaattgctttaagcatgtaagaaatttaagggtgataacgaagtggcttttttttttcattttagctaataaggtccccatggataactatttcccatatcaggaaagagacatgtgcttcccttaacacctgccacatagaggaggatattaaggattttctttgcctttagttctttcctctgtttgccattcttcacagtagggattgggggtaaaggcccaagaatgtgatttttttcactcagtttttgttacaattgctcaaggcattgttcccaagttcttctcttaagctgagaattttaaccttttactttagccttgcttcttgttgacctcaagacttgattttcttagtggctcatcctgtcttcaaatttatatcatagtttttatcatctcaagaaaagtaacaatgctgggactaacattattagtaactctcttattttaaatatttgggttcagaggaaatagtaattgaaagcaaaatatgtgttattggacctgcaatagaaaactcaatttataatctggcaaattttttcattacgttttttcatcctagaatatttttgattatcagacaaaattatctggagtgttccttgccaacttaaatgttctctgcacccatttctaatattttgaagaataaacacttcttttactaattttacaattaaaggacgtgaatataaaatatatttctgaccaaatttatatgaacaattttctcatgggattgccctgaattctgggctgtatcaatgtcaccagagcatatcacacatggttcttttcgttgtttatcctccgtgatacctaagttagaaacacaaggagattccattaaatgatacaattgactcatttttcttatccctgcagcataaggcagtggaaagtacacagactatggcttaacacactatctctgttcgtatctcagactcacatttccacaatggtttgtgcacccatgtactaatgggctaagaacctccacctcgcatgttgttttatttcaaagttcaattgattaataaagtatattaataaaatatagatttgttttaaaaatacatattcatgattgaagcatttttcctcaggaaaatagcttcaatcacttcaaaatagtttctattttgaaaatagcttcaatcacctcaaaatagcttaatcctcaaaatagcttctatcagcaatgtaagattaataaaatattacatattcatgtgaagtatatagtcatgaaaaaattccaaaaagtaccaaaatgtataaagagaaaggaagggtcccctattcttcactcccaatctactgtgcccccaacaataatctccattaacagttcggtatgtacctttccaaacgagagataaatagatcaatcgatcgtttttattaaaaatatagtcaccaaaattttgaatacagatgcttctcaacttacaatgtgattgcatcccaacagacctattgtaaattgaaaatattctaaatcaaaatgggtttgatatgcccaaggtacttaacaccatatcttagcctagcctactttaaagatgctcagaatacttacattagcctacagttagatggagttatctaacacaaagcctgtttataataaaatgttgagtatctcatgcaatttattgaatgctgagctgaaagtgaaaaacagaatggttgtatgggtgctcaaaatgctctttcaactgaatgtgtcttgctttcacaccatcataaagtcaaaaaattgctaagttgaaccattgtaagtcaggaaccgtctgtatatgtttttcctttatatcatgattttgaatcagttgttggaaagaacattttgccaatgttttgctgatgttttcattgtgtttaaactagctgttactacaaaagaactaacaatttacaggctaaagaaaagtggaatgggattgaccacacacttatttttttggaaccattcattaattgtggcaagggttttgctgaaatgacaagtaaatgcacatcttaactttatacagaaatggaggctaagccaaataaagacttgctcttaaaatattggtctgcaaatgtctgcagagctgaaatgtgtaaattagagattcattgaagtctgctagccaaaagtgaaaatgaaagtgctttcagcttgctaattaatgctgcctgtggaatttgcaggggaaaaaaaaagccacccagacctatgagcaaaagtagtgatctggttgtcaaaagaattgtgtctcattctattatgctattatgctactcaatatggaacccttagtaataaacctgtcttttttccccaatgtaaccacttaaaattaggtgacatattctctactttgttattgtgtgacaataagacgagggaaaagaatatccaaaattgttcaaattccagaataagatatgatataactataatatatagctgagattttaatgttctgatgtctatattgtttatatattttacattttgtttcttttattgatacataatacttcacatacttatgtgatatttgtattttttacatgcatagaatgtataatgatcaaacctgcttatttgggggcacccatcaccttgagtatttatcatttcatcaccttgaaaagggtaacatttcaagttctctcttctagctattttgaaatatacagtatactgttgctgatcatagtcactttaggctgttatcaaacattagaacttgtttttctatctaaactgtaagtttatacccactcatccacctcttttcatttcccctactcattctaacacacttacccacctctggtatctatcattctgttctctgtcaccatgatactaagttttttagctcctacatatgagtgagaacatgcggtatttatcttattatacctgggttctttgacttaacataatgacctccagttccacccatgttgctgcaaatgacatgatttcaatctttgttatggccaaatcatattctactatgtatatgtaccacattttctttgcccatttgtttactgatggacacttaagctgattccatatttttgctattttgaatagtgctacaataaacatgctagtgtaggtatcctcttgatatactgatttcctttggatggatatccagtagtaggattgctggatcatatggtagttctatttttagttttttgagaaatctctatgctgtttttcatagtgcttgtactaatttacattcccaccaacaatatgtaagtgtttgcttttctccacatccttgccaacatttcttacattttattttttataatagccattctgactgggataagatgatctctcattgtggttttgatttgcatttccctgatgattactgatgttgagcattttttcatatacctattaaccatttgtatgtcttcttgtgggaattgtctgtttatgtcctttgccgaatttttaagacattatttgtttttttattgttgagttgtttgagttctttgagtattttgggtattagtccccactggatgaacagtttgcacatattctctcctattcaactgattgtttcttcactttgtagtttgtttcctttactgtgtagagctttttagtttagtataatcttatttgtctttttgttttagtttctatgctattgaagtcttagctgtgaaacctttgcctagaccagtcttgaaatgttttccttacagtggttttataattttgggtaagtgtaagtctttaatccatcttgagttgatttttatatacggtgagaaatatggatccagtttcattttttggcatatgagtatttaaatttccctgtatgtgtatcgaagagggtgtcctttccctagtatatattctttgtatctttgtcaaattagctgggtgtaaatataaagatttattttggggttccctattctgttccattagtctatgtgtttattttaataacaataccatgctgtattggttactattgccttgtaatataatttgaagtcaggtagtatgatacctccagctttgttctttttactcaggattactttggctattcttctcatttttggttctatatgaactttaagatttttttatttctgtgaaaaatgacattgttattttgatagggattgtgttgaatttgtatattgctttgggtagtatggtcatttaacaacattaattcttccttttcatgagcatgggatatctttctatttgtttgtgtcctcctgtgttattttaatcagtgttttgcagttttccttgtagagacctttcacttccttggttaagtttatttcttgggattttttgtagctattgtaagtggaattgccttcttgatttcactttcagctatttcactatggtgtacagaaatggtactgattttttctatgttcattttgtattctgcaattctactaaatttggttatcagatataagagttttttggtggaatctttggttttgctagatataggattatgtcatctgcaaagagggacaattttaccttctttgtttttgcaactgtgatgctatttatttatttatttttttaagatggagtctcactctattgcccaggcaggagtgcagtggcacaatcttggctaactgcaatctccacctctcgggttcaagcgattctcctgcctcagcctcctgtaatcctgagtagctgggattacaggtgtttgccaccacacccatctaatttttctatttttagtagagacggggattcaccatattagccaggctagtcttgaactcctgacctcaagtgattcacccacctcagcctcccaaagtgctgggattacaggcatgagacactgtgctgggctgatgccatttatttattgctattgcctcattgccttggctagaacttccagaaatatgttgaataggaatgatgaaagtgagcatccttgtcttgtttcatatcttaaggaaaaagctttcaacctttcccattcagtatgatgttaactgagggtttgttgtatacagcttttattgtgttgaggtatggtccttctatgcctaattggttgaagcttttacatgaagtgatgttgagttttatcaaatgctttttcggcatctgttgttttttcccttcattttattgatatgatgcatttcctttttactgatttgggtacatgaaaccacccttgcatccctggtataaatctcatctgatcatggtttattatctttttgatatgctgttgctttctgttgattagtattttgctggggatttttgtatctctgttcatcatgaatattggcctgtagtttcactatttgtcaaatccttgtctggttttggtatcagggtaatattggccttatagaatgagttagggaaaatttccttctctttgatttttttgaaatagcttgaggattattattatttcttctttatatctttggtggaattcattagtgaatttatctggtcctggtctttgctttgttggaagattttcattactgattcaatctcactactcattactggtctgttcaggttttctatttgtttctgattcaattttagtaggatatatgtttccagaaaattatccatttcctataaggtttctggtttgttagcatatagttgttcataatagtctctgatgatcttttgtatctctgttttatcagttgaaatgtctccattttcatttctgattttttttaatttgagtcttctatcttctcttcttggttagtctaataattattagttttgtttattttttaagaactaccttttggttttattgttttttgtattgttagtctctatttcatttagttctgctttaatcattatttttttttccttttgctgtttttgggcttagtttattcttgcttttccagttccttgaggatcatcattagattatttgaaatctacattatttgaaagattatttgaaatctttctactttttaaatgtaggcatttattgctataatattccctcttagtactgtttttgctatgtaccatgagttttgatatattatattcctattttcatttgtttcaaaaaatttttaaatttccagcttaatttcttcataacccagtggttgttcaggagtatattgtttaatttccaactatttataagtttccaaagtttaacttggcgttgatttttagttttattccattatggtctgagaaatacttgatataatttttaatctttcaaatatttttagacttgctttgtggcctaacatatagtaggtcctggagaatattctatgtgttgatgagaacacagtgtattctgcagttgttaaataaaatgtaatgtttttttaaatgtctgttaggtttatttggtctaatgtgtagtttaatgtttccttgtagatcttctgtctagatgatcggtgtaatgcttagagtagggtgttgaagtctcccactattcttgttttagagtctattgccatctttagacatctttagatctagtaatatttgctttatgaatctgggtgctccagtgttgggtgcctatatatttagaatgtttatatcctctagctgttttattgttttatcattacataatgaccttctttgtcctttttttttccattttagtgtttttgacttgaagtacattttatctgatgtaaatatagctattcctgctcactttgggattgtttattgttgcttttttggggggtggggtggggcagggtcttactctgtggcacaggctggagtacagtggcgcaatctccactcactgtgacctccacctcccgaagttcaagtgattctcatgccccagcctcctgagtagctgggactatcggtgtgcaccactatgcccagctgatttttgtatttttagtggagacagggttttgctgtgttggccaggctggtctcgaactcctggcctcaagtgatccacccgacttggcctcccaaagtgctgggatgacaggcatgagccaccgtgtctggcttcccttttggttttcttgtgtggaatatctttctccatctctgcactttcattctataatgagtctttagaggtaaagtttattttttgtgagcagtttgtagttggattattttaaaaattcactcagcaagtcgatatcttttaggaggagaatctaattcatttacattcaagcttgttactgatgtgtgagattttgttcctgtcatgctgttattttctggtttagtatattctttgttcctttattttttccttattgtctgtcattttggtttggtggttttctgtagtgttatcattgagtcctttctcttcctcatttgtctgtttgctttaccagtgagtattagttacaacgtgttttcatgatggtaaatgctgtcctttcgcttttgggttgaagactgccttgagcatttctcgtagggagagtctagtgctaatgaatttcctttgctttcaattgtctgggaaaaattttatttctccttcatttatgagggttaattttgctgggtatagtatccttcgtgattttttttttctttttagcactttgaatatgtcatcctattctctactggcccataagatttctgctgagaattctattagtctaatggagtgttcctttataggtgactacatgcttttctcttgctctttttagaattccctatttatctttgacttaagctggtttgactataatgtgccatgaagatcttgttgcattttatctgtttggggatctcagaacctcctatatctgaatgtctaaatttcttcctaaattggggagttttcatttattatctatttaataagttatagaatgcttcaattttctctttgctttatgggactcccataattttaatatttgattgctttatgggtttatcatatgtcacaaaaactttgctcattctttttattctctttatttttttctgacaaggttattttgaaaaacctgtcttcaagttctgagatttttttcttctgcttgatctagtttattgctgaagctttcaaatgtatttttaactttattcaaataattattcagttctaaaactctggtattttaaaataatatctatctgttaaattttcattcatgtcctgaattgttttttctgatttctttaaattgtttttcagatttctattgtaactcactgagtttcttaagaatcaataatttagtttcttattctgggatttcatgaatttctttttgattgggatctattgctggaaaattatggccctttaaaggtgtcatacgtttttgctttttcatgtttcctgtgcctttacattgatatctctgcatctggtatatagttattttttccaaatttctgaatttgctttcatcagggaggactttttcctgaatatgtacctatggtgttggttgagcagggcactttggctttgattttagatgtgtgcggtagtgtagtctttgtaaaacttctttgactgtaaacatcatcagtagtatctgtgattttcccagtggcttagggtgcaattgttattggaggctgtgatgaagtttttctgtgggctaggatgtcaggaaggccagtctttaggccccagtgatggcagcaatgggctgggatgcctgtccttgggtcccagagtggtgtaccctggtgtttgttggttcaggtaaacctattcttgagcctccaggtggcttactccaattctggtaggcagcagtgggccaggtgggtgggttctcaggtccctggacagctagaatggcatgggtgaaggtaacaggacaactatctggatcccacgtggtgagtgcttatattggcagtgggactgtgatgagccgagtgggccagtctcaatgctcacaggtgctatgtgcagatagatgccagctgtggtggtagctgggtgggtagtcccaacctcaggccccaggaggagtgttcatgtgcagtggtggtggactgggctaagcaatctttttgcctccagagtctgtgctctgggatgggagaagttgggcaacactgggccaggtgagctcatcttcaggcctcctgatggtgtgtgtgggtgtcagcatggtaggcaggggtggggtgatccccaggccaccatcagaatgctcaggttgtgggcagcagtggttatgctgcagccctgctactggatagggtggtgctaccttccgtggcagcagcctagcctggtggctggggaatgtgcacaccacttgcacccaagctttagtagaattcatacctaagacctgctgtggtagctggcttcttgcttgcactttctttgtgctttcaccttagacgcagtaatatttggtggttgctcacatctaagccccagaggcaagagccagggcttgtctagcacctcagctgcagcaccactagtccccggaagagtgcagtgtgttgccactggcactcgaaaatggcagcttgttgtagctgcttagatctccaggtgttttttgggacccactgtgagccctctctctggggcagtgccattgcaaggtctcccagcagctccctttgttggtttcaggacctatgaagggtgaagaggctttcctgtggcttggattgccacactccatgttggaaatgtggactgttgagggtttctcacttactctttccttgtattgaggagtctctcttggcatctgacacccagttgatttcaggtgagcagatgcctctcttccttctactttaggtagttcctgtcactttcatattgaattttagtgttttctcttggataatcatcttttgaaagtataaaatatctactcactattttgtttcttcttagtgaaggaggcatatatgaaatgcctctaggcaaccatcttgaagctcctctacaaatttttaatgagggtctatcaaatcaataagaagttagtggattattgctggtgacaactgctggtacatatcagtgacaagatatgtacaggacttggaaacaagcaatgatatatctgttgaatctaataataaatgggcttggattttacatgtcttttctttacatttcatgtttaaagttgttgcttttgttttgttttgctttacaaattggttgtccatgataaattagaaacacaggactggagtcttcatcgctgagagtttgagaagcactgcagtaggggactagcactgcgctagatacaacagagaacaaagacggacatagcctgttctctcagagcttgagtcctgggagacacccggatattaatcaaataacaattctccagtgattttgttattcaaactgagataagtgcccttcctgaactactcttctcctctctccatcccttcccttttattttctcatccattcagcccccttgtgattccctatcctgccacctctttacccattcatctctcctctccctccctctccccaccatgacttgttctccctattgtcaaccttaatcttctatttttttacatattttgatttttatatctgaaaaactttatcaatttaagcaatagagtaaataatcatctttttaaattttatttttaattgacaaataataattgcacttatttacggggtacacagtgatgtttttacatatatagtatatgtagagtagatcagagtaattagtatatccattacctaaagcatttattatttcttggtgttgagaacattcaatatgctccttctagctattatttgaaactatatattattattaactacagtaatccaaagtggtacagaaaactggaacttatttctcctatctagctgtaattttgtatccattaacacatgtctctcctatcaacaaatacaaaacaatttcaatattccaatttttgaagattattatattctcactttgattaccaaagagtatatgcctatatcccttttcctttgtcccttcctcctttccttcctttcttccatccttctattgaggaatttacttagaatctcttgagcccttgctatgtggtgaagattaggccttttgtcccactatatgcatgaccctgtttcctctccatacccccagaagaaaaaataagcaaaagaaataagaatttgaattcaggattctttgaatatttaacctagttatgctctgtcttaggatgcagtttctttgcatgtatcctttaaaaatgagtagagattaacatttatggcttttgaaaattattaagaatatcaaatataataggcattgctcctttttctagaagcccaaaaatataatcaaagtggaattttatttagatcattactttactttgactttgagataggactcattatataaatgaagaaacagtttattttctgaagcacagaatcactgaattatagtacatttcccactacttaataacatttgtaagtaatagctgaagtgatttgtatgtgaaaatttgtggaactttttcctggtttaatttactactttattttagatttttgtcactatatttattattgaaaattggttattatgttgtgttggttgtataaaatagtactttaaagaaaaattatttgaatagaatttttaaaatctcacctcttggctttgtattatctagaaaataatgctcaatccacactacaaagcgtctaaacattttatcagaaaactagagatacagagcatagtatccaataaacagaaagtttctgtgccctcagagatgttcatgtatggcatggtttcctcgcatggcaggtgttcgcagtatcaccagagaattgggagacataagctcatagcctggaaaggtacatggtggagagaaaaggccacagattatggagtcagctgctcctgagtgttaagtgggctttggcacatagatcatctggagaaagccattcaatcaggagccaaggatatgcccctgtgacattaggtaacctgggcttgctttgaggattgataaattagtaccccagtatcatttttaattactctttagtggcacctagtatctactaattaaatagtaaaatttttatgtgtgtgggctacttcaaaaaatcagggcacaagggtgtcaatttttttaagaatgatgtgtcccaataagggagacagtgatttaagggacccaagactagaatgtgcagaacagctaggccataaataaacctcactgagtttcatactgagatatcatatagtttattgtctaaaccaggatatatttgagatccaaaggggggcatgattagtaattgtactgagagaataactgtacaccaagactgtgtgaggtagaccctacacagttcccttatcttttctgtttctacgtgtctccctacttggctttctctgatgaatttggctcaagagattctaagtaaattgctcaatagaaggatggaaaaaggaaggaaaggaggaagggacaaaggaaaaagggatatagacatatactctttggtaatcaaagagagaatataatactcttcaaaaattggaatattgaaatagttttgtattcatcatggacccctgtaacttctccagctcaatgctcccctaccacttttacttctgctgcagctactaacgaagttagtggtttcaacttttcaaattttaccatgcaaatgaatcttctgggagtctggttaaaatgcagattctgatttagtaggtctgggataaagtctctgattctgtatttctaaattcactggtggttttgatgtggtcattggcccttaagaagaaagtgttagttcaaattccaagagatgaaatcctttggcctaattcatttttccggtctggctgcattggctgtgggtttgacttgtggtttcattgccctttggtcaggcgcctgccttggcagtttcagcctgggctagttgtgtggctatcaatgcagtaggctgttggcatgttgatttgtactagaagggagcatagaaatgagatgtgtacaaccaaatgatatattcaatgtaattcattgttctgtttagtttagttgcatggataaccactaaataaggatcctggaaatgtgccatcagcagtgaacactctgaatcaggtgctgcaaagctcagtaaatgttccctgtttggcttaagtaaagaaacaaggattttcaaaatagaatctactgcgctttatccaaggaaagattttatagatggccatgcttatgtgacattggtgtagcagcataaaacatggaatggggttgggggggtactatgaccagctcttgattaattagtagtaatcacattgtgagagctcttaatttggcattattcaaagagtttaaattgatacagttagtacagtaacttagattagtttttcctaatggtcatccaagacagatttttaaattttgatttgatgagaactcaatgttttattctgacagaaacagtttaaatgaaaatgaatatatataccactactataaaaaggatactcattatctgggaatcctttctattcttagttgtgtttttttcctcaaatcagtctgacattacttcttggctatcctcttactatgacaaaaataaaatatccacaaaaacaaaatgttttctcttcttctgttgattttttaaaattatattttcatttggcgatttgctgtatgtactgctttacacaaagaactgttaaagtaaggtcctcactacctatgaccatttgggaaaatatgacttacatccatgaaaaaattagtgtataatacaatataaaagttttgggctatgaaaatcatgagtttagaaaatagaataaaggtggtttagagtcattaatttatagctttatgcatttgctgaatatctactatacacaaagcataatgctggcttcaaggcatacagcagtgaagaaaagcctagcccctgtcctccacctatttgtaatttagttgatttgctcctcagaggaagaggtgttctccttggagggttgtttctcctacttcagtacctccagacattaacccccaacaattatcacttaatttttgataattcccaggatatttattgctaatcccatgattcctgaccccaacaccctttaccaaatacctattctccaacccacatgagagctccctactactgagcttgttccaaaccaccgtcatcatcacctttctctcatcatctttctcctctctatcctcctctctgttctttgctgctgagtttactttctttatattctactatttctataatccaactctttctaaagcctgccttcactgagagacaatataacatagagaaaagaatgtagaatgcgacacatgtcattaagtgctagtgttgccattaattcctcataaatctaaaattaattcattttcttcccctacataacatagcatctgtctttttcaggctcctctcctcagaatacccaaacatgtgtttcctgctgagatatactagtagaatttagatggaagtttattttggaattaggaaaccagtttctaatactatgtttgtcaacaaaacttttattgatttttcattctttaagatgtcgataaactcccttaataccactgttactgacggtaattaatttcaatgcaagagagagaaacagtaaagggaactgggtgaaattatcttgtatatcaaataatgaatttatattatttaaaaaattacaaaatatcgtttataataatatcaaagtttttagacaaaagtcttgaggctaaaggaaaagaaattatatcagttgggattgggatccatctggaaaatggagcccattccatgacatccattaggaaaatttaacactaggcactatttacagtggtgtttgaagagctaaaaagccaagcaggggttagtgaagcaactctggaattgataacagaaagaggcggctcccatagctagcagtggaagggccagggaatagctgatattactagagctcaagcccagagctcctacatgggaatcagattcacaaaagaggcttcttagcaggaactagggcatagaggatatactccccatgctggagatggagagactgcctgaaccagagagggtgtgtgcatggggagggaggagggcataaccaggcattctctctttgtccaattatccatctcttccagtgtctctcattgtctaaacccagtcataaggcactaggcaagaaaacctaggaaataaaatttgcaatagaaggagaacagatttgagaacaaaacagccaatgaccattgtgttagataaaggagcaggtattgtggatccttacagaataattattttaggatgtatttgttctgtaaatccaggaagaggttcatagctcaggcttcttgctgtctcagaatattggcaataagaaattcagctacatcaatgagtagtcctggctcacccattaccatagggagaagaactgttgaagggcaggggtaggagagtttaggagaatacctaaaggagtatacattctaatcattcacctctaagttactttaaaaacatgggtacttaacaggtctagtatgatcacagggtttctctctccgcacaaactcccaaaacacaatacacttcacctgcttgctaatggctgaaaataccaagagaaaaagcctttcattctgcaattagagataaaaggtttaaattacaactgcctagttgaagtaacatttttctgtgagggaatttcagataaaggataatcaatcaatcaatctgtcaatccattactcagtaaaatgacatacatagagccagtgtgcacacaaatagctggagaattagtgatcaagaggggaaagagaacatgcaggacccagaggacacactttgatggttttgacaattcttcccagggtgatactctttacctgctatgtgagcaaaactgatagtgacttcagcacatgtgaatgcttatatgataggcagctctactttagaaggggagtaaagattcttgattttccaaacatacacttgacccaggtaaaggccttttcttccaggggtttgttaaccaaggtaattaagtttatccttttcccccagataaggtttatagctccttagttacacatttacctttaattctttgggcaagatcatatcctttcatgagtctttttaaaaaatgggaccattctggcagtaagtatttttgtttattagttttgataaagggaaagaatatttggcttttggcttctttttctgaaatttttccagatttttataaaatgagattaaaatatcctcagattcagccttactgaacccagaattgagggctgttagtcatctttagttctgttgctatccacagttgcctcctttaattgcgtattctactgggtagttgttggatatcatctacattaatttctcacatatggctcctaagcacttatatgagaaatgcttctagattccctgacctcaaccaaaataaattaaaccaagatttctagcctttattgtgttagaggttttagtgcccacatggatcctacagatacatatttttaatcatctcccccaggaaattccaaagcaattaaagtttgagaactactaatacacatctattattcgaaatatactatgtatattattccagtatagtattccagtatactgtgctggaaagtgctaccaaggattcattcagcctacattacctgctttgtgttgcagagtaaaggcagttatggtgtaagatttaaggtatggcctagtgatagataagcttcctttgttgttgttgttgttgtttgttttgttttgagcctgggaaaagacagagcagagaccacaaggggtaaaggagagttgcacttaaactattttgcaattagatttcaaaggaatttttaattttttttcttttttggatatgaaggtactaatcttttcagcaaggctatttacatctatattttggacctaatacttagttttacggtaagatatgaaagagaagttttctaaggggggcatcaaaggactagaggaggaaaattgtggtgaatttggggaaaacaataaaatctttgtggaccctgtgagcatctgacctgaattttgggactaaatttccaagtactaatgttaaaatgaggattttatatatatatatatatatattttttttttttttcctgtttattttgcctaaggcacttggcctaaaggacatgatgctgagctactgaaagtaactgaataagaaagtaggtcaggtactttgggagattacatatacacacacacacttaaatacacacacaggtacacatatacattaacataatattttaggccaattctcttcatacagagagagctaattgttgaatatgatgctgatgaaaccacttttctacaaaatgctggtgggataacttaacagtatttctagggtctctactaattcatggagggaatggggagtagcaaaagagaaacaataaaatgaataatctgccatttactgtgttactagaccttctagacaagaaggagtctcatctgtgctcgcagagatagcacaataattctccaacactaaatccatcccatcaaaagtagccacagaacaagttaactcccgacgtccaactgccctcctgatgtcactagattccacacttccttgtcatcacattccacattctcctctgttgctaggtaccctgggcactcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttgggtaaggaagcagattacccctttaaagtgatgacctgatatgaattggttacaggagtctgagatccgcgattttaaattcttaaaaagtatcttttagggagagagggaaagagaataaaaatggttaacatgattacatgaaactcagcaatagaaaattcttaatttgtcctcagtttaatatctgcttactgttctatatggtatttttaaaataaagacatcaaaaactttgttttaaatttggatttataggacagtgttgtgagacattattgttttttaccatttaaattgcaaaatatgtgagtatgtatatttgatacaaatgagtaaatcatgtatttgtttttcttaaaacatactgatttactcaggaatgaaatatgtaacgctgttgaatttagttaccttggtaacatctggagtgaactactccatctaaaaatattttctaccttattgtttatactttttattgatataaaaacaaggcacttattaaagcctttcctgacaaataataatgtttaccttacctgaaaaataaatgaatgatataccatttattagatatacataatgatttcagattgaagaaacagatgtaggatgtttagtttttaaccaagatagatattggatttgtcttatgctaacgtagattttattttaaaatataatatatacttagggttatttaacctaataacatattgacaaagctttcatacattaaatgttactatattttttaaaggattctagaacacaaatgttaaatcactttttttcatgaattaaaaattggagttgaatattttcattgtgctcttctttggacttttgtgggaaataataaagtaataaaaatcatcttcataatttagcgtaagaatttgaattggcataaaaagaacatgcacacatttatctaaattacttatataagtcatccccttaattctgcatttcagaaaccctagacatttcatgttaaaataatattttgaatccctggattaatacctatggaaagtaccatgtaataaaaaatgtcatattatttatggccagtttcctaaattttcctatgtattttttctttccacatcaattctttctttgatgggtacataaaaagtaatttactagaattttgccatttgaacatattttaacatttttcacagggtagtcttagaaaactgtttaaaaatattatttcaggccaggcgtgaaataatattatttcattacaaattaaacttaaacctaatgtgctttgtttttatattttttattttattttatttatttatttattttttttgagatgcagtttcgctcttgttgcccaggctggagtgcaatggcgcgatttcagctcactgcaacctctgcctcccaggttcaagcgattctcctgcctcagcctcccgagtagctgagattacaggcacatgccaccatgcccggcgaatttttgtattttaagtagagacgggggtttcaccatgttggccaggctggtctcaaactcctgacctcaggtgatccacccacctcggcctcccaaagtgcatgagccaccgcgcccagcctgttttttaattttttactacagatctggcttcatcttagactcttgcctattccattactactagtcgtaccagttctattctcacgatttttctaattgtctcctctttttctgcattgccactgcttcagaagtttgagcttttaaatatgccaaattagatgacttctaaatctcttaactggtctccccaacttccattttgccccttcataccattctcctcatcagagtcagaatagtctatttgaaatataactttttccatgtcacttcccacaataaattaaaactgttatttgctcccagaataaaatccaagttctttgataaacaaaatgcttttcttggtattctctttttttcttctgtttatcttttcccattctcttttcttgcactccagactactcttacttctcacttgccctgcatatgctgacctctgtgactttgcacgtgctgatccctctatagagaatgctcttccccaacttctccacctggttaaggctcactcacctttgagaattcaactcatatcaccttctttaggaagccttctatgatgtctttatcccttgtattagatcacagccttcttgctctgcattttaatagcatgtttgtttttctgtctctcttaattatctgtgaccttgttgaagacagagtctttacaggccaaatacttaaccccatattggtcagagtaagcacttaacaaatgttagtgaataaatgaaggaacatgtgagttatatcactctttcagaatttgaatataattcccatgaatgtaattgattagaaaacattaactatttcattacatccctcaaaaaaacatacttgataacattcagaaaattaaaaatcacaagtattgaataatatttcttttgctcagccatatttatatgatttcactactagcttttaactaaatgaaacaatttaataccttttccatcataatttttaaaaatcagtagcaaatttttatcatataagataaaattaagaaaaatagaatgttatttcatgtaatctttgtctatgtgtttttttttaacaaaattgggatcataccaaccacactcttttgtagctagatttttgtgtttagtacttcatgactcacatccccatatcttaaaatgcaatattgaataactacataataatctaacaatttcaacatttatttaaataatctatttgtggtaatttaggtcatttctaattttttgctattatgaacaacactggtataaatgtttacctacaaagagatacacacaatgattaaacttcttaggtattaaactcccagaagtgtaatgactggaacaaagtttatgaggacttttaatgctttagatgcatcttaaacagtcattcagctaatactgatgcacattccaccagcaggataaatgatgctttttatcagagaatttttaccaaatctagatattctcactggaaaaacaaaaacaatttgcaaaataattggtagttatttaattctctttgtttttttttctttgagattgcatttgagattgaactgttctctcaattctgttttcttcttcctgttttatttcacttattgtgcctaaatgtgctgtgttagcccatttgcgttgctataaaggaatacctgagactgggtaatttataaagaaaaaaggattatttgggttacagccctgcagactgtacatgaagcatagtgccagcatctactcctggtgagggcttctggaagcttataatcatggtggaagatgtaggggagccagtttgtctcatggtgagagagggagcaagagagagagagaagaggtgccaggctctttttaaacaactagctctcctatgaactcccagagcaagaactcactcattaccatggggatggcaccaagccattcatgaaaaatccaccctcatgacccaaacacctgccactagaccccactatggacattggaggtcacattttaatgtgagatttagtgaggacaaaacattcaaaccttatcatgtgcctactagattaaaaataacaataactgctttacaagcttattgctgaggatgaattacatattgtatgtaaaatgccattcatataatgggagctcaataaatgctagttgaagtagactctgaatagcatattaattaaaatcaaaatataacttttcctttccaacagatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaaggtatgatcacattacaatttccagaatttttgagttggtcatgaaggtcacaaaaaatacctatgcatatagcagataaacattattgttaataaaaatattataaacaaatccaataagaggataccaagaaacttatcaccaagcatattgtgtgtttataacatatgatttcaggaataatagcaaaatgaatcgtgtctcaaagctgtgggtgtttttagatccggagaatcacttgagttaatgtttctcatgtatataatctatttgtatgaatctctctgggaatttgttgagctcagatgtgacagtttcagtctcggtacacaattttctactataaaaggatcactatctagtttctcctagatggataggtgtaagtaaagataaagtttcaattaaattcttcagtttgctttggagacctggggactttgatcagtaattttctttgtggacactaaataactgttaagtgtgagggtcctggatgaagtttgtggattaattattttaagaaatgatttatcataaattatatcatacaaaagacaaaaacatatttcagacatatctaaatgtttagattctttatattaatattagaataaagtacaaccctctcccattcccagctgacttttttttaattaagcttaaacttctgctagtttgagataacacatgctggtgactttgctctatgatttttgaaggtgtactttggaacatatgagggtttttatggaatataccttttgagtgccttccccagcccttacctctaagtcagagttgtagaacttgttttttgacatagatccttaaagcaaaatgtcttaatctggattaatttctgaatttgctaaggcattatgcttcctaaattggctctatttaaatcttctggcttgcctgggggtgtgttgttttatcctcttttaagcaagtcactggacattagccgacacctaagcactcctgcctgagggaggctgctacaacttttgctgtggcaaatgttcaaatatcctcctcagtggtttaaagccaaattacataaacacaaatgattttatatttgatgacatgatctgattcactgtgcactgtgttacattttacagaacaaaataactcctaagtttccctgccctccacgtaaacctgtctttatgaagtttaaataatcgtgaaatgctctttctatgctatgtgtctattaaatttttttctaaaattattcgatagtttgctcttcttttttttattcccttattcagtattactctgggaacgatgcttattaaaacatattcttgcacatattagacagaatgaagtgacttttctacctctgttacaatggagttgagaagcacagatggtttgggctgcttgtgagggttaagatgataaatgagcctagaagagaagaagatacccctgatgcacttaataatttatggcttagtaaatgaagaatgcttcccacagccaactgaggaatagccaaagacgcagaagaaaaatcagaagggtgtaatgtatgaaagctaagcaaagtccacctttgaaggagagtgtaggcagctccaatggacaatgttgagaaatcaaataagatgaagatagaaaatagttaaatttgtgagagaagttttgatagcacattgggaaaagaatcaagagatattatttttattattgtcttcaaaaagaacatagtaaatacttagcacctatgaaggacaaatacatctagagatataaacggcaggagtactagagctaataatatcatatcatctattgaaaatttgctaaaagtaaattttagatgttcttaccacatggaagtgatggctctgttaagttgcttacctggagtaatcatttcactatggataggtatacaaaacatcatgttgtacatcttaaatttatgcaattaaaaatacttggcatacttgcagcaatggagtaggtagcagagacaactcagaaataacagtctttattcacaaggctcttgatacttaattttgagaaagaggatacacatacatagaaaagtttcttagaacaagtacagacaatacttattctcgtattaaaacagtaagagtttaagtaagaaaatgctatttgaagtaagagtcaaaataggtttcctagaggaactgaggcttgaactttgaaggaaatataagattaccattttatttctttcagaaggggtctcttgctagacactatgaagggcctggaatgcagatagggaagatgacttggtctcaggctagggaatcattgtccattctgacctcagtatgattttatcacttcctcatggcattgaggaagaacatgacatccttttgcaggataaactagttgccaccaattaatttattctccaaatatttactaaaggattcctacatgcaagtcactgttgtaggaagcaaaaatatgtaaatgagaagagcaagattcctgccctttaaaagctcatggtctaacagtggggacaaacttgtggttacagtctgattctgtaagtgatatgagggacatatggtcaggagggtgaaatgaaagaacagaggaagggtgctgagggactgtaatgattcttcaggaaaactctaaagagagattgatgccagaggtgagtgtggaatggcaagtaggagttattctgattatgtatgggagaggggtaagcatgttttaaggcacagagccatgagagagcgtacctggcatgggtatttgcaaggagcttagcatggctgcagcagagaacaagtgtgaagggatgaagtataaagcggctccaccagtaaatgtaggtcattttaaggacttcggattgtctaatagaaagagcttagtggtcagcttagaattttagaaagcctgtggtcagcttggaattttataaaaattattctggcaacgttttggtgaatgaataggataggcactagaaaaaagtaatgagagaatgccggttagagagctattgtggcaatccaggaggaaaatattgacagttggaatcaaataactgacaatgagaaagaaaagcagagatatagtacaaaaaattactgaacatgttatttttgttcttttgacattgtatttgcaggactacctatctaacctccataggttgtattaatatattgccaaactcctgggagtgccattcacatagcctacaatatgaatagcatatttacctttctatatcccattaatgtgaacattctgtgaatataagaatgatgtttaccttgtccactgcagtatgccttacacctggcttactatctcgtccatagatgtttctcaatactttgaggaaatatacaaaggtttattgaatatggaaagcaaagcatagaggaacattctagaatgactccaagatttttggctttgttgcctaagtggatgacgaatccgtttactaagattcagaatgagaaacatttgaagaagcaggttttgacgtgtagtttacggtgcacatgcagtgtccattggacatatttaataggcattcgggggacatgtgtcagctctgaagaaaggtacaggatggagagagagagacattttaaagatttcagagcaaaagtgctgcttgaagctgtggtggttgataagatcaccttgggagagcatagaatgaggagagagttgaaatatgtcacctcgcagaatatcaatccattaggaacaagtgatataaaaggaatttgtggagaaacatatacccaaggagaaaatgaaagtaactagataagaaggggatattttagaagccaaaatgtggagcatttcaatattgatataaattgttaaactaagcgatccttagatgaagtgacattggcctgaacctgaacattggttaggagagttagtgctcagaggtggattcaaatcacatggcagaagaaacactaacagaattagtgggaaatttgattgaagacagttatagaggctgagataggaaagcagaatcattttaattgcgaaggagactgtgtctggaatttcactttagagattcttcctgcaatcttaatccaaatgtagagtgctctaggattcccgcatctggatcaatacttgctttaccccaaggctatgaagtgaacttcatagtaaagttctgttcaatctgtgcaatcttttgtagtcctcaggattgttccatcacttctgtgtgaccttttgaagtgacactacatttcttcttccttggagggctataaaagcttaattatatagaatatgtgaaaagcttagattccagtgagtttaatattgacctgtttcacaattttattgtgaataaaatcaaacaaaaatgattataaagcattgaaaaattgaacagtgaatagaagtgcttaaaacgaatagttgagttggactatgtcatttactgattacttattattatgcaaattaactcactagactagcagggaatcacattaactaatctaaggactaaatgtattgcactgaatgaagttaggtgatatttattttctacttgctgatggccgcattttaaaaggacaactaataacattagagctccaaagagggctgaaatgatgataaagagcttggaaaatgagacccatgaggaagtgttaagggattagctatatagaaaatgaaaggccaatcaaacaccaatctaggtatagatgttttaaattattaatcaatgagaatagaaagaattctaatggcagtgaatacttaaaaacactgtattattgactttttaatttttgttttctatttatcttttagtatttgtaacccagctgcattttactttatatggttaaatattctgaagcaatttcccagaagaataatgtttccaataaggactgcggtgggcacgtgattattgttgaacagtttatgtgcaactgtggttactgcatatttgggtctcagttcccaagacccctaaatcttcactttatttagtagtattttattttgtccactgtgtttcatgtaacttttttcaattaatctttaattttttaccaaaactgatactaccagttagtttataaaatattaatggtaactaacattaatatttgctatatttaatttcatttaaatatgattaatggaagcagcacaagtttcaaaatatctctttaaaaaaagaaattgtcttttacaaactaagagcgatggattgacttctgtaatattatctttgtctttgttatatggatattcctgctcattattggttcaatttaatgatttttaatgtctggcttttaggtgttatacatttatttggcccaggtgttgtttagggtagaagcaacaacatgtattcttattcagggtagaaacaacaatagtaaatgtgcttaatatgtgtgagacactctcctgagtgctagacggacaaagttaaaaaaaaagagtctctatcattaagaattcacattttggctagaaaaagcagacatataaatgagtgtattataatacagaaattgatttgtgtgtgagtctcctctaggcttacttatgccttggaaggttcctgagttaattctcattggttaaataggagatggccacttagcaatagggaatagagaattccaaacagaggaacattgatgaacagagcactgaggtaaggactagaaatgctgaagatggaagatgatgatttaagtctggagactagagtgtcagactagggaaggttttgaatatccttttgaagcttggattttactctttagttgacaaggaatcacttaagggtataggatggaaaatagtgtggtcagattgtgttttggggtaggaaaaattctggcgtgtgttttacaagatgactttaggtggcataagaagggagaagtctgctaacagagaataagacttgccttagtaaggtggtagttgggatggagaggagggcataaatttaagaaatatatagaaaattaaatggacagaattgggtgtttgattagataggtggtggagagtataaaagaaactttagccacaggataaaggatatatcagttttgatattgggatactatatcaactgtagtaatgatgaatattgtgtaatgctttcttattcataactcaaagcaacccaatgtaagaagagcaaatacagttattagctttatttaaacaaaaggaaataaactctagtgccatttaagacattccagcgacattattaatacaatcagataagtgataaagcctggtatttaacccaggtcacctgcctctgcagcccatgtaattttcgctacacccacacctgctgatgctgtgtgagaccaatcatctctctggatcatgtggtgactatgacaggcaagctatacagaaaggaatagtatctaatacaatcagtggatagcttcttgataaatagcaaatacttgcaatggcatttcttattttcttatttgaaatattagttttgcttttgatgttttagttactttataccatgaaaagaatgtaacagatgcctctatcataaaactaagcatttcttcaaagtatccttttattgctttggttcataaatgtaaatgaatgcgtaattgaatgagagtggttcttttaacagctctagggtaaattttgagcttatattttattaaataccaatttaaaacagcatcttcatattatatacatatataaacatatgtattttgcatataaacacacacacatataaatagtatattccatacttaaagatcacatattcttcagttctgctcattactggatacatttttttattatgttcttagtagattttttaaaaataaaatgatacataagaaagatataataaagttaatagctttatagtatatgtcatattgcaatctaaatttaaatgtatacaatgcttttatgaataaatacccacattactagggattgtaaaatcaactatattatatagaataatacaactttaaaatcaggaaccacttcattttacagacgaggaaattgagacccacccaaatgacctaacacccaaatcagtgtccttttgaatcattatgctaccatgtttgccattgcatatgctcatattctctatatgttattgcaggaagatgaaggacagggccattaattacaagtgcctatgcctactatgcatgttccagtccatgttggttcatttcacattttatatctcaggaaaatgaagaaggtgaggggcttctataatttatgccttgaaaagtgcaaggtgaagttgattttaattctgcacattcggtgaaatgtgcattttgagttcctttttagacatataatagttcatatgagttagtacaaaatcttaactagccctccagcttctgatgccatgtattcataaataatctggttagttatagattgtatttttgaccaaaatacaaaacaaagaaaattgacccgtcattatccttatctttatttgagggttcatcaatacctcaaaaagaagttgtctattttgtttatttttgtatttaatttttgtttatttgtttatgggctttctgttttttgttttttattttttgcttaagtgtgtgtgtgtgcttgtctttttccacttgagttctatcgttaagaataaggtcaaatgcttaaaaatatcattccagtctgtagatgccttgagaatagtggagaatctctaagagaaagaactatattttaaatactcagaagtgatttatatatgtctcaagataattgctattaccaggactccttaaaatattcaatattgacccaaatttggagaaagaataaaagaagaaaaattaatactagactcatagagttataaattctaatttgtttcaatatgctagtttacattttcattattagatgagccttacattatgcaccataaagcaattatctgtagccttcttattactatttattttatttttatttaaaacttttaattattatggctacataataggcatacatattcataaggtatatgtgatggtctcatacatgcatatgatgtgtaataatcacatcagtgtaattggagtttccatcacctcaaacatttatcatttatttgtatcagtaacattccaatttcactattttagttattttaaaatatgtaataaattattattaactgtagccaccctgttgtgctataaggtactagatctttttcattcttctaactatattttttgcaaacaacccatctgacaagagattaataaccaaaatatacaagaaactcaaagaatttgatagaaaaaaatatgataatacaatttaaacaataggcaaaaggtctgaatagacatctcccaaatgaagacatacaaatggctaacaggtatatgaaaaaatgctcaacctcattgatcatcaaagaaatgcaaatcaaaactactatgagatgtgatctcacccggttaaaatggcttttcttcaacagacaggcaataatgaatactggcaaggatatggagaaaagagaaccctcatatactattggtgggaaagtaaattaaaacaaccactatggagaacagtatggacattgctcaaaaatctaaaaatagaactagcatatatttcagcaaccccactgccatgcatttgtaaataatctggttagttataaatcgtatttttataaattgtatgttatagatatatttctaaaggaaattggtatatcaaagagctagctgtacatccatgtttattgcagcactattcacagttgctaagatttggaatcaaccgaagtgtctatcagtggattaatggattaaaaatgtattacatatacacaatggaatactattcagccgtaaaaataacgaaattctgtcatttgtaacaacacggatggaactgaaggacatgttaagtgaaataagacaagcacataaagacaaattttgcctgtgtttactcatacgtggaagccaaaaattaaaacatttgaaatcatggagatatagtgtagaatgatggttaccagagggtgagaagagtaatggggagaggggggaagtgtagatggttaataggtacaaaaatatggtatgctttttaatacttttaaaatggcgatcttagggttagctggggtcaagaggataactcagatgacaaggttaaaaaaaatagccaagtcataaactcagtcccaaggaaaaatgaaagtgtatattgagtacttgtatactatgtgccaggattattctaataactaacttatgtaattctcactgtgatccaatggaattaggctctgttagttttctcatttttacagattggaaaaccaagattcaaagaaattgtatatatgattatactaagaatttctaaaatttgtatttaaactacaaataatttaacccaccttttaaccactataatgttaaacgatcatggtgtaggccttgagaatgagtagctgcaaacttgacctgatgctgagacccccagctactagtttggggttcataattatttcccgatcaggaagcacacttatcagctctgtgactttgaacaagtctctatcttttgagcttggacagttcatcaataaaatgatgataataattcttaacctataggcaattatcaagattaaataagatggtgtgcatgttttacaataaatgaagttgctgcagtggttgttattggctccagaatttagggtttagctgaatcttgcaaaaatgtcttccattcgttaatattcatttggaagtttaatacctgtttttaatagcctaaaaaattcttactgagattggcaacttgaagaagaacattgatttatttaagctagcaaatactagttttcttttcttcttttgtcccttcttccttatttccttttagttacacttattatccaggaatctggaatatacacattcccagaggcattttataggcattcttgatcccatttctgtgagtaacatgcactcataaaatagattctaggatgtcttatctctgctccttaatatctttcctgaccccattggaatctatccaattaaactgttacttccttcataccacctctcctgatcactacctcagctagaaaaaaaaaaaaatcttttctgaacttctggaggggaagatccatgaggaatgagggcaagatggcagggtgttgggttgtaaggtagcacactaaagtgatttacatgcgtgaagcttgcttcctgtcaaatgtttgttaaataaaatgcagtgacatgggaatatgttgcattgatcttatcccatacactttttcattctggtaatttcttctcattgccatttggcttccctgaactcccagctatgcagctgactttagccttaatttggaatagagtcttttctctttcaggcaaggtgtaggcaattttacctctctgatgcatatattcccttttgaatatttcaccaaaaacagtgaatcaaatgaaataaatttccattatggtgattaaggaggattgcatcatggcgggctggtaaaggagatatttggggccttatgagctttgcattgcgattctcaaatcacaatgtgcaaacttcacgtaaaataattaagtattttttatcaattacattttcacgtatgagacaaatattttaaagtaaaaattaacctgtaatatttatttttacatttttcattaactaagatattatcactggtgttagtcctctgtattattcaggattctccagacaaatggaacccataggatagatagatagatagatagatagatagatagatagatagacagacagatagaaagtgatatgttatgaaggactggctcacacaactgtggaggctaagaaattcaatgatctgctgtcagccagctggaggctcaggaaagccctggtataggtccagtgtaagcctgaaggcctgataaccaagggagccaatggtgtaagtcccagtctgaattagaagaccataaacccaagagtgccaacatctgagggcaagagaagatgaatgttgcagctcaaaaatggagtggacttgccctttctccacctctttcttttatttgggccctcaacagattggatgatgcccactcacattggtgaaggtgatattcttctttgaccagtttaccaattcaaatgctaatctcttccagaaacatcttcaaagacacacccagaaataatatttacaagctatctcaacaccctatagcgcagtctagttgactcagaaaattagccatcacaagtcccccacttattaactcggcacccatatgcaacttcttaaaccatactgaatctccaaataaaaaaaaataacaaggagataattctgcctgacatgatacaactatactacacgtaacagaaaacaaactaatgccttacccagaagaggaggtaaaatccatgaatgatgtttattcttctgatatgcagttgcttaaatatgatgatgtaaaatgaacaataattaaataccctaatatagcgtcagtacatcttttgttatttgtgaaggaaataagacaggaaagaaaacaaagatatttgcttaatatatgaatatatacatataagcatgttcataacaaaatagggaggaaacactcctggcaattattttcctatattcagtatctagtcttgtcttgatagctggtatttataccttcttctattacccattctgtattccattttccttcaacaagcacctcagctagtcatggttcttaacttcagattaaacccaatctttctttttgaagagtatgggttattagtagccttgtttggattgggttattgtgatttttaattgaccttatatcacagggcctggtaacactaagcaatgccctaatggatctcctgtattccaaacatactcttcctcatccccactgtggagtattactcaaatttctttgtggtagcctggagcaattaccccagccagcacagcaactcccttcttatcctattgattcagaggcatgagaggctcaaagaggctgggtggcagttttgacttccagctgaacagaatcattgttgtgtctcctggtggaagcatttatctccctggaactaagacctgtaggccagcagagcataaagtcatgggaacaggaagcaaaactttttctagtctgtctctagtggtaataatgagtgataccactcccattttcactccttgattcctgggctcataaatcctgctatcaaagacacagcatcatacattaattgctgatttgaagcacatgtagcctttgaagaaccttgccccagcccttcgaggtattcacacctagctggcactgtaactgagtcttccaaagatcatcccaccattctattaatcagctgtttcaggatggtagggaacatagtaagaccaatgaattctatcaggataggcctattgccacacttattttgctgtaaattgagtcccttgattagaagcaatgctatatgaaatcccaggtagataatgcattctgtaggttcatggatggtagctttggcagaagtgttgtgtacaagaagggaaaattcatatctagagtgtctgttccttccatgatggaagcagtccagttgaatcagtctgtcaccagatagctggctggttaccccaggggatgactctacatctagggctcagtattggtgtctgctgctagtagattgggtactcagcaaattggttaatgcccagccacactggtgagggtgagcttttttactctgtttaccaattgaaatgctgatctcttccagaaacacccttgcaggcactctcagaagtaatgttttaccagctatctgggcaccccttagcctaatcaagttgacacataaaattaaccattacattttctccttagagatgtcttagaatgctgaaataatttaataaatttagtattatttggaacaatctttggatcagaactgtacaagttatcaaatattcatcagtttctatataagtatggtgccctattaaagactgagagctataaaattgtttctgaaagagaaataccagttactgaattaactaaaataaaatgtaaaaaaaagtcagtttttatatgcaaaaaatgttctgtgaaaacacaaagtaggaaattgaagaaggcttcaaggaagaaggcatgttgtatgagcccaaattataagcatcactttcatgagagaaatttgagaaggtgaaaagaaagaagagaatagtcacaaaagcagcaggcagcaaggttatctgggagaaaataaccatggagttcagaaggactgaggggtgcatgaaggcaagtcaggagaggcactttccagagggttaggcctggcaggctatttgatttttttccctgagtatggggaatcatcgaagtatgtaagcattacagtgatgcaatgagtgtgagccttggccaggaggacatctcagcactacgttgaatggtttgaggatgcaagagacagaaggtggagatcattctccagaggacaggcgtaagagccattgccagggcaggagcattgccagcctcagttttgagattatggagtttcaagtgctagaggaccattaattttggctgatagctggcaatgtgaggtcaatagtgaggatgaggcccagaaagaaaagaaatagaggcctgaagagtgtcaccaggttgccataagggaagttgccagtcagaagatctgagcctttcactaatgtatgaaagaagagaaaacagtgatgaaggatcaagatgaagcagagagccagaaaacaggaagaatccagcatagccagtcccaaagtacacgaaaagatggcaatggatcattttgaaggatgcagagagagatggagtagatggaaaagcaaaatgggccattgaattgcatgtccctggaggacaaatctcaaagcactgaggcatgaaccaatatatgatttcttcagaaaaagaaaaaacatgtagtaaaaggattcattgcatttatattagtttttaaattacttttggttataatatctgtatgattaaaacaataaaatataagataaagttggtattttaacacggtatctcaacatttacttttcagttgaatttagcagtttgagcaccaaataggaaataagccctgaaagtgcagaaatggaaaaagcataggtttgcactcccaaggcatcaagaaaagcaaggagacattaaacttgctacaacatgacagtctgataagtgcaataaagtaatattgaaagtaagtcatgaatataagaggaagattcattttattgagaggaggaatagggatgtcagtttgaggtggtctgggaagattttcctgaaaatgtcaccttacctgggttttaaaagaaaaatagtttccagccagaaaaatgaatagaagcaattttaatttgactagggtgtgtgggtttagatagttaatctctctttaactcagtttacttaaccataacatgagagaatgatctttattgcaaaaaattatttatataatcatcaacataggtttgctttttattatatgctaagccctgagtaaaatgttaaggatatgggaactgtgatgaaaatcaaatgaaaacaaaacaaaaaatatctttaaaatgtttactgttgttccaagacaaaattaaaaggtgctgtcattacatgtgttataactataaatgaatgaaatgatgctgttgacaaaaagaatcaaactctgcaaaatatttgaagagatttattttgagccatatatgagtgaccagtggcccatggcacagccttgggcgagcttgagaacttgtgcccaaagtggtcaggctgcagcttagttttatacgtttttaggaagccataagacatcaatcaatacatgtaacatggacactggtttggtctgtaaatgtgggataactggaagggagaggagtggtttcctggtcataggtggattcaaagattttctgatgggcagttgattgaaagagttatctaaagacctggaatcaataaaaagtagtgtctgagttaagataagggattgtagagaggaagtattttattatgcagatgaagcctccaggtagcaggcttcaaagagactagattataaatgtctcttatcagacttaaagaatctgtcttaaggtctgtattttgatgttaatgctggtcagctgtgcctgaattccaaagggaggagggtataatgaggcacgtctgaccccccacttcccatcatgccctgaactaggtttcaggttaactttggaatgcccttggccagggggaggatctgttagttagttgagggccttagaattttatttttagtttacaaggcagtaagtgaagcaaatgataaccaaacagtcttgctgaagaacaggagagtgtgaagtgtgtatgagaatgatgggcactagggcatccttataccagaggtgaggcagtaatgagaggagataaggcaggggccagaacaagaaggtatcatatgcatactgaagggcttatactttatcttacagggaaaattaataagaaaaagatttccagcagcaggaaatatgtggttgcatatacatttttagaaagctaaatgatatgctcttctaaatccttaaggtttttaatataatcaaagtgttagatttgcaaaagtggtagggtaaactttatttcactttttaaacaaatatttattcagggtgtacgatatgccacatatcatgccagccactgaggatgcaaaaatcaacaaaatgcagttgctaccctataaaagctcaatctattgagtgagacagctacatagataattataataaaacacatacaataataaagatactcactaggcagcatacttacatgaagaaaatttcagaaccctgggaaatatcaataaaatccagaagataatcatgtactttaatgcttgttcttaagaagttcacagaaagggtagatttttgaactaaatgctcacgtaagtaacaaaaataacatgtaaaattatgtctgcacctccagaaaaacaattattatgcaaggacacagagaatgattttgagtgggttttcctggcactcctctttttgaaaaatggggataatgtttactcatacaagtttcatataaagaattaaagaatgcctacatcatgatcccaggtttttatcttaaatgtaaatcatggtcacttcagacttcaattacagtagagtaaaatgtgagcccttaatggaactttcatgaatccacaatgattctgagtcatcatgtagtgccttttttcataaataagaaagtaaatggggacttaattggtatgagtattgcaaattcttatttaacatttagattggagatttttatttaatagtacattttgatgcaaagtgtttacattttatttatcatttaatgagtatttattaagcctctcctgtgagccaagtactgtgttgctacctagaaataccagagtgaagaagatggaggtggttcctttttctcagaggttctcatctggttgggtcacgctgttcattagcaagacgttggaggtggaacaagaagacatggtatggtcaaagtgcaggaaaagacactggtttgggtcttgggagtcaggacttcttctccagaaggtataatatctcattaggaaactaaagaatgcgtaggagctagacaagaaagaagctttgcattctaagctaaaggtctagccccaggtggaaacaaaacttggagacaagcctaagcatggcatgtttgaggaactgaaagaacatcagtgcagcaagagcttggagaatgggggggctactggaaaaaaatgagtctgaaaaagtaaagagggccacatttcaaaagtccttataaattatacttataaatttgactattgtcactactatgagtagtgaggataagattttagttttaaaactgttgagaactggatgagccaaggtggagtcaaggagacaatttaaaatgcctttgaaataatctaagcaaggtattttgttgactttgtttctggcatggggacctgggtgagtggtactacaagtcactaaggtaggtttctgtgtggatggcactggcctcaagctgctgtgacacccagtttgaagataattgcctctcctagtccatgctttcacagcaccctctattcttcccacttcagtacctaaatgtagtattatgattaatttcagtattagcacttaacgctctctatggtgaaacctgagttccagtctttatgaaatattgtctttgtctggtctgagtgcagtggtgtttacaattaattgatcacacacagttacagatttctttattccttgtccattcccattgcttcacttgacaggcctaaaaataaaaataataataaaaaaagaaatgtcatcatcgaacaggtttttcttctatgtagaaagttcattgtgtctgctttccttatcctgccccacccctctaccctgcccttgccatcacacaaacacagacacacacgcacctgcacatgtcatgttgacgtggtgtgcttctatccattacttagactgtgtcagggctatgaagtctttaagacattaatatttagcacaatttctagcagatgtttactaaatcagactagctgaaaggtaacaaagggaatattgttcttagctaatgctataggtatgggaagaataaaaggtaaggacaattatgtagtttggaattgcgtagtagaacaaacctacagtccgtgattaggaaatgtagttcgcattatttgcagcgctaaaaaattagtgctttggaatgcatgctaatctcagtctatttaggaagaattcacgtaaagagaagttgtattgaattgtaccctactatactaaaaatgattatgctttctgaaccatctatcatatagttactaggaataactgaattacaatcactcttacactgagactgttgatgtacattaagatatattgtcctaatttctaaaatataggaacatattccttaagatttactttcttgtttttctgtgaggacctaccatttcagagtttaaactgtttacattttatttttgttacattttctatattcatgtttataattcctttagaaaataattcagtatgaaatcaccatctctctctaagtcatgtttttgaatgttaataacttctttgttataacagcattattcagtacttctgagtagaaaaaatagaaattagcattttatgttgtctgcagagaagtttccaggcactgaggtattttagataacctttgcccataattaataatatggatatttttgttcccttgagatggaagagacattatcaagtgcttacactgtccagagttttaaccttttgggattctttgatttaatttgggagaatatcaccaggtctcaagaatatgatgtggacattgagatcttgatccaattacagttgcaaatctcttcctagtctttcttatcaagactgaaactgactgatatgttccgcaagaattttgccagtttaatggaaaataaagaactatgggaggaaaagactggtataaaaacatacataggtttaaatttccttactctatgatagttagaatgaaataaattgagggcaaacacaatgtttttattcatagttgaatcctaaatacccaacagagtgttgaatcgtggtatagtataacattcaaggaaattctgacattgacaatctacaatacttgcaaagagaaggttgtgttttataggccttttgactggcttcccactctgagcaactggccagctcctgagcaggttgactgtacggaccacattatctcttagaaattagactcctcatggacagtcaggataaatgccgaatgattggacaagtctacaagactatttgttatctacctaacctggatttcttggatgagatatgttcccagtcagaatgacaattgaatatcctccattttagaaatgacaaatagttttcatcttttgtcttagttgcaaatacttgctagtggcttcctatcctgctgatatattatgttctggctcagaaggaaaaattatcaattaaaagttgtcaggctgggcatggtggctcacacctgtaatcccagcactttgggaggccgaggcaggtggattacgaggtcagggcttcgataccaaccaggccaacatggtgaaaccccatctctactaaaaaaatacaacaattagctgggcatagtggtacatgcctgtagttccagctactcgggaggctgagacaggagaattgcttgaacctttgaggcagaggttgcagtgagccgagattgcaccactgcactccagcctggtaacagagcaagactctctcagggaaaaaggaaaggtgtctcatgagcatggcataggggaacacctttgccattcctgagataacgctgtacagctcaaaattatcagcatcatcttcctctgaaacatctggtcccagctcacacaggtactccactcccaaccctgtaaaggaaattaccaataaacattgacctataaaaataagctcataaagatactagtcaataaacatattatatgtacattcataattgccttagaaaataacattatatttttataatatttcttagtgtgttatattcataataacaatgtaaccattattgtgagtatatagatattataaaagaaaataaaaaaattagcattatctagccaggtgtgatggaacacacctacagtcccagctactcaagaggcagaggtgggaggattgattaagccagcccaggagttagagcacacagccaataaactatgattgtgccactgcactccagcatgggcaatggagcagactgtctaaaaaaaaaaaaaaaaaactcagcattatctgtatcaaaaaaaagtgttgagggacaatacacctacttctctgaatttagacatcataaaaatgagggagttgcactaggtggtctcttcagctcaaaaatccactgtacaaaatctactttaagttttctgaaggactgttagcaagcagtttaagaaaactgtcattgtcttctctctccacattgttttttacattctactcagcaactataagtatatggtgatgaaaaatgtaagtgaagcatgtggaaggggaagaagagtgaggaggaaaataaatacatttcaagggccatctatgtactaaactcatggaagtgttttccctgcagatcctctgtagcacatctcctggtcattcattaatttaattgacaagcaagcaaacattgattgaacacttgtcacgtggacatactgaacctgtgcctcattactgaaacactaacttttaattttcatatatttaaaaagtgttgtccaaaaatataccatctatgggcacatatctttgtttccccatatattttctctttttcaagtcagtttattcataattttgcaagctttttctctacaaatcatgtaatagatagcataaatataagaaaaggctgggcctttctttttctgcccaccagtatattcttctggcagttaatcacattttctccttcatctgttattcctgacctcaaaaggtatataatactggggagcattcatggagaaaaagagtgatttcatatagataaaaaagaggtaagcaaatctatggtttatattgaaagggaattggctaacccattccatcaactctttcttttttagtagcattatttgtaaagattcatataccatgcaattcaccaatttaaagtgtacatttcagtggttcttagtatacttgcagatatatgcaaccatcactatggttaatttttgatttccatcacctcacaaagaaacattataccccttaactatgactctctttcttcccatcttactcatctctaagcaaccattaaactacctctggctctgtagatttttctattctagacatttcacatagggaatcatatatgatgtcatctttatgactgctttctttaacatagaatattattttttaagatctgtccattttgtagtatgggtccatatttcattccttcattattcagcccaatggacaataatatgtcattgtacagctatacaataccaaattttgcttatctatttatcaattgatggacatttgggttgtttttactttttggctattatgaataatgctgctatgaaattcatgtgcaaatttttatgtgaatatatgttttcattttgtggtatttctacatatatggagtatatatataaagtatatagagtatatatacttacctataaatatatgtgtatatatttatatataaagtatatgtgtatatatttatgtaaagtatatatacttatttatatataaagtatatatgcgaagtgtatactttgaagtatagtttgatgtgaggtaatgtgatgcttgtggctttgttcttttataaccagaaaagtcaaagcaatcctatgcaaaaagaacaaagccagacgatcacattaccccacctcaaactatacttcagagccacactaaccaaaacagcatggtattggtacaaaaacagatatataaaacaatcaaaaacaatagagaccccagaaataaagccacacacctacaaccatctttgacaatgtgaatgcaaataagcaatagggaacagacaccccattcaacaaatgctgctgggataattggctgttgatatgcaaaagaataaaaccagaaacctatctttcaccatatcagaaaaactaatccaagatggattaaaaacctcaaactattaaaattctccaagaaaacctaggaaatacccttctggacatccgctttggcaaaaaattaattagtaagtactcaaaaataaatgcaacaaaaattgacaagtggaacctagttaaactaaagagcttatgcacagcaaaataaattatcaacagaaaacatacagaattggaaaaaatatatttgcgaattatgcatctgacaaaagttcaacatccagaatgcgtaaggaacttaaactaagagttgaactaccatttgacccagtaatcccattactgggtatatatacacccataggaaaataaattattttaccaaaaagacatatgtacctgtatgttaatcacagtgctattcgcaatagcaaagacatggaatcaagccaggttcccatcaacagtggacttgataaagaaaatattgtacatacatgccatggaatactatgcagccgtaaaagaagaatgaaatcattttctttctagcaagataactgcagctggaagccattattctaagcaaattaatacaaaaacagaagaccatatgttctcacttataagtgggccctaagcattaggtacacatggaaataaagatgagagcaacagatcctgggaaataccagatggaagagggaaagtgttgaagtgctacctattggatactatgctcactaccttggtgatggattcattcatacttcaaaccttagcatcatgcaatatgcctttgtaacaaacctgcatatgtaatccctgattataaaataaatttgaaaaaaaatcttggacttaaattaaaataaatagatacaaaattcatttttgcattgttcattacaaatgtacagaaatactattgatttttgtatatgaatcttgtatccttccattttcaactttctataattatttctaatagagttttaggagactgcttaggaatttctccgtatgagattatgtcatctgtgaataaagttggttttctttcttttttttccgttctaaatggccctatctccttcttatctaacttcactagctagaatctccaggacaattttgaatagaaatagtgagagcatgcatccttgtctttattctgatctttggttaattcatccagtctttcaacattaagtatgatattagctgaagtagatactatttcaagacttcaataccctacttcctggaatggttagaataactaggcagaagaataacaacaacaaaaagaagacttaaacaacattatactccagctagacctaataggatagactactccacccaacaacagcaacatacatgtattcttttcaattgctatggatcattctccaaattaggccatattctaggacgtaaagccaatcttcatgaatacaaatttattgaaatagtacaaaatgtgttctgactccaataaaaattaaattagaaatcaataaaaaatgacatttgcaaactcaaaaatatgtagaaattaaacaatacattcataaataaccattcagtcaatgaagaaatcaaaaggtaagttagaaaatactttgatgtgacccaatagaagaaaggaaagaaagggttttggtagacgtttctctgagattcattaagttccctttgatttctagtttgttaagtttttctcatgaaatgatgttggattttgtcaaatgctttttgtgtgtctattgagacaatatttttattctgttgatatgattgacagttttttagatattaattcaatatagtcctgaataaatcttagtagatcatataataggtacaattatattcatgtgcttctggacttggtttgctaatattttgttgaggatgtttgtatccatatttataaaaaatagtagtctttagttttctttctttgtgatgtctgtagctggttttggtatcagagtaatattcaattcatacataaagttggcaactgttcccttttcttctatttcttagaagagtgaataattgatagtcatctgtttttaaacgtttggtagaattcaaaagtgaagcaatttgggacttggcttttctttataatagtttttgactactaactcagtgcctacacttatatgtctaccatgattgcttatgcttaagtcagtttcagtagtttgtgtatttctaggagtttttccatgtcatctaaggtactaatttattggcatttaattgttcatagtattctttatagtcttttttatttctgttagttccctgtttcacttatatttggaacattagtttttctttcttttcattgttgatctactaaagttttgtctttttgttgaccttttcaaagaaccagcttttgattttattcgtttttgcctattgtttctctattctctatttcattaatttccactcaaatcttcattattttctttcttttgcttgtactacgttttgtttgtcctttgttttcctgtgtgttaaggtggaattttcagtttttgatttgagatctttattcttttttaatataagtgcctacagctagaaattttccactaagcactgctttagttgcatctcacaagattgggtatgttgtgtcatcattttcatttacttaaaagtattttctaacttaacttttgatttctttattgaccagttggttatttgtgcatgtattgcttaatttctacatatttgtgagtttgtgatttctaatttaatttttgttgaagtcagaacacattttatactatttcaataaatttgcattcatgaagattggctttatgtcctagaatattgtctaacctgcagaatgatccacatgcacttgaaaagaatacatatatattgctgttgttgggtagaatgttctatcaatgtccattaggtctagctggagtataatgttgtttttaggtcttctggtttttgttgttgttcctctgcctagttattctatctattccaggaagtggagtgttgaaatcttcaactattatctattattatttaattgtctagtcatctttcattgatgttattttttcctgtttattggtataatactgtattattaggttcatatagtttataattgtcatatcttcctgatagattttgtcattgtaagatgtctcgttttatctctagtagcagttttttgttttaaagtctattttgtcttatattaatgtagccactcaaccttttatggtttctatattcattatatatctttttccattcttttactttcagtatatttgtatctttgaatctaagtgtttcacttttaaaaaagttgtattttgtgttttcttttttttcctctttcttctatcaggtcaaatctactgttaatcccttctagtagatttttttattacaatcactatacttttcaactccagaatttccatttgattctttttattatttctatttattgatgtgaaattctcatcatatcttcctttacatctttaatcatcgcttctttttgtttttccaacatatttataatggctactttgacatcttattctgttaaacctaacatctgctcactcatacagtttctgttgcctatttatttccagtatacgggccatactttcctgttcctttgcatatattagggttttgttgttgttgttgtgggaaacttcccattttaaatactacaggtatttcccacctcctaacccccaacacagggtttgttattgttatttgcttgtttatttggttagtgactttcttgattatttcagtgaagtctatttttccctttctactacatcatgttaagggtctgatgttgcttctcagggaagtggagctttgggtatgcccacactcaccctggatgacagtggttttgttaagctctcttagactatttatttctctaatcacacccagctattagttgccactaattactggctgatatttctattattttcaacaatgcactggagtataatttgctgttcagactaatgctgtacagactaaggcaataaaactcaggtgcctttgaaggaatggttaccaatgtcagtgtttgagatttgttctgtccccaggaaggcacctcctaattgtctctttccttgttctctcctgcaaacttaactgccctacagtttagtctatattttcaattaatctgccaatctccttccagttgccgtccactaaaacctctatttagtttttggaagttcccttagcctaaaacttctctttgctctgttgcaaattaatttagttcctttagtaagagattaagtgctacattatggtctccttctcctcccaggcaaagtctccggagctgggagtgaggacaatgacgtacttctctccaactgacacctctaccttaggaactgagctctagtgtaggtgaagctttcattctatgagtgaagcctgattgaaagagatgtgctcccactttgactacatttacctagaacttggctttagcaataaggagctgaatgccagatgagaaatgctgagatcttgcccctcctgggtagatagccctcttactggtagctttgaatttttgctacatcagtgtagagtgaagtttctgtctcaactggaagggggttgttgtgagagtgatcttggttcaaataccacagactctcactgttattactaaatcttagctgttatttttgaatagatgtttcctcatttactgtatgtccttaggatgacttccagagactttttgttcgttgtatgttttataattttcaccaattttgctgaggtatgggtctacagagctcttcatgctgtcataacagtgttgatctggcctgttaactcttgagaagtgaaattaagtaatttaaaaagacatccataattgttaactgttcaatacatttttagggaaatgtatcagtatatcttacaccattttgaatttagactacaaaagaaaaatagatttagggttgaaacgttagaatgtgaatttatttaattttataaatcacaacttagttatgcaaatgccaagcaaaatttcaggttaagtagatcagaatggagagaaaatagatttccaaagtataaaaaccattctcatgttgtactggagtatctatcattaacattctcctgttaacatttaaagaagatctatgcacatgcttatgggggaattaacctctgaatctgtaactttattaattttatttgcagatatatcaaaagtacaaaaacctaggacttcattttgtctcattttatgcctcctattgataacctatccatgtacagtatagaattcagtttagctggagcaacactgttcgatagaaaggtttgcaaatgacagaaatgctctgctctgtctagtatggccaccactggctatgtgtggctattgagcatgggaaatatggttagtatgactcaagaacaaaatttttaattttacttaattttacctgatttaaatttaaattggtacatgtggctagctgctattatatgggagccacagggctagagtaattagctaatggtaattctgatgcattgatccatttataattcccctccctatctcacctctgtcagcacacatagaatagcactcaccaacaccacaattgtaaaaaaaatgcagtgtaatcatttcactgtaaaaataataagataggattaattgttgtatcccagagaaaccaagtatacaagataatttaatggctgtcaacagagtagatgttaaacagtagaaataaaaacatttagtttatttttattatttctaccattatattttgaagcaatgtgcaatttaaaataaaaatatacattcacttataaataaagtttcagttgggtggatttttacatgagagatccaagaaatgttgagcaatataataggtaagtttcccaaactctgtggcaggttcaatgggtggtagagtcagactgatagagaacagatgttttccatattggagtcagctagaggtggaggggtaagctagttgtggatatcggtgagaggatgcttaaggatataattaaatatttaagttgaatgagaagaaaatgaaagtgagcagagactggtagattgggagaaatttgacccaaagaattggacacctttatgaaggcaggtaacaggcatagcgggtataagatattgaaagtttgtaaatagagtaagttttaattagataattgaaaattcagattttgtatttttaaaaaagcattcattatgataacaagatctaggatatgagcttaagcctgtctggctgaaatggcatgaaaatgaatgtcatttgaattgaggagtatgtggaattactagaccagatatttgtttaaggacatggaattcactcaggacagggatgccatttaggatggaaaggaagactgtgggctaggtgataagtacttctttaaattctgggaagtggacaataggtaaatgataaagaggcaggagcagggactgtttaattggataacacagatttcaaaggaagagttattttcacgtaactgtagaagaataaatggctgtaaggggcagtgtaggtctaggagtatagcagcccaatgtctagaccttggcaatttgtaggatttggacaaccatgcagtataaatcgacaaactgcacaaataaggcagggactcagggaaggccaggttcaacatatggcaaggagaaacaggaagcatgttctgttctacaaaaattaaggggacaaagagatgtgtctgctatggaagggggtggtttcagagggtacagctggaagatctgggagtcagaggaggtaacctatgtgaaagatatacagcataataggatgtttcagagaatgagtgaagtgtgtacattttgggtagtgaccagttatgatctgatgtgagatacaaaaaaatagctcacttctattttctaagagaggttattttgtaaagttgttttgctgtcactaaaactgacaacttctttatcttcctgtcacaattacaataccttatttgatttttcatcatacacttcaaagtctaaaattatcttgcttacttgtttttgattatcttccctccctagtacaagatagtttcccatgagaacaggatcttgtgttttagtctgctactacacctcagcctctagaacagagcctggtacataacaggtgctcaataaatatttggtaaacaaaataatcaactcatttatattctgatatgtgatcatgagtgggagataagactaaaggagttatacgttgtttaatgaacattgcacgtgctatatagggcataatgatcatgtcacagctataatgaagtaacagtaaggaaattgtaacacaggtatggtaataccttttattttgtcagacatttacacagtgctttaatatgccaggaactattctaatagctttactaacatcaactcttttattatgaatgatgaattgttatacttccctagtaattccttaaaaacctgcttcgtgctctataaatatttggcttcaatctttgaaatatgctgagcatgagaatgtcatcttccctctgtctctacagaaaataaatattataaaaagattaagcaaatatccttagtagatcttcatttgggctactctttacaaaattgaatctttctttttctaatgccacacaataaccattcaatagatgctgtattaaaagttatctcttggcttggtttctagcaagctattttcattgtcttgtgtaaatacatgtatgctataaatttttcgtatttttttactcagctggttcataattattaacaaatgccaccattcaacttactaggatgcaatggtgaatggcagcgtatccctttaatatcactaaccagcctatattttaggccttcattcagaatgacttgccaatgatttttttttttttttttttttttttttttgtagagatggggtctcactctgtcacctaggctggagtgcaatggagtgatcatggctcactgcagcctcgacctcctgggctcagttgatcctccccacctcagcctcccaaatatctgagactacaggtgtgcaccactatacctggctaattttttgtagaaatgggcttttttatcttgcccataccagtctcaaagtcctgggttcaagcagtcttccagttggcttcccaaaatgctgtgattataggcatgagccactgtgcccagtcttgccaataattttaaacctctattttaaataacttgataaaaatttccaaattgtacttggttccattgcccgcagaaaaggaagaaggtaaaatatagaggctttcaaggcctttttttgtctttgacagaattccaatatatacagtgtatataccatgtggtgtagatgtcttcttttccttccccagaggatgcatatctggctatcttgggtgggggcgggaaacaagtgtctgcatccaggtaatcaattttactcactcttcagctgtgtcaatctacatcatctatactgggttgagcctcactgcctccaaatctatagtaatcagtgggggaatgctttttgtgtttcaagagtccacaaagaatctcatgcccatgaggagagtaactatgaaagaggagctgcccccacctctcctgcatcttcttacatgaacagggtttcatagtttggaccatttcctgggttgagtaatctttcccaaaagaaatgatcaggtctcaagtatctttttatgtttgaacatttcacacttctagcatcctctgaaactgaaatctccacctttgtctggttttatggccactcccatgtatagaagtagggaggtctagtgatagcctcttggggtggggaagagtggaggaataatattgacagtaggcattttacttctctggctaagggtttaatttcctccgaagtgtagagtcaattacaccttgccctatgacagtgtttttctttttcaaaaacaaccttatggcctgcataagaatttcatatttcattaaaaacatttggaccttgttttctaacctggaaacccaagacttcatatgctaagtgagcccttccccctgtgtttgacctcctccaggaaaatggcaggaaatgacgagtttcttcttggttcttgattttcttctttggttaggaaagtagtagggtagtgtatgtggagtggggagggtgctttcacttcaccaagctccgctgataaaagcagaaatcatctggcttcagtatgcattgggacatcagggtggctccaagtctcctcaattcagcctgcccactggtgcctacctactgctatgcccttccttctaggtggctgctagtccataggagatcaaccgtatactgggaaaagaacagtgtttagattcaggagacctaggaataaatcctggctctaatacctttgtcactttgggttaattatttaatctttctttgtctcatataattcatttataaaaatgagaacactgatactttcctgcagttatcgttgcttttggaatgaggattatcacagattctaaatccaaacacacattgtgtgctgcaaaggatcaaatatgggataattatattcttttccagcttaagaccacaaaaacaggctttgcctcattattgtgcaaaccataacagttctgagctcctacttagtcagggagtgaattgttttcccctgctgttctcctccccatgtcattcctagaagctttagtgaatgctttccagtcattctcgtgatcaagtgtcattcatctatggcatgcttctgtgaagctttcagggtcactttccaactgctgtatgatgtactttccaagctccgatcatgatcacggtcatttcagcccctatcccccaaagcaaataggccctagtgttatttttcagtctagcttttatggtatactttatatacaacaaaattcaccatttttagtgtaaagtactatgagttttaacaaccatatatagttgtataactaccaacaaattaagatatagagaagattcactataaaatcccaaaaaatatccccccaaattcccactttccattctggagtacatgcctgccccaatccctacccactgacaatcactaacctgttttttgtctctatatttctgcctttttcagaatgtcagatcagttgactcacacagtacctactgattagtatcgcaatatatggatctaccacaatttatttaccaactgaagcacatttgtgctttctccagtttttttgcaattataaataaagtggctgtaaacatttacaaacaggtttttgtgtgaacttatgttttcatttattttgggtaaataagtgtgagattttttttgattctataaacatatgttacattttttaaaaatgcccaactgattgtcaaagtggctatatcattttgcattctggcaggtaattctttccagtgactctacagtagtcccccgatctttggtttggctttccatggtttcagttatctggggttaaccatggtccaaaaatattgaatgcaaaatttcagaaataaacaattcatgagttttaaaccattctttgtcctcagtagtgtggtgaaattttgtgctgatcctctcagtcctgcctgagttgtgaatcctccctttgtccagtgtatccacactatacatgccttctgcccatttgtgtttttataaaaagttcaagggcatatttagttatttatttagctgtttggactattctgtttcatgtaaattgacacctttacattatactttggtttacagttcctctgagttgtaaaataaaacaatattatttgcttttgtccaaaaagtaatagatcaatactggatttcaaaccaatatattgaatagccacaattacagtttttaacaaatattactttcaaattcataaatataagagaatataacatggtttgcctcataaagtacttgttgatttacataattagaaagttcgtatcaggcacacttgcttttcttccttgatttattttattttactttggctaaagaataaagccaaatcattttattttcataaatggcatattctataaagccaagaggtttatttgatgaaaagtttatgaccatttctagtgattatttattcatctacatatctatatcccaatttcttcatctgtaaaatgtaagtaggtgataaccattggctctttgattactctcggctcaagtctatgatgaggcaatagatttagagagattaaggaagtcagaactttgcattcattttaaatctacttctgtatttcatgcctttcccaacatacaacaaagatagattatggataaaactttacccactaatctgctgaatgtacagcatttgctacaaaactaaaaattttgatagcactttatttcacccctattgtgacagttagtgggttttgctataatagaaaatattgaggaagacaagacatgagggtcttttcttattagcctagaggaaaaacaaattggagtgactaaaaggcgatttttgaggatcaggtctaaccgtgataataaatcattggtaagcaaaagtgatggtcctgaaagtttcatcctctcaatagatgacataaaataatttgtataggattgaaaaacacaaacaaaatgtgaaatacttgataacattttatgtaatcaaaatactggaaattaagatatttagaaactcacaattatgtgcctatcaaggttttatttccccattggtcagaggatatgtgctgcctcaccaaatacttttagattcctgaattcctcaggtgtcgaaaacattaccctcaaaaataacctcgtgtgagattttacaactgtggtaaacatttagagttgcttctttaaatttttaagaaagttttaaagctaattgttaaaatagttaatgttactcatttgatgcattatatcatcttttttctttgggaaataatttttgatcagtttttgttctgaaacactatctcatttattcctcattataatcctgtgaggtaggtactgttattattctgtttttaatgaaggatctcagacttaggtaaaataaatcgtccaaggtcacacaaataacaaaagggggaaggggaatgtgattgcttaagttaaagatagtccttgtacaaatgctaacactttgtaaaatcttgaggccatatcacccttttccagagtcgaaaaaatgtagaattcactaggttttgtgttattgttgttttgtattgttttacttcaaatgataaaattgaccagtgtattagtctattcttgtactgctataaggaattacctgagactgggttaatctaaggaaagagctttaattgactcacacttcctcaggctggacagcatctgcttctggagagccttagggagcttttactcatggctgaaaggcaaagagggagcagacgtcttacatggccagagcaggagcaagagagagaggaggggaggtaccacacacttccaaacaaccagagttcatgagaactcactatggtgatgatagcaccaagggggaatggtgttaaaccatgagaaaccacccccatgatccagtcacctcccaccaggccccacctccaacactggggattattattgaacatgagatttgggtggggacacagatccaaaacctatcaactattatagcattgggaagcttgcaaattctcatgcaccaacctagagggatatttctatgtaagtctgatatatatggtgtctatcctgaggtatatttcactgtatatttgaccctagggtaagatatgagtgaaaattagatcaatactcattctgcattctatttcttcataatttgttgtgtactatgaatgtattgagatttcgtttgttggtaaagaaataatgtctccttagtttctttgttgttgactagatattgccctaatcaagaaaacattttttttgaccctctcacatgtaaggtatgaggactcgatttcctatgatcctggaaaatattttttcacaggctatatcttggttgaaacccaaatgatttctttagtctgtctcaaattatgtgcaagcaaagaaatacatcatctttaatacattactttgtaaattaggcattagatttttactattttttctattgttaatttttaattagtactacttaaaattgtcaatatttgacttttttttgactcatataacaagtctgtatgattcaatctaacatgaatgcaaaagggcaactaagcttttggtttaacttcatgttaaagaatatttttaaaaagtgagggaagagtgaaaaagaaagccaaagattcagtgagtggtttgaaagcaacaatgtttaaatatatatgtaaatatatattatgcatgtttacatatatgtgtatatgtgtatatacatatgtgtgcatatatgtgtatatgtgtgcatatatgtgtgtatgcacctcctatttatatatatttatacatacacatacatatacctaatatttatatttggtttcataaatatgtgtatacatatatatgtgtgtgtatctgtgtgtgtgcatgtgtgtgcgtgtgtttataccacctatgtatacctctcatctacctcctatttccacatgcacataccaactcttctactatcaacatccctcaccagaatggtacatttgttataatcagtgaacctacaatgacacgttatcatcacttaaagtccatagttcacattagggttcatgctcagtagtgtacattctatggctgttgacaagtgtatacttatattatagtatcatataaaatagtttcagtatcttaaaatcctttgtgctctgcccatttatcccttcctccccctaacccctggcaaccactgatctttttactgtctccatggttttgccttttttcagaatgtcatttaattggaatcatatagtatgtagcttttaagattgtgttatttcacttagtaatatgcatttaagattcttgggctgggcacagtggcacacacctataatcccagcactttgggagacagaggcaggtggatcacctgaggtcaggagttcgagaccaacctgaccaacatggtgaaaccccatctctactaaatataaaatattagccacgtgtggtggtacatgcctgcaatcccagctacgtgggaggctaaggcaggagaataacttgaacccgggaagcagaggttgcagtgagccgagaacgcaccattacactccagcctggggaacaagagtgaaactctgtctaaaaaaaaaaaaaaaaaaaaaaaaaatcccattgtctggatataccacagtttatttacacatccacctgctgaaggatatcttgggttaaattgtgtccttactgattttctgcctgttggatatgtccatttctaacatttgttgaagtctcaaactataataacagactaatctatttctccctgtggtactgttggtgtttgcctcatatattttgatgctctgttgttaggagcatacacaatacagattgttctgtcttcttggagaattgacccatttatcattaagtaatatccttatttatccctgataaatcttctggctttgaagtctgctccatctgaaattagtatagctactccagcattcttgattagtattagcatggtgtatctttattcattcctttatttttaaattacatgagtatttatatttgaattgggcttcttgtggacagcatgtggttggatcttgatttttgatccactctgactatctctgttctttcattggtatatttagaccattgacattcggagggattattaatatagtttgagtaatgtctactatgtttgttactgttttctattcattgcctttgttctttgttcctgtttttgtcttgccctcttttcctgccgtatgcaattttatttgagcattttatgtggttccatgttctctcctttcttatcgtatcaattatatttttatttttactgtttctagtgcttgctctagagtttgcaatagacattcacaatgaactcaagaccaccttcaaataagactatatagattcatgagtagtacaagtaccctataacgaaatactcctaattcttccctcacttctcttatgttcttgttatcacacatttcatttatagataaactatggttattgtacgattgttgctagtattattaaaacacagttttatctgttagataattaagaatgagaaaaaatatttttatttgacctccacttatgcttcctctaatgctctttgaaaaaataagtccaagtcattaacctatattatttccttcaatctaaagagcttcttttaacatctcctgcaagccaggtctcctggtaacacattctcttattattttctgttttttagtctcagaaagtattcctccttcattttgagtgattatttttcaagatacagaattctagttagctggggcttttttaatcatcactaagtatttcactccaatctttttgtttgcctcgtttctgagaagtcagatgtaatttttatctttgctcctctctagctaagttgttgtattttctggcttctttcaagatttttctttatcattaattttctgtagtttgactataataaggctaggtgtagtttttcccacatttttcttgtttggtgttttctgaatttcttggatctgtggtgtggtgtttgacatttttttttttaatttcagtcattgcttcaaagattctgttttttctctttttttcctatcttaattatgtatatttcataccttttgtggttatcccacagttcttacatattctgttctgtttattcagaatttttctctttgcttttcagttttgaaagtttctattgacatatcctcatgctcagagattctttccacagccatgtccagtctactaatgagcctatcaatggcattcttagtatctgttacaatatttttatctctagcatttttttaattttctcaaaatttctatcccagaatttctatctctatgcttacattatccatcagttattgtatgttgtctagtttttctattagattccccagaatattaatcatgattattttaaatttattgcatgataatttcaacatgcctgccatacctgcgtctggttctgatgcttgttctgtctcttcatgttatgcttttggccttttagtgtgctttgtaaatttttgttagaaggaatacatgatgttcttggtaaaaggaaatgagataaacaggtctttagtaatatatttgtaagatgtttcatgggaggggaagcatcctatagccctttgattaggtcttagtctttagtaaacctggacactagactgtgactttcacaaatgcttctcagtttttctcttttattgtctttccactcttcttggtggtacaggatgcctagagcaggctagagttgggtaattttcttcctccaactcaactggactctaataaaaccacagcaatttaggctctggtaaaataatttctcttaataaccggaaagaacagaatgctctggcatgtttcaaaatggttacttttcccctccttttgctataagcctaagggtatttttatctgatattcactgttaaaaacttggtagaaattcttggaggtaaaagctcacaacttgtgaggacagctctatgactaagttctaagtttccttggagtttttccttttcaggcttgtccatcacactgagcttccagaaatttgtcaattacaatttaggttttccttctccaatagtggttcccatggatgtgggtttctgctttagtgagttgtgattctctctatctacctgtttgtctgtctgattttttgaatagcaatctgacctagaacctcacttctgtgacaaatccaaaaattgtttatttttcaactgtttagctttttagttgttaggatggagtggcaacaactaagctccttatatgttggagtggaaaccaccaaaaacattggttttgaatacactatataataattgtttgaaaattttgtggcatttaaatacttgtaattcattaaaattgctttcttatgaggcaggtcagaagcaatatctaatttaaacactgaataatttatggtgttatgagccgacagttccctttccataattctaaaattcaaatggctctgagaaattaaagcttttgcataagtttgtggcaaactaattttttggcaaaagctaaccagaatgaaagttttttatggtctttatccattttagtgtaaatactcacataattttctggagaaatatcaatatattttataggatgcttttggagtatttcaaagtacatatttatactccacatgctatttctaaatacaaaaaaaaaattctaagttcctcaacatttatggtaccaagagctctaaataaaggattgtggacctgttatagtatttttaatgtcataatttaagatgtgtctttaccaagtagtacattattttgcacttaactagaggtagaataagataatatggttaagacattttataaataggttaaaaaatagtcagaaaatttaatttacaattttaaaggataatattgtatctggcatgttgcttaagcataaataaatctcaaatttcaataaaataactgtaaagaatattgtcatattttagttatcattgtcttctttttgccctctcatccttctgttactacctctaaaggggaatggggggtgactttgtttatgttttgtcctggtccttatgaacaagcatgtgatagtgtctatttgagtcttccttctaaggttttacctctataatctaaacattcatctgttttatatattaaaaaccaaagctctacaatcaaccatttctcacatacctaccttcaagagtaaatgtcaaagtaaaatagtctgtgtttctattagcctttatttaatttaaatttatagttcagatcctctttttcactccacagttaaacatcaatattgcccaaacaattatacaccaggatttattaagcacttgctctatccctgtagttgaacctccctatttacatgttctacatcaatggattcaattaacctcaaatgaaaaatatttttttaaaaaacttaaaattaacaatataacaataaaaatgatagaaacaaaaatataataattatttaaatagcatttatattatattagatattataagtactagagatgatttaaagtccagaggaagatgtacataggtagtatgcaaatactatgccatttatataagggacttgagtattcacagactttggtatcagcaggggtcctggaaccagtctcccctggtactgagggatgacattatacatctaaattaatacttaataaacaaacccagaatatcttgggtgcttgctttgtatcaataactcatgcagttataattcctcaaggaatttcataagttctcaaggaagcttaatttcttgtaactaggacagataagaaaatagtaatttagaagataaatccttcttatggaagagaaaaagtatcatcagtagagacctgactaatggaatactacactcactagctctttctcttgacacccaagtctctcctttggccagaatttggccatttttcctatcctactctaccttcgcaagactctttgtctgtactggtatatactggtatcagtcactttgatatatgcatatgaaatttctagaaaaggtagacatatatctttcaataaatattaattttggaataagaaaatataaagagaatattcaacagatagataggtaaagaccagtttggcagatagcggccaactggtcaccaacccaatattctcttcctcctgagcacacagttaaacagcatttccaaattttccttgcccatgtgactgagttctgggcaatggaaaatgcatggagagaaaaatgcagttccagcaccagcccatagcaactttccatgcatgattcttctttccttctctactggctggatacaaaggtctccaaggcctagacttccacagtgggaaggagcctaggaaaccacatgtgaagtctttttccagtcagggaaaacatgttaaacttcatgagaatgataaccagactgtatttagtcactgagattggggggattttgtctgtaactgcagctagcattatactgaccaatacatatatgaacatataatttaatttaagaatatatttatatgtcacatgacgtcaacataataaatatcaaaccagatattatctcagttaaaccttgtattcgataacatagtaggtatggatgggtaggcattgaagctagatgtatgagttcattttcatactgctgtgaagaaataccctagactaggtaatttataaagaaaatgtggtttaatgtacttacagttccacatggctgggaaggcctcacaatcatggtggaaggcgaaagaggaacaaagtcacatcttacatggcatagtcaagagaacatatgcaggggaactgtcctgtataaaaccatcagatctcatgagacttattcactatcattagaaaaccttgggaaaaactctcccccatgattcagttgcctcccattgggtccctccatgacacgtggggattatggttgctacaattcaagatgagatttgggtggggacacagccaaatatcactaggctatagagtttaaattgcaactccactattcactctcatttttctcactgctaaagtgaatgtaatagtatctacctcatgggatctttgtgagaatgaactctgatatgtgtaaagtactaagtactgttctggaatataataagcacactataagaccaaattatcattactgtatatattattattattaatgaggatgatgatgttgctatcatttactattagagttatttttaaaataagacaaatgaaacaaaactattctatatgcaacctaagagtagtgcaaaaatagatgccaggctgggcaattccattgttaagcagcaattgtcttttaatgtctaaagcctaggccagtgaaataaatatttatataaaactacttccttttgaataaaaatattaatagtgccctcaaatcaatacaatattataattatttgaattggtggtgatgaaattaattactgggagttcaaatcaccttcaaggctcacctctaactcaaacttaactctaaaaggagaaaaatgtagttctataaatatgagataacagtatagtaaaatcagacttacagaaattcattaacagtatgcataactttttttcatcatcaaacatcaaagtactttcccaaaatctaaatgatattcacaataggcatcctgagatctgatatttttaccttctactatttcaattgtggaaactaaactgaggtatcaaaagatgaagtttgccattttgggacttctacttcagaatgataggtaataactttaataattgtgtttgtaacttggaaaggagttaaatctaggattgacattttaaacttaaattggttaaaatatatgtaaactctctcaagaaattcttttacaaggaagtatgtaatagcttcaaataaaatgcattgcttttgacatatgccttgtattcctaaatgaaatctgcagaatggtggagcaatttttctctgacagaaaaccttcaataaccatatagcacaccaggcttgtgtgctgtgagacggtcacaaggatcagttgttctaaacccattttataaagacagcttagcccctccccagcccctgacctgtatttctcttctcttctgccttgaaatgtgtttagtgtctaagattgttatctgttcagtgtttaatttctctgtgtgattgtactgcctgtctctaaggccctccatcctcaaaaaactctttctcataagatgatttcctgtcattaataaatcaaattacattcatcagaataaaaagttttgtgttcagcaaaaatccatgacagctgtgttctcaatgtcttccttactattcagaagttgtgtccaacagtgccttctgcaaaggaccaccattaactgagagaaaagggagagatgcttgacatgagggcattttatttccatgtgtattaatttcttcaccaattgcctttttaaaattaatttatttactttttttacatctgggctggagtgcagtggcgccaactcggctgactgcaacctctgcctcctaggttcaagcaattctcctgcctcagcctcctgagtagctgggattacaggtacccgccaccatgcctggctaatttttttgtatttttagtagagacagggtttcactatgttggccaagtctggtctcaaactcctgacctcgtgatctgcccgccttggcctcccaaagtgctgggattacaggcatgagccactgcacccggccttttaacaaccccattgtattgtgaatagtgagctcagtcttgtgaaaacaaatacatgagagtagatcagagtaaaggaaaagaagaagatattccttaccttataattagatttcttctttgtacaaatggtaatttttaatgaaaatattttatttctgtttttatggtggtataaaaaagtctcataattttagcatcttaactatttttaagtgtacagttaactacattcacaatgttgtgcgacagatctccagaaccttttcatcttgcagaatggaaacactatacccattaaacaagaattcccctttgcttccttctcccagccactggtaactatcattctactttttatatctatgagtttgactggtctagatacctcacgtaagtgaaattatcagtatttgcttttttgtgagggtcttatttaacatagtgtaatgaactcaagattcatccatgttgcagtgtgtgataggatttccttactttttaaggctgcatagtatcccattgtatgtatataccacattttatttattcattcatccagccatggacagttgaattgctttcacctcttggatactgtgaacagtaaagccatggatatgggtatgcaaatatcttttgagatcctgctttccattcttttggatacaggcacaccttgtttcattgtgctttgagttattgtacttcacagatagtgaattttttttttgcaaatttaagtttagaggaaactgtgtcaagcaagtctattggcaccattcttctaatagcatgtgctccctttgtgtctctgtgttgcattttggcgattcttgcaatgtaataaactttttcattattattgtatctgttactgtgatctatgatcagtgatcttcagtgttaatattgtaattgtttttgatcaccacaaacttctcccatataagatgatgaaataaataaatgtcgtgtgtattctgactactccaatgactggctgttcccccatctctctccctctccttgagccttctgaagaaaattaaaagtcctcctccattattcatgagcacatgaataataagaaagcaaaacagctttattgctgatatggagaaggttttaatagtctggatagaacatcaaaccagccacaatattcccttaagccaaagcctattccagagcaagtccctaaatttcttgaattctgtgaatgctgggagaggtgagaaagcttcaagagaaaagttggaagctagtagaggttggttcagaaggtttaaggaaagaggccttcaccagaacataaacatgcaaggtaaagcaacgaatgctgatgtagaaattgcagcaagttatccagaagatcgagttagtattattgatgatggtggctatgctaaacaacagattttcaatgtagacaagatagccttttattagaagaagaagccatctaggacttttatagtcagaaaagttaatgcctggcttcaaagcttcaaaggacaagctaactatcttgttaggggctaatgtagctggcggctttaagtggaacccaatgctcatttatcattatgaaaatcctacggcccttaagaatttgctaaatctacactgcctgtgctctataaatggaacagagcctagatgacagcccatctgtgtacagcatggtttacttaatattttgagcccactattgagacttactggtcagaataaaagattcgtttcaaaatattactgctcccgcacagtgcgcttggtcacccaagagctctgatggagatacacaagaagattaatgatgttttcaggcctgctaaccaacatccattttgcagctgacagatcaaggagtaattttgactttcaagtcttatatttcaggaatacatttcccaaggctgtggctgccatagctactaattgttctgcttgatcagaaaaaggtaaattgaaaaccttccggaaagaatacagtattccatataccgttataaacatttgtgattcatgggagaagatcaaaatagcaaaattaacaggagtttggaagaagttgattccaaccctcatgaatgactttgagattcaagccttcagtagaggaagtcattgtagacgtgtggaaatagcaagagaagtagaatcagaactggagcctgaagatgtgactgaattgctgcaatcttatgataaaacttgaacagatgaggagttgcttcttatggataatcaaagaaagtagtttcttaagatagcatctactcctggtaaagatcctgtgagcattgttgaaacaaacaaataaacaaacaaaaagatttagaatattacataagcttaagcttaattgattaaacagcaggagagtttgagaggattgactcttattttgaaagaaattctactctgggtaaaatgctatcaaacaacctcacatgttacagagaaatcttgaatgaaaggaacagtcaatgaatgtggccaacttcattgttgtgttatttcaagaaactgtcacagccaccctatgcttcagcaatcaccatgctgatcggtcagcaaccatcaacatgggggcaagaccttcttccagcaaaaagattatgacttactgaagggtccaatgatttttggcattttttagaaatagagtatttttaaattaagatatgtgcattgctttatttagaactagtgctattgcacacttaatagactacagtatactgtaaacatagcttttgtatgcactgggaaacaaaaatatttgtgtaagtcactttattatggtattcactttattgcagtggttgaaaacccaacctgcaatatctccaatgtatgcctgtatatacccagaagtgagattgctggaaaatatggtagtcctatctttaattttttgaggaagtgctatactgttttctatgttagttgcacgattttacaatcccaccaatagtgcgcaagggttccaacttttccacaacatcctcaacacttttttaaaaatatatatatagttgccatcctaatgggtgagaggtggtagctttttatagttttggtgtgcatttttcggataattagtaaggctaagcatcttgtcatatgtttcttggtcatctttagagaaatgttgatttaaatactttgctcattttttaatcaggttatttgtttttttttattgttgagttgcaggcatttttatacatttacttttagctttaaaaaattgcagcataccataaatgatttaatctttggactaaatttttgtttaaatttttttttttttttgagacagagtctcactctatctcccatgctgaagtgcagtggcatgatctcagctcactgcaacctccacctcccgggttcaagccattctcctgcctcaacctcccgagtagctgggattgcagatgcccaccacgcccagctaatttttgtactttttagttgagatggggcttcaccatgttggccaggctggttttgaacttctgacctcagatgatccacctgccttggcctcccaaagtgctgggattacaggtatgagccactgtgatcagccttaaaaaagtatttttggttcaaatgttaatttacacatcaaagagtctgatgtttgtaggattcataaattttagctgtagacaacaggcttattacagcagaaaaaaaaatatttatataaagtaatctctggaaggggtggagaatcaggcttggaacctttgcaggcaggaacagtgccccggtttactttgcagaagttacctgatgaaagtactttaagactgagcactagtaattacccctagaactgtacattttctcttaggtctcccaacatcacttacagttctaaaaattagaaatacttcctttgtaaaatgcagttcacaagagtaaactgaaaatatgacccctctacaaaaatacatcacctcaaaatttcattgttattgtaaacagtttcaagtctaggatctctgaataatgtcctttttttcttctcatttgatcattttcctatcttgtaaaggacagatccaactgcaaaattctcatacacagaacactttctacaaaacaatggaggaaaagagaatgttcactgtcacttctgtatgcatttgagttgctgctaatcatcccaatataggaataacttccagaaatatttcaaccaacaaacgtaactgcattatgccacacaggtgtttgggattacagattctgatatgaacatgtgctattattcctggtatgaaagtataagggaaatggaaacaggagaaacaaaaactgaactgttttcagccatagtttagaatgaaaaacattctttcacgttcttccaattattatacatgtaaaatacaaaatgtaggatttgtatctcaccgacacctagtcaaaatgaaaaggtctgtcctttgaagaaatattgaataagcacaccaccttttccttcttttattggaatcccacacaaaagactttatctgaattcttgtgtttgcatgacataaactcatagcaggcccgagaacacctaacactcttttcacacattgtatggatctcacctatcgaatttctctcagcatattgtatcaaacatataattgtccagatgaggcctggaaactccgagagaaataacatacaaagttgccactgacacacacatacacatacacacacacacacacacacacacacaaatagcttgaagaagtaagttttccagtaacgaaagttctatatatagatttatctaacattctgtataagttatgaggataatgtgatctgtataagttatgagaataatgtgatcctacagtttaaaacttttaatttttaaagtataggccttattatttgaattataggccttaattttataataattttgtgtatttcttcagaatcattggtcattctacaattcatacataaaagaaagtaagtatgtcacatgaagccaaaataatgaaagactggcataagcttaaaaatgtcagtatgtcaaagattcaacaaaacattaataaacaattttttcaaccatattttatgggaaagataaaaataaagtgtcaaactgatgagatactgaccagtttatttaaaaaccaaaggtcatatatactgttttgttgtaaactacaatattttcaacaagacaaatattacatatctgggtttttagaatggataaatatattaagaactctcaaatatcatgaagattccatggagctcataatggctatacttatttgaattacatgtaaatcaaacaaaaacactaagaactcaaagtgtgttcctcagactttcaggagctgcatcacttgggctctcgctagaaatcaaaattcttggaccccactgtagacctactgaatgggtccagtaacttgttttaccaagtcctttgggcgatttcaacgcatgacaaaatgaaaataacactgctctagccagacaatatcttgaaaaacaaggcttaaaataatgttctctatcattttgaagtgcctaaaaaatgtagctgaggtttaaaaattattaagcggaagagattttcattggcaggttatgataaaaggatttatttttaaatgacaatttcatgggaatcttcaaagtaattgttaaatttgatctttttttttttttttggacaagcactggaaaaatgtcaaaatgcaatgtcaaatgtgacttatttgtccaaaattgattaagaagaattaatgtaaataatgggaaagcatatacaaaatggtaaatgagtaaaccagataccatataccatctatggttatacaaatgaataattgcagattcacatgcagttgttaagtaataataaaaagatatcttgtgtgcccttcacacagtggaatgtgacatttaaactgcaatttcaattttgaccttttggaaaaagctgagaaattacagactcctaatttggaaatatatgaagaagcctacatcattttgttgtctatttatttaatacaagattgagagcacattcagataaagtgctaatgtaatatgaaaaaaataaagatgaaaagtgaaatataaagaatatttctctgataatgagaagtgagttgcaataaacttcagtccatatcgaaggtaatatttctttaggaggaagaaataatagaattaatgaagaggaatgaattatattatcatattgcgagaagatttaagttgcatgttggatttgacaaaaaatattgatatcaatgaagaaaacataagactcataaacgctgctttaatgaaggcatcaatcactgcgcagggaaacttaaaatgtcctgaaatctcatggttcagacatgaaaggaacttgattaaaggtttccccaaactaaacataatctaacagtttgcatgatattagcaataattaatttgaacagtaaaaaacataaactgtcaagaataaaagacattttcattagacagaataaagactgaattatttttctattctttcaatagaatatattactacataactgttgtcgtatgaagaagcagtcaaagagcatgcagccaagaaaaatgggaaaatgtcatttatttttgcatttgtgttgcttgtggcacttagaagatttttttaaaaaattagattcccggggtacatgtgcaggtttgttacatgggcatattgcatgatgctaaagtttggggtatgattgatcccctcacacaggtagtgagcatagtacccaataggtagtttttaaaccctttccccactaccctccttcctcctctctctagtagtcttcaaagtttgttgttcaaatctttatattcatttgtacccaatgtttatattcccttataagtgttgacatgtgctatttggttttctctttctgtgttaattcccttaggataatgacctacagctgcatccatgttgcagcatgatttcattattttatggttatgtagtagtccatgatgtatatgtaccatgttttctttatccagtccaccactgatgggcacctaaattgattccatgtctttgctattgtgaatggtcctgtgatgaacatataattgcatgtgtctttttggtaaaatgatttgatttcccttgggcttgtatgcagtaatgggattactgggtcaaatagtagttctgttttaagctctttgagaaatcaccaaactgctttccacagtggctgaactcatttacattcctatcaacagtgtgtaagcattcttttttctctactgtctcgtcagaatccgctatttttttattttaatttttatttatttatttatttatttatttgagatggagtctcactctgtcacccaggatggagtgcagtggcacgatctcggctcactgcaacctcagccttccgggttcaagccattcttctgcctcagccccccaagtagctgggactagaggtgcccgccaccacgcctggctaatttttgtgtttttagtagagacagggtttcaccatattggccaggctggtctcaaattcctaatcttgtgatccgcctgcctcggccccccaagtgctgggattacaggcatgagccaccgtgcccagattattttttgactttttaataatagccattctgactggagtgagatggtatcttattgtggttttgatttgcattttgctaataattaattatgatgaagattttttcatgttagccacttgtaagtcttctttagagaaatgtctattaatgtcctttgcccactttttagtggggttgttttttgttggttgaattggttaagttacttatagactctggatgttagaactttgttggatgaatagtttatgaacattttctcctattctgtaggctgtctgtttactctgctaatttgttttgccgtgcagaagctctttagtttatttgggtcccacttgtcaatttttgtttttgttgcagttgcttttgaggactcagtgataaattacttgccaaagatgatgtccacaagagtatctcctaggttgtcttctagaatttttatagtttgagatcttacatttaatccactttgagttaatttgtgtatgtggtgataggtagtggtccagtttcattctcctgcatatgggtagccagttatcccagcaccatttattgaataggatgtcttttccctattgcttgtgtttgtcaattttgttgaagattggatggttgtaggtgtgtggctttatttctaggctctctattctgttccattggtccatgtatctgtttctgtaccagtttcatcctgttttcgttatcgtatccttgtagtgtagtttgaaatcaggtagtgtgatgcctctggctttgttttttgcttagaattgctttggctatttgagctttttaaaattctatatgaattttagaatagatttatctaattctgtgaaaaatgtcattggaaatttgataggaatagcgttgactctgtagtttgtttggggaattatggtcattttaatgagattgattcttccaatccatgagcatgggatatttttccatttgcttatgtcatctctgatttctttaagtagtactctctttgtagaggtcttttacctcattggttgtatatattctagagtatttcatttttgtgtgtggctattttaaatgagattgcattcttgatttggctctcagcttgaacattattggtgtttgcattgttgatttggttctcagcttgaacattcttggtgtgtaaaaatgctactgatttttatatgttgattttgtatcctaaaacttcactgaagtggtttatcagttctagggtccctttgctggagactttaaggttttcaaaatatagaataatatcatctgcaaagagagatgatttgactgccttttctattttgatggcttttatttctttcttttgtctgattgctctggctaggacttccagtactatgtggaactggagtgatgagagtgagcaaccttatcttgttccagttcttaatggaaatgcttccagcttttgcctagtcagtatgatttttgctgtgggcctgtcatagatggctgttaatattttgaggtattttatatatttagaagctttcaaaaattttgtaatttgtggttattctcctcatcttaaataaatagtaactttttaatctaatgtttcaaaacagccccctctctaaattttataactttcaggctttacaaaatgtggattcatccaatcatgtgaacctaaaacaatgctctaaacatgaagtagtgcttcttaaatgttgttgaataagttaatatagaaatagtcaaaacagaggggatataaaatcaatcacaacatttataaacttaaattttattttgaaaatataaaatatattttaaaatagagactacaatgaaccagtagtactcatcacctaaactgaacagtgtttaagactttcccacattttttaactttttaactttttttctgtagtattttaatttctcttaagagacagggagtattagtccattcttatgctgctaataaagacgtacccaagactgggtaattcataaaggaaagaagtttaattgactcacaattcagcatggctggggaggcttcaggaaacttacaatcctggtggaaatggaagaaaacacatccttcttcacatggcagcagtaaggagaagtgctgagcagaaggggaaaagcctcttataaaaccatcagatttcatgaaaactcactatcacaagaacagcatgaggaaaacctcccccatggttaaactacctcccactgggtctctcccatgatacatgcagattgtgggaactgcaattcaagatgaaatttgggtagggacacagccaaaccgtatcacaaggtattgctctgttgcccaggctggagttcagtggcaggatcatagctcacagcagcctgggattcgtgggctcaagcaatactactgcctcaccctccccagtacacttctagggatgcatgccaccatgcttgtataattgtttttggtttttggttggtttgtttgttttttagggatggaggtctcactatgttgcccaggcttgtcttaaactcctagcctcaagcaatcctcctgctttgacttcccaatgttctgggattatagacataacctgaccttctatagtattttaaagcatatctcaggcattcttgtcgtatcatctccatatcttaacttgtatctctaacaagtgtggatattttgttacatatttacttaaccaaatgttaaggtattacatctaacaaaaattaataattccatgttactatatattttcctcatctataatagaatatttttacttttctcaaaaaatgtctcttgctttgggtttctttgaatcataatacaagcaagggttacacattttatttgattatatctcttaaatctcctttaatatatcttatttctctatcagtaaattgttgcaaaaccaaggtcaattgccctgcccaatgtctcatattttggatttacctgtgtgctttctctggtgtgatttaacttctctctctgccatttttcttacaaatggaatttagctccagacaagtggttctcaagcttgactgtgcctcagaatctcatggaggtcatgttaaaacacagattgctgggcctacatccaaagttgatcttgggagggagctgagcctttgcatttctaggaggtttccaggagatgctgatcctgctagtgcaaccagcacattttgagaaccactgtttctagattaaagtttgggttcaacttctcactctttctcttccttccttcctatcttccttccttccttcctttcttttctttcttttctgtcctttcttttctttcttttctttgttttcctttctctctttctttctttctttcttgatggtgagtttacttcttgagtagtgccatgtgcttcatataatatcagaagacacacagtgctagatcattacacttataatgatactgacattgcttgtaaactcactgatgaataactgatattttttaaaggaaatataagatagtttttaaaattgcaatttaaaaaattaaatcatcttcagtgtaactcaaaagtgtaatcagtcactcactcagaaaacgtttactttattccttctatgtgtttggcattgtgcaatgttataaagatgaaaggtgcctatgtgactctcccctcaagtaactctcagactgcatggaatatgaacatataaactcgtttgcatgataccttacgatcactgctgtgacatagatatgcaaagcacgtgaaagcatagacacctggcactgaattcatgtgttcttccctcatttaggacataatgaggaaacacaggttcgccttttttccactggctgcaaatatcagacacagctcccaaccgcagctgtgtctaacaccaagcactgtggtgttgctatctgagccatcctaggctctgactacagataagcaaacaggtcacgtttccttcaagtgggaattttcaaggcctaatgctggcagttctattgggatgggaaaatttgagaaaaggaaaggtcaaatgtattctcagaagcctctttgctgaggaaagccacgttttatcatgggaggaataagcaaagtatatagctaaggcaaaaatctacccttatccccataagccaacacctgtgttttgaggataagcatgtatccatcttccatagagcctaaattgtggttctttaataactttggatctttattttagttctggtttggatttttttaggtttatacttgaagtaagaaaacaattgcacctgaaatgaaggtttcctaggctatagtcatccaaagttcttattaaggcaaggcaggcttatggggcaaatggctgccatatattatatgggttatttggagacctatagtaacttgtattccctgagcctatgataccattccaatactcacattcccccatttatgaaaaccaaatagttttatagaaaaaagagaaattatagtcagtcttgaattgcaatctgtaaagctcatgtcttggattctgtgagggatatgtgttggttcttatctcagactagtttgaagaaaaatgcaaattaatatggaaagtagagaacaattatagtgtttaaatctgtgtcaaattaagtaacttggcttcacagtttagggaaagattgaagtagactagggtagaagctggaatctttgtggaaagtgaacttaattcggccttaaatgataggtcctaaatggtaagagaggcaagaaatgataatccagctgaaaagcagaattcagttataaaaatttcagtttgttttgtagagcaaaataacatcaatcatccttgagatttagatcctgaatattttcagatctgcaagattgcacgttctttaaaacttgagtaaacagggctatacattttttactgttccaactggttctgtgtccatcaaacagctgcattgaatgaattagcccagaatatttgcattcaaataaccatattgtaacatttttaaatatttcacattgccattcaaaatatattatgcttattacattttagatttaaaaagatagacttttcaaacctatggaatattttccttaatatattttattagctaattccaccttgttaatgatgtgaactgtaaagatattatgctgatttttaaaatttaactttactgttaatgtcagagatctgttctagttttattattcctccactgactatatagttatgatatgttagtatgatccttaaagcatgctacacatatgttatcattgcatggaggcagttttgaacactgtcaatttaaattttcccttcataaaggttattcactatcattttactttgttggtagattcgagaatatctcctgctgcttacaaagatagtattattcatttggctggggccatctatatatttgaatgatcatgtgtgaaatctatattgttaatctggcttctaatgattggtggctgtgccactccagattcaatctcaggtgactgaaactcaaatttaagcaaaatttaaaagcatgtgggtgggtggaggatgtatggtattatacaacttaagggtccagggcttaatttcagtaatagtgagatctagatgcacaaatgatgctatcacgactctatgctccttagctctgctggattcagcttgatttgactcaggccagccatctcacgtagaggcaaagatgcatgcttagcatagagaaggttggtacccaagggattggcaattttacctggtagagcgaggggccatttctgaaagaaaaaggtgctgggccagcaaacaagtaggagataccataacaggccccgtggttggtcttggacacaattatagaagttaatgaaaattgtctggattggcattcatcttcctttacacacttgcctttctccttctactttggcaatccactgagattccaaaactcaacattttcatttcttttgctaactcccatgatcctccaatgctgaaatcctgtgtagtgttaccagcccagtgatgaatggatggcctctacttaacttctctaccactcttctcagtgtcggaggttatctcatcaagttaaattaactgagccttaatgaagtcattgataatgtgaataatataattactactcagggttctccagagaaacagaatcaataagatatataatatatagaataaagtattggctcatgagattatggagactgagaagtgccatgatctgctatctgcaagctgaatatccaggaaagccagtggtggagttcagttcaagtttgaagccctaagaaccaggggactcagaattctcagtaagtctcttagctcagcagtcaggcagaataggcaaattttccttccctctgctttgtattctattcaggccctcaagacactggattatgcccttaggccctcccctcacccaccctacacacacactgtgaagaacaatccgttttagtgaatccaccacttccactgccaatctcatccagaagtatcctcacagacacacctggaaataatggatagccaaatacctggacaccgtgtcatcctgtcaagttgacacataaaactaactgtcagatatattaatatcatttattattattatgtatatatttgaaaccatttataatgtaatatattaatatattaatactagttcttctgtgaagttattatgtcaaggttaaagctccatgtaaattttaagatgcttcattaatacaaaacattattaaataggctccagcccatataaaatacatatattctattagattggctcaggggaaattcatagttagatgttaaataatgaaatgggtttaatatgtcttgtcacagaggtacttctattttaaaagttggtgtcaagaaatacagtgccttaggaattgatttctactgatattataacaataacctcataagtagtcatgctatagagacagcatagaatagtgttaagatgataaactcagagccaaactgcatgggttcagatcctttttcacttgctagctatgtgacattgggaaaatcacttaaccagttcattgtaaatgagtcatatatttaaaaggcttagaatagtgcctgatgcataatagctgcccataaatactttgttgaatgaaaattgctctgtggcagagtatcttggcacaaaaccaaatgtgtagtgatacttaatgtaaaggtttgctgagggaagaaatgattgactttgagatagatacttggagttggagcaggagattttagaaattactactaaccatgttggtcttaaaagttgtatgttattgctgtttattaagagtttattctcttaaatatatatttttcctaaaataaatatattccagaatatgtttagtcctaagttgaaaaaagaaagcttgtcactatttccttctatagatgttttgtatttaagaaactgtaattatctgcatttgattacaatagtgtatctttattctactttatccagcaaaacaaataagcaaaactgtgtatgaagcactaataaattatttaaatagattctattatatgtggaaattttatagcaagtgataattcttcttactcaagatttataaattgcagcttactgttctataagaaaatgtaaataatgtatccaatttatttaggtggaatagcagttttaggggaaatcacttataaaatattttgtttaaagattaacatgtacataaaccaatgcatattttatgttctttcaattatacacacatgtgcatacacgcacacacacacacacacacacttagaaagaaaaacttcatatcgaggagaaaaccttatgtgatcactcttagctcttaggcagacctaggttcacacagtagttatataatctcattctttagataagaagaggttgtttagatgttctaaagctgtttccttatctgtagaatctggaggataatcctttctcaccaggttgctatgaagcttaagggaaccaattgactaggtatgcagttgttctaagtactaatttcttctctttacctctcacttgcttcattatttgctttattgtatgtgatgtctcaaaaaatatcttttatatcatgaaacagaaataaatagagaatactcatttttaaatttgattacatcttagtttagtatcttatcaaaactacctagaatatgctaagaagattgatcaatgttatggtctcaaagagtatataaaatagtttgtggttatgctgtacatggctgattcaagctccttatcacaccatatacttggattttctgtatttccaggtcactcttccaaacttactctggaataatcctagagggtcccaagagaaaatatttggaataagtgtaatcccaaaatgaaaagtgatcaaagccagtttatttattttaaacagccccattaacatgtagatatacttatgcattgtattctgacaacggaggctctacgaaggctatctatcagctgtttcatgtgaaaatgaactgttaaacattttcaatttttcagatgtttaattatttttacatggaaatatgtgtcactattatttaattgttcttgctttaaatttgttgtgtcttttgaatggtgttagaatccagaaacattaaacttaacagaggattaggaagaaacccggttcccattttctaaacccaaatcagatgacctcttaagactcatagacaattaatacatttattttaaagcatgttaactaataactaatagtcaataatattttgtatagctcttgctgggtaagttaattgaacatccctcagtttccataactgtttaaagaatactaataaagttagcataatactgatatgatataatacaatattatataaagtgtaatactagtactaatattgacaatgctctgaggtcatattaagttctaagaatatgtgactcaatgattcccttgcaaaatcgattacagattgcttttttatttggaatatgagtattgagaggaaacactaattgctcttgcatagctaagttcaataaaactttctgcagtgaaggaaacgttccatgcagctaacaagtacttgcaatgtaactagtgtgacgtgaccaaggaaatgaaattttaatttaatttgaattaatttttatttaaactaaaatcaccacagctctagagttatcaactcataaacaagatttttgagaaacagttgaaattaaagatgaaacataaaacttataagcttgtgcaatgaatttaaaagcagttatttcaccttctcttttcagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgtgagtcctgccacactccaagtgtggtttaatttttaccacttcactttcatgttgttgcttgttggtaaatgtggatattttagagacatgtttgtttaatttacagaaggatttaaaaagtacatgaaacactctttgccaaccagacaccagaattgctgtgttttgtttagaattttaaagccaaatgtgagctgaaaactggagttgtgttgtgtgagtatgcatgtttacctagtggatggagggggcctcagcttagtcctcggaagagtacgcccgtcatctgttatttcttttgctttcctagcttatctaattatgcatgacaaaagagtcagttgtttgatttcagagattagtccactgtgcagtgtagcaatgtaacagtcgtattcatcattaatagagattgtaaaggggtgctcaattgtcacagtctctgttatttcctgatttttttctacacgatagtctattcttttctgtatgtttgtctgtctgtctgcctttctctctttttctctctattttttaatccaaccatttagaaagtctttaaagagtgtttgcttaaaatttctggctttccattgcaaagttctccagtgcataaaccagaaaacagtattttcctatcggtaatcaagacaggaagctaggaacagaagagagcagccctccaaacccttctcctctgtctccctcttgccaacagatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatggtgagttttgaattaaaacacagccctagactccatcaaaatcccacatgtaaaccatgacactattttttttccatcttagtgtctttttttatttttttccataatgtcaggtcaaagggggttttgtttgctcgtttgttttttccccttctccttttcatcttcctgaagtatttattctctttgtttatttaataaggaatatcttgtgagtccagtgctcacagaaccacgtggtaccatgtcacagaaaataaaggtgatatgagtaaacaccagtgagaaccagcatctcgttcatatttgttttctttctgtcgctactaaagtgggcatgaggttatttaagttgtgaactgaagcaccagtcactgcttgagatggcatgtaacaatggcattctctaaatcaaaaggaaacagatggatctacctaggaataccattttcatatcaatggttaacaaattgcagtccttgaaagtaaagatcagagaatgaaaatgcttaggtgaaatataaggatttgttgtactggatatgtttatttgtgtgctggtggatggtaccaagagctttcatattcaggtggatgttatagacagatgagattatgttgacattagattactgatagggtggagattagaaatcaatgatttttaaactttattctatttcaccttgctctaattgttacatctagaaataacgcacacatttacaatgtatgcctttcccattttcttatttcctatgtatgtgagcagtttcgaaattttgtgaaaccatttttttcttgtcttatttgagaaggcgccataaaagcctaggctgttagtgtttgtgatctgtgaatctaattagttaggtgtgattgggtaggaattggtgtacataagagaggtttcagagtatgtctgtaccaattatctcaaatcataaaatctccagagttggatataaaaggccatgctttatgaaagataaatctaataaatctaatgtttgatcaatactgtcttcattttcattagattttagaaacccaatgagttaagtaaccattaaattaatctgtagacaaatatatcaaattgttattgagtctgttgtgtggctttgatgctcaaattcagcaatttctctgaagaatatttattgttccagaaggtgtcctgatcttaaattcatagtaatagaaaagtccataaaaagcacagctttatgaacaaggtagggcatctccaataggtgacatgatttctgttttttgtttcctgaatttgcattatgagactctttcaccaaggtgcatacatgtatttctgtaaaacccaaatgacaatatttagggaatatataggagacttttagtccattgctcctcttgtatcccaagttttgccactgtacctagttaaaccaaatagcctagatatttaaatttaataatctcaatctattgaaaaattacctagatagttgcttttaatgttatgcaattgactcttttcccttgtagaaataaatctcatgcaagtttttgtattgtcaaggtcattgtttactaggctgctaaatgtccatgacagaaaatctgatttcagaagtttcttctagaatttaatgcaagaaaaataattgttttcctgaggaaatggaatgcttttacctgttctcaacaccgggactgtgaaccttaatatgttcacttttgtgccttactgccagggagttcagagccaaactctccattgtctttctgtttaatttatcttggtggagacaactttccttggtggatttgataaattttaatggaaaagaggagatataaatttagaaacaaataaataaatagtctaattatgaaagcaccagaaagcaagcctttcatgtttaggaaattatatgtttttttagaggatttaacttttcgatcatttgcttctatttgtcaaacacagctcacagtagagggatcagaccttgttttcaatacatagtttccctgatatcataagcatgggaatagctacagtgacacttgctattaactttttaacaaatagaagtattataaaaatgaattaagcgattctttaaactgaaaattatatcaaaaatatacctagcctttcatataagatcttgataaaaactttataatacctatgtagctattaatattcttcacgcaacatgagtataactatgtgtttctctttgtcaccaattaacttaattgatgctaattagcaaacacattttgtttgaattttccacttgctatttgtactaactcttgccctctgtcttatagttgtcatttaccatcccccaggttacattcacattctctaagatctttatttataatctttatttttaattgcatcccatagtatcctccttattaattttgatatctaagctgatttcacatttcttttaccttttccacttcagggatctggatctctctttcacctcagtctttattagcatgaatacaccttggtcttagtcatcactccaagagcctgaacaagcaatattaaaaatttcaaagttttctaaatgttctcaagtattctctggtgactttacagaggaaaagtcttgttcttatttgccctggataaataaacctcacatctctgcccccatataattctaccttcttcagagcattgctccatcaaccacccctactgttttatatattcagttttcccttttcaatgagaggaacatttaatccctttttcctaaaaaaaaaagttctcagatatcaaaaaaagttacatctcttcttcttcttctacaatctgagttcatctttctttctcaggtttctcgaaagagcattttatactcacagattatacctattaccaccaaatcctgcagtagtcccttacattcagattatccagactatggttctcaccactgtgtagtcagccgtatagatctgcaaggtctgcatctatggattcaatcaactaattgaaaaatatatggggaaaaaataaggggattgtgcctgtattgaacacgtatagacattttttacttgtcgttattccctagacaacacagtataacagctatttacatgtcatttacattgtattaagatttataagtaagctagagatgatttaaagtatatgagacagtgtgcctaggtaataggcaaatactatgccattttgtgtaatggacttgagcatcctcagaggtgctagagccaatcccacacagataccaaaggatgactctactgaattagttcttataaagatcacatgaccacctttgcacaaaactcaaagactgcatattcaactaaagtatatgctctttttcttgaaacttgttgtttctgttcctcctcatttactcttacctgcttttgggcagttactacagttccgtgtttagccacgtactgtatatcaccctaaccacaattacaaatgtctgtccttgtgtacagtgtcctattctcaaagtacaataccaaaaatatacaaatctttggtatttaattccaaatgtcagtcggacactagggcaataattatatcacactgaactctatattctccagcacctattttctccactgatattccacttcatttatcaagacaccagtaagttcctcttgacttgcctgctgttaatagcaccatattgtcatttttaccattgctcaaaaatgtagaatgagatttgactatttttgtgtcttgtatcctaccacttaatgaattctgcttattcctcctttattctgtttcccaaataaatcttacagtttccaattttatgtgttcttattttagttctagtctttcatacctcatacctgtactcttgcataatcctaactcaactccctactttcctcttaccctcttcacacacattatgcctaggcagaggcagaaatagggtttgtaaaacctgaagattatatgacttgagatctttttgaaaagaaaagtaatacacaattatgagcaaaaaattaggtagaaaaaatgaatgtgtatttgcagtttaaaaatatcctacacaaaagaaatttagaaaccactgaaatcttgaagattaaaacgcttttcttctaacatctcgttagacaattttcagacacacttacatataaatgcttccagattttaaagtggctttcccttcctacctagaatgcttacaacatccaggaactccagcacttaagaggctcatccaattgaggcatcctatgcctcacttttattgactttatgataaatctgcctttgctcctagagtagtcttcctcaattttggctttgataatgtgaaactctgtcatgttagaacattttgtttttttgagacggagtttcactcttgttgcccaggctggagtgcaatggcatgacctcagctcaccgcaacctccacctcccggtttcaagccattctcctgcctcagcctcctgagtagctgggataacaggcatgcaccaaaacacctggctacttttgtatttttagtagagatggggtttctccatgttggtcaggctggtcttgaactcccgatctcaggtgatccacccgccttggcctcccaaagtgctgggattacaggcgtgagccaccacacctggcagaacaaatttcatatttctttctataatgttttagcgtatgaccttttgaaactgagagacctagcttcaatgccttgcttagttcaattcctgtacaagtgtggtgtttctgagtctcttctaaaggatagggctattggggtactatatgtgatcatgtatgtatatgtatagcatataatatggtacctttctatcccttcttctggtatgttcaaattatattctttcaaaccttagttcatcatatgagactgctgctccttctttcaatgggttgtctcttggttcactaattttttatgacacaggaattatgggtacctttgctcattgtttactaaatgcattaaaattgaagaataactaagttgtaaagaatatagccaatatatttttcagagctacttatcactgcatcttttactttaagcaaggtgttgacctgagcctcatggggtatgttctcttcacattcacacaccccacccagcttcccaccacaaacacatacaaatcctgaatataatataacaatttaaaaaatattcagctaagctcaaaagaaagaaaaggaaatttccaggtacctgaaatgagtaggaaactcttagccaaaattgtaagccctttggattgggtaacaacttagaaagatagaaaaagtaaatgtagaaccagacagattagggctggggtatgaatgtccacccaagttcaggatacatgcattttagtttgtaactagataggcatataaactgagaaatgtatataaagctgggcccaagaaaggctcattctctattttcctctctatgaaagtggaattaagaaataacctaatacgactttcaggaataaaaatgacagacattataagcattgaaattaaaaccttactaaatgggttaagtagaatataatattcaggcaaggagaaagtaaactggaacacagaagtatgtaagttacccacaggaagaaaagagaagttaaatatgaaaaagaaatgaagatggataagagaatgataaagatagatttaacaggcattccagaggagaaattacaataaaaaggcaaattgaaaaagataatgatgaagaatttttcagaattgattggacctcaatcctaataacagataagtagattagtcctaaacagtatacattttttttaaaaaaactcatacctagggatattatagtaaaaccacagaagagcaaataaattcttaaatgtaccagaaagaaataacacattatctacaaccgaaaaccagcctgaacaatttcttcaaagtactaagaaaaaaagtcttcaagagaaactacttttaattcacaaatcaatgcccagctcagctctactttcagagtgagggggaaagaaatacttcagataatttctgaggctactactcatacagcctgactgattccagaggaatgcttctataatctaagaagaaggaaactgaatccaaaaggaaataataaaaaattagcagcattggtgagcatctgaagaaaagcacctggatttgatagtcagtgagccttggttcttgtctgtgcttttccagttgctacttgttgattttctatctctgagctttggtctcaccctggaaaagaaaaatggaaataatagctcttatcctaaaaatgaaaaccaaaagcacttgaaataacaaatgtaaaaactcctaggacagtacctggtacacctagtatggtacctggtgtgtgtgagaaatgtgataaaatgcaatttaatctgaaattgaatttcacagttccctttcctgggaaacctgcactgtcaatctgttgagctacttgaaggactaagtcaactaggtctttgtctatttaatcctcactgctagctaacagcagcctcaaatctctctttcttctgtgtgcaaattgtactttgtggtacatcttttgtagttttattttatcctgtcttatattgctgttatccatatatgggccttagctcttcaagaagaaattatgttccttgagtactatgcttcttaacttgttcatctctgtatcacccacaatgtcttatataatacaagtagctgctcatgaaagttgctcaattcatgttgaattcaactgaattaaaattgctgaatgaaagattgagtgactggatggatatttactaatgtgcttctttgtggtagaaattagttgagagataagataatttttattgtgtgacatgagtttcatagcatcttgcaactggtattttaattttaaaagctactactaactgaaaatatagcctaatatattttaaatgtttagcgagtttttttttcacaaaagaaaacagttatataacatttaattttaactctttttaaactattaaagtgttaaaaaaaaattacacttgatcttaaccaaaaggccaagaattgatacattaaaaaaatttaaatctatttaacaattagtgggaataggtagtgatattaattatatgaatggaattggtatacacttttattttcacaaataaataattaggaaatctacatcataatgtacaataattgtaagtttatataacactcaactttcagaatatatacagtgtatatagtatatacaaaatatattttatatatttaacataaaggatcatgtagttaaaattaaagcatgttatttcagttgttaatttagttgatcctgtgtcttgatcagaggcgttgtcagctgttattaactaaactgtgtttctaaatcttcaactagaagacttattaattccccatgtagtcataaaagatcattattaatgaccaataatattctaaaaataaggccaagacatagatcattaattcataaatgaaatatttctaatcaaagcctagacaaaggttaactggcttatattccacttctgttaaaacacactttcaaactccttttagtcaagagaattttctcaaaacaactagaaagttcaagaattcacacatagtagatccacgggctccaatttcaggggtttgctgctctcctttttcttaattatgcttctcttgtgtattgatttacatcttagacaacttcttgctacctgtttggaaatgttgccaccagcagttccaggcctccattcttaaaactcacaacccaagatcaatcctccaactccaggtctcagttcccaggaaagaactttgcttggccctatttggattatatgtccaccttcttggatcagtcattggaaacaaagtattgagttcccatgattgcccaggacgaactcaggtggccagggttaattgaggaaggaactttctttatgacttccatcaaaaccatgtggaatgaaataaggacagttgaactactattttagtttgcattcaccagtttgtctgaaatcttggcttatctatggtttggaatttagaacttttcagttttgggacatgatagagtgcatactaggtttgttgcataacacccatagtggggcctagaaaaacatcacaaataaaaatatatcagtatttctgcagcaaaacatatgcatattcacagaaattaggaaaaagtaaaaccttaggtattcatttatcagtttttttctgccagctgagtttatcccaagtttctgaaaaatcttttaggtttatacaatattagagcttcagaattgattacaaaaggttgtgagtctactaaacacactcttaataatgcacttccgtgtatattataaagttataacctatgtgctaggcattgtaccaacttgtcaagtaaactctatgatggcagagaccatattggtatcttcaaatctctaaacttggcacagttcctatcatatataaaagtgcttataaaatatgctagtgactttatgcacatttctcatggacttctaaaaactactccataatgtggagattattttccttatttataattttctgactgaacctcagttttgtcatttttaagaataaaaatagtgatacctagcaggatgactgagactcagattaagttgcaaaaatggtcacatggcaagtagctggttatagaataatattcagttcagtatgacttagttgcagactatctctattccactgctgtataagaatgaaaccacctgcttaatagaaggaatctcttagaacatgaaactttatatatgtatataacctggacaattatgcctttaggtatagatatgccacttgggggagatagtgtgtgcgtaccatccaaattacagaattcttaataatgtgttttataaagtaacaagtttaggaggaataatcttaattcatcacactacctaaactcttgactactgaattattatcttcaaagtgctcattctacttacaaccttgggtggatgtcacagttgctcccaatctggccttaactaatacttgattaagcttcacattaactgtggagtctgaagagcatcaccacattaacccatgaccataacctgacattcttaaatttctttgtacttttttgtaattgcaaaaatcctgtggcatcctaaatgtacagctgaagttcagaggactctaaagttatttcatgtatagttttagacccacaaaaatggaagtttgttggtgtgacggtacattttatcaacatatataagaagagacacatttacatcatgccaacagcaattacatcttaagtccccaattaaaatgtgactttttaaactccaaaagctccatgtgatggtttagccatctgtttaatgacacaactgccactgatttgagcagtgataattattacaataagaacagtgctggagaaagatcaactcagatcccagttagaatgtcagttaattatgaagagataattaatgagggtaggtaccattatcttatatacagagaaataaatatgtaataaatattcccaatccaggtgtagatcatttgaagtgtataattaaatccattgtaaactaatattttaaatattctaagatatagatagagaaagagagagatagatatcaaatagtatatgtatttactgagttatcttcagccacaggaggtgttattttcataagttatctattgaatttattgcatttggtttttgcatcaaaatattcctatctccaattattacatggaagctttgtgttttatggccactcttacaaatgtaagagggaattttcagcctcattcctggtgaaatctatgaccatattccctaacacactctgctaattatgttttagaaagaccatactgtggtgacattagaataagccctcaactgtcaaatgtaatgatgaaaaggagagttcagaaggagatgattctcagagcacgtactaaacactagttttaaatttctctgtaatattacttttataatgagaaaaatttattaatttccttctcactctctcgatattagtacttttgagttgttaagtgatagaagccaaattatagagaaatttttttaaacttttgtctttgctatcttataaccaaatgctgcacacttgagccctgtgtgtattggagagtattggcatttattattggctcattaatattagaagcaaagagatttttagcatgattgcctcacaggagggaaagaacttttctgcctggctcctgtattctcattttgggcatgaaattaagctttattatggttcgtgtatagtaatttattgacacttctggctgtataaactttaaaatcttatgaattcagattacatcagttaagaatttgtggcataacttagctaagttacatttttgtctttgtgcttttaatgaagatcataaatttcataatttatagaatttataggaaaatatattaaaggacttcaaccatttaactgaaggatgctagggagatcttgatatattctttgctaaatgcaatgtgtggttagctgtgattgaatttcctcacaggaatgtgtagtatttaagaattctagatttatttaaactcagtggggactttgttgtaaaatgtgaataatagttcactagggattataactcccaattcatcatcagacttgaatttgaattcaggtatttccacatacatcgctgcataattgtgagcaagttgcataatctctcagaacttgaatgtaggttatctaaaatatgagtaatataagtacttttctcaaagattgttaaggagattaaatttgataataaatctaagcttttggtattaatacctgaatgtcctaagcactcaataagagttagatattattaacatttatctaaaaattaaattaggatggtactggatttctatttggaggtacacattattgagatatagtacattctctgcaaaaatacatttaaaatataattttttgattgtaacacagattttatgatttattctgcctttttctccaatgagcttgagttaatgatgattataacacattcatgtacatgtctacctttgttctgcttatttttttagttgaaaacaatggtttgtatatacagattttttaaagaattttttgttttattaatgacaaagtatgtaaaagtactaaatatacaacagaatttaggaaagtgagagttgaaaattgggagacacgaaacctgagttctggatctagttcaatttgtccttttgcaattacttaatctacctaggtttcagttcttcaaagttgagagaagaaacttgtactggatgacttctatggccattgagagttgtcaacttatgatcctacaataaactcagtacaaatctattttcaaaattatactgtttatctacgggaagtattgaatcatgcatctttgattctacttattttttccactcaataggatagtgtgcatggttgctttatcttgaagttaatttttaaatattaggttatcacatgaccttaaaatatatctagttctaattagccaggacattactctagtttatgagaagactaatttcacacatctaggaaagatccaactctccctttcatcttttctgaaaaggaaattacataaattattatgcataacaacttttactgctttagtagaagttgagtagtaaaagttgtttttaaaaattaataagaatttgaaagaaaatgccatgaaataatattaattgaaggggtattttacttacgttctccatgttaaacgaacttttatgtatttaagttacttgtgtgcctattgatacaatgtaatcatttagtaaaattctatagctttatatattcctaatttttaatggtgatagctgaaaaaaagagagaaaaatcgaggtaacgaagaactgaatatgtctctctgaatcccatgtggctctcaataattggattaagaaaaggatggttgctgatattttatttagattctcttaatttcatccctggaaacaaaagatctaataatgtactttataaagatataaactctcactcctatttgaataatgctaactacaatcaaataatttgttttattttttgataatgtaatgttcttattcccatttttcctataacatctttgcctcaaaaattagctcaatcaagaaagatatcaatgagtatctaattcccatgtagttggactacatttttgagccaggcagtgatcatcggttaatgagactgattttatagcttaatttatttggctttggactacaatattttctttatacttagtgaagtagagaatgaaatgaagaagcaatatgagttttgaaattatgcttacatctttatggcaatttattttagatttgcctcatttgaccctcttttctattacaaatacccagtcctggctttctaatttccttctcaaaatgcttatattgcatttttttcctgccacccatggacctcttttcttcttttttgcaaaaatgacattccaaatatccaactgctttattgtcaaagtagtgtaaccatcatttgagatgtcccatggggttagcagaagagtatgtaccctatacctttcctaccttttgcctccagaggctactttggagggggagtagtgaggaagtctgctaaggcagctgcagaaattgcttcctagttcacccaaggtcagagcctggtctctgtctacactgtacaaatttaactatggagtgtctgttaaaacggtgtggtctgaatttagctgttctagaatattatttgagatgtaagccctgtgttcaatttgctgagacacactctacatgccagagttggtaaaatgagtcatgtataaaaaaggtttgtttcaattcctttagaaaaaaattcaaaaggtctcaattagttcaggcttctaataaatagcattcacacatattttcgtttgaggctttgaaaaccctaaggtggcatatactgtatatgctatattcccaaaagatacatttatttcataatttcacattattttactacctcatttggtttaattttgttatttctcatctatcatttgcttatcttaatttaaaaaaaacttctatattattaagtatttcatctttcagttggatgactttgcatgtaattatggaaaaaagaatgaaaatcataatttttgttatggttatcatgaatgatattgagagctgcaaacaatttacagttaatcatgagcttagttggagaattaattctttctatgtgggctacatagaagatggatttcaacacgtccctataaaatatcagctcatattttataagtaaaacaaaacaggcatgtacacataggcaaacatatctcacatctaaagcactaaacctttaatatataaaaatcattgtaggactgactttttagtttttaattatttatatttaaaaccattgtaatcacatcaattgggtcataatttagagtgtaaatattcataatatttcatattaagactgtttgacatggtctgagtgtctattaggttttttaaactctattttagccctgtcacttgtttttgttttggttttttttgtgcatgtcatatgttgtagtagaattaaagaccttgttttacttgcaaaatccagtcagcagttttgccactgcctgttcaaactccagcttcatgacccaggctagatacttgtgacaatggatctatgggaatgaatgatggatctgtgtagcaacgatagctttaacctctaactagctttcatttttcatctttacaatttccatttcctctttctattgaaacaagttcagttgaaataaatggatattcctgcacatgttgatgatcctgagagctcttctgagaatagcattggcctgttaatgatactgttaataatttttttcatacttttctctttttttttttagtctcgacctattccttcccaccttacttcagcagttgcagagagtatcttggcttcagcttgtgagagtgagagtagaaatgccgccaagaggatgcgtctggagagacagcaggtactgaggcatcttgaagtctggtgaacaccagctatagcaaatgtagttcatttaatttgatttatgttgaagagtaaaagctcttgaatggatttaaagtacacagagatatagtttttgtgtccttatgatatgaatttaaacttgaaaatgtgtgttcatgtgatcaatgaaggtcaaagaacaaaatgtttctgtggcgaaaatgaacagtagcaaaactaacgagttatgattctgtttagtatccaatttaaaggtcaattacttattaagaggttctagctgatcatttccaacagctttgtaaatttacctcatgacttatgagagtgacctgatcatgttcatttcgaatgaaatgaaccaacctctccttaatttcctctggcctactaccgcatgccaatacatgatgctgagggtggtgacagtacaacacaactttgaaagactagaaagtcacaaaatgaggatatacataatgaaaattcatgtcttagacttaatctctcattaattaatcatttattgtatgccaattgcatgtcatgtttcaatatcttttttctaaggcatctgtgtattggcgatgtttcttttttttgtactttgctcactggtgtttccctcagtctttcccttgggttatctgtatatttctgtttctccttctcatcccagaaatgtctttctctttgttgtatgtaccccctttctcaagtatccatagtaaaaatctaaattatcacatgatatactaaatattctgcataaaactttgccacattttcacttgtaaagtatttttacaacaaatggattatatgctttatattgctaattgaggatgagatgagtcaagactaaagtaagttagttcaattttgattctacagtgagccaatggacttcgaggaaaaaagcaaaaacgttttttcatttcaggcttagaatactttaacatgtttcagaattacatcagcattgatttgatgtgtttattattaaaatgtcatgtgctaataattctaaatgccacaaaagatgaagccttcagttaaatgaaaaatacagtattagtctcagataaaaaccatgtgaaaatgtcaatttagaatgtgctaatcgtgccaccagtgttgattcacatatatgtgccctctgttaggagttttatcattgttatatctataaaatgtatctatacaatgagttataacactatgtataataccatctggcatagtgattaggggagcacattctggaactaaatagacctggttttgaatctcatctctaccttttctaattgtgcaaacttcaccaagctattccagttctgtgtgctttgattactccatatgaaagacagcaatagtaacagtactcatcctgtggagtcgttatgagaactttaaatgacagattcatgttatgtacttagcattttgcctggtgcatagtaagcatcaataaattcagtctagaaaagactgatgctagctgttttgtcattgtattgatatcagttaactagaagcaggcattaataacactacctcagatactgaagtttcaaaggcaaagtccatttgagaacagatgctagttctagaaattgagattgtagaattctgggattaaaagggctctcctggttgttgtctagctatacatcccacctaatgtacattctagaatatccctatatagttttaatcatgtggagttgttataaaaattaaatgacttattcatattatatactacctataatatcactctacaatattccccaaagctggtcatcagctgatatttgatccagtcacttaaatactgttggcctaatctgtaaaatgggacatacagatatcagattcatagagctgttgtgaggattttataagtcaattcatataaaagcattatgtatttcatacgtttatatgttgttaaagatatatttgttatttgctttaatatctcaaatctcacactggtactaaagatctgctatttactgacacactttcctactgtcagagatttatcattgtttttgaaggtctttacattgagctcaaatttacttcatagactttctacccactgaagaaaaacttctaaaaataattaaaaatgggacttcttactcctgcaccaggagtagggactagaatgaatgaggaccagtggtccttggccctactctccatattctctcctttttatatgtcctcatatatttattgcaaggctctgtttctaggaatggaggatatccaataatatctccacacaaaaaaatactgttttctttttttcccccgtttttgttttgttttgttttgttttgttttttgtactttaagttctgggatacatgtgcagaacgtgcaggttacataggtatacatgtgccatggtggtttgcttcacccatcaacccatcatctacattaggtatttctcctgatgctatccctcccctagcctcctactccccgacaggccccggtgtgtgatgttccctccctgtgtccatgtgttatcattgttcaactcccacttatgagtgagaacatgcgtgtttggtttgctgttcttgtgttagttggctgagaatgatggtttccagtttcatccatgtccctgcaaaggacatgaactcatccttttatatggctgcatagtattccatggtgtatatgtgccacattttctttatccagtctataattgatgggcatttgttggctccaagtctttgctattgtgaatagtgctgcaataaatatacatgtgcatgtgtctttatagcagaatgatttataatcctttgggtatatacccaataatgggattgctgggtcaaatggtatttctggttctagatccttgaagaatcgccacattgtcttccacaatggttgaactaatttacacttccaccaacagtgtgaaagcgttcctattcctccacatcctctccagcatccgttgtttcctgactgcttaatgatcaccattctaactggcgtgagatgatatctcattgtggttttgatttgcatttatctaatgatcagtgatgatgagctttttttcatatgtttgttggctgcatgaatgtcttcttctgagaagtgtctgttcatatccttctgaatgggcaaaaactggaagcattccttttgaaaaccagcacaagacaaggatgccctctcttaccactcctattcaacacagtattggaagttctggcaagggcaatcaggcaagagaaagaaagaaagggtatttaaataggaagagaggaagtcaaattgtctctttgcagatgacattattgtatatttagaaaatcccattgtctcagcccaaaatctccttaagctgataagcaacttcagcaaagtctcaggatataaaatcaatgtgcaaaaaatcacaagcattcctatacaccaataacagacaaacatatccaaatcatgagtgaactcccattcacaattgctataaagacaataaaatacctaggaatacaacttacaagggatgtgaaggacctcttcaaggagaactataaaccactgctcaaggaaataggagaggacacaaaaaaatggaaaaacattccttgctcatggatcgaaagaatcaatatgaaaatggccatactgcccaaagtaatttatagattcattgttatccccatcaagctaccattgactttcttcacagaattagagaaagctatgttaaatttcatatggaaccaaaaaagagcccatatagctaagacaatcctaagcaaaaaggacaaagctagaggcatcacactacctgacttcaaactatactacaaggctacagtaaccaaaagagcatggtactgataccaaaacagatgtatagaccattggaacagagcagaggcctcagaaataacaccacacatctacaaccatctcatctttgataaacctgacaaaaacaagcaatgaggaaaggattccctatttaataaacggtgttgggaaaactggatagccatactcagaaagctgaaactggaccttttccttacaccttatacaaaaattagctcaagatggactagagacttaaacgtaagacctaaaaccataaaaaccctagaagaaaatctaggaaataccatttgggacataggcatggacaaagacttcatgactaaaacaccaaaagcaatggcaacaagagccaaaattgacaaatggcatctaattaaactaaagagcttctgcacagccaaagaaactatcatcagagtgaacaagcaacctacagaatgagagaacatttttgcaatctatccatctgacaaagggctaatatccagaatctacaaggaacttaaacaaatttacgagaaaaaacaacctcatcaaaaagtgggcaaaggatatgaacagacgcttctcaaaagaagacatttatgcggccaagaaacatatgaaaagagctcattgtcactgctcattagagaaatgcaaatcaaaaccacaatgagataccatctcacacctgttagaatggcgatcattaaaaagtcaggaaacaacagatgctggagaggatgtggagaaatagcaatgcttttacacggttggtgggaaaaatattattttcaaacccagaagggttcaaaaagctttggaattgtggggaataatgaagaaataatttttttaaattaaactcttttaagatttactaaaaacttgttgggcaatttctagatacagtttcatttaccattctcaacaaccccatgagaaaggatattattattctcatttacatgtaagaaaactgcggcccagagaggtggaatgatttgtgcaaggccaccagctgcacgagaaagccagaatatgagtttatattagataaaactaatgcctgacatcttttcacaatcctataatgtattttcatgtattatgttcatggagggaaacccatagcctagaacaaacatttaggacttgtatcatttgtgcctctgcttacaaggttttggcagtgcagttttcttgtggaaaatgatttactttatttacaaaaattttgtactttactataactagcaatctagagtttgcctggatatcagcctaaaaaaggctacaaacttcccaaagtgcttcacttcatctggagagctgtttatgcactgtaaacactagtttactgtttataattagtatcttaaaagtgtataaactacttttttcttgctgtaaattctatagatttccttagctgtgtcacacagaaacttctaccaagtgattctacttcctaccaaagcatgtaattggcagggatccctctattagttgaatcaaacccctctttgcccaactagagagagccagagttcttttgcatgttagcaagaagatcactcttcctgtgtgcattcttaacctgactcaaaatttttagaattttccagtgactaagagattcttcattatgcccccaattttctgtaggcacacaaaagttcaaaacatgaacactcaaaattggctttctgttaagccactcatctgactgcttgctgccagtggttagccacatgtagagatgtaattatgtatgtctttcagagtttatgaagcttgatgaattaattggattttataaagctctttgagctatgaacatgagaggtggtatggatgtgttaaatactttattccatatgtccattttgtaccaaaatccagaggaagcttgttattatgcagcctcagccctgaagcaagccagtggcaaggacaggagcctactgctccttcatcaggaatcagatttcacagaagtccattcgcaatgcagtttggaatatatatagcatttttctagatttaacataaaatttgtattttttacgttatctaggaaattcttcttcactttgacaattcaaaaggggcagccagatttcgcatttagagttctatgacatagctcaaaatttgtgggttcttttctctatatatttattatttagtaattatttctttttccttaaaccaaaaagatcttatagttattggttacatttcatttgaagacaaagaggcaaaaagtaagagggattagaaccagttacttgttggtgatttatctcctatcagtgtattatttttgctggttttgagggatgacatacattttattaacaggcttgatgactgattaaggtagaaagtttctggagaatgtgagggtttccttgttatgttttctgctcttagtgctttcagttaaattagttcgtagttctgtagacaagatcatataaaaccaccagttaagggcttccccagcaggagcccagcagttactgccctagaaggacaaagcgggaatgctgggtgacagattttgcagtagctaagacacacgggaaaccaatggttgactgtgatgtgacaccattgactctattgaaaagaacacagtggagggaaggggaaatggcacgttacttacctgtggtgtaataaaaagtcaggaagaagaaaaataaagtactgaaaacttatacatcactaagttaccaaaaaaaaaaaaaaaaaactcactgctaattaaccagcatgaacccaatggcccaggacctaaaaatatttagtaactgtataattccttgcaactgttttttcccttagtagtggtgaattcactgtcatctgtgtctcttcatgatttttctttgttttattaggatactaataagttggaatattattaaagaaatgtaattgcaggtgcaaaggttgaaaatgtagccacgtaagcgtgggggcaattttaatatgacttttttttaaaactatctaacataccatgattaagacatggtttatgagaggcagcttttctttcacatttaattctgcagttttgtgtcctttttataacatttataaactttaacaaatacctaactgaaagcaacaccattcaatagggttttattcttaaatttagacattgtgatattaacaagatatggcttgaaacttatttctatggcctgccagtccacacttattctcagtcatcctcagctttttactttactcctggcatttttctctcttacatacatatgttagggggaaaaccctgtatctttgagtttctcaatgtgcttcaacatgacactttcattcacagaagaaaatatactatataggaaaaatgaagcacaagcattcctcattttattgaacttcactttgttgtgcttcacagatattgcagtttttacaaattgaaggtttgtgacaatcttgtgagcaagtctgtcagcaccatttttccaacagcatgtggtcactgtgtgtctctatgtcacatattggtaactctccacaatatttcaaatttttcatcatgattatatctgctatagtgatctgtgatcagtaatctttggtgttgctatagtacttattttgggacaccgtgaaccatgccaaattaagacaaagaacttaataaatgtgtgtattttgaccaccccacccaccagccatcaccctgtctctctctttcttcagcctttctgattccctgaaacacagtaatattgaaattaggccaattgataatgctatgatggcttctaagtattcaagtgaaaggaagagtctcatgtatctgactttaaatcaaaagctagaatgattaaacttagtgaggaacacatgttgaaaagccgagatgggcctaaagctctgcctcttgcaccaaacagccaagttgtaagtgtgaaggagatttaatattcttggagaatattagaatgctactcagctggctgtgatggctcacacatgtaatcccagcagtttgggaagccaaggtggaaggactgcttgagcccagaagttccagaccagcctggcgaacatagtgagacccccatctctacaaaaatgttttttaaaagattagcaaggcatggcgcagtgcatctgtagttctagctacttgggaggctgaggtgagaggattgctttagcccaggaggttgaggctgcagtgagccatgattgtgccaccgcctccaggcaacagagtgagaccctgtatcaaaaaaaaaaaaaaaaaaaacgtgctactccagtgaacacaagaatgataaaaaagcaaaacggccttattactgttatggagaaagttttcatggtcttatagaagatcaaaccagccacattcccttacaccaaatcctaatccagagcaagatcctaactctcttcaattctatgaagagtaagagaggtgaggaagctgcaggagaaaagtcagaagctattacagcagagattagttcatgagatttaaggaaagtggccattgccagaacataaacatggaaagggaggcagcaagtgctgaggtagaaaatgcagcaagttgtccagaagatccagctaagataattgaagaaagtgggtacactaaaacaataaagatttataatgtagatgaaatcactacatcatcgtagtgaatcattgggaaaaggtgccacctagtattttatagctagagagaagaaattaatgcctggcttcacagttcaaaggacaggctgctctactgttaggggctaatgcagctgatgactttaagttaaagtcagttttcatttaccattctgaagatcctagggcccttaagaatttcatgaaaatctactctgcctgtgttccataaatgaaacaacaaggcctggatgattgcacatctgtttagagcatggttaactgaatattttaagcccactgttgaggcctactgctcaggaaataaaaaaaaaagattcctttcaaaatattgctgctcattgacaatgcacttagtcacccaagagctctgatggagatgtgcaaggagattaatgttgtttttatgcctgctaaccaacacccattctgcaacctatggatgaaggagtaatcatactttcaggtcttatatttcagaaatacatttcccaaggctatggctgccatcgctagtgattcctctgatggattaggaaaaggaaattgaaaaccttttgaaaaggattcaccattctagatgccattaagaatattcacgattcatgggaggaggtcaaaatagcaaacctaacaggagtttggaagaagttgattccgaccctcgtgggtgactttgaggggttcaagactttactagtggaggtaactttagatgtggtggatagcaagagaagtagaattaaataaagcctgaagatgtgactgaattgctgcaatctcacgataaatcttcagtggatgaaaagttgctttttatagctgagcgtaaaagtggtttcttgagatagaatccactgctggtcaaaatgctgtgaattctgttgaataaaaacaaagctttaaaaacattatataaactaaggtgattaaacagtgtcaggaattgactcccattttgaaagaagctctactatgggcaaaatactatcaaacagttttgtatactttagagaaatatttcatgataaagagcatctgtcagtgtggcaagcctcattcttgtctttatttaagaaattgtcacaaccacactagccttcaacaaccatcaccttaatcattcaacagccatcaatatcgagtcaagactctccatcagcaaaaagattttgactcaagaagactcagatgattgttaacatttttaagcaataacggttttatgttgttgtttaaggtaagcgcattggttttgttttagacaaatgatattgcacacttaatagactacaatatagggtaaacataaattttatatgcagtagaaaaacaaaaagttcatgttacttgcttaaatgcaatatttgttttattgcagtggtctagaacggaactttcagtatctctgaggtatgtctggaccatcggggtagttcttggactatgttctatctcctatgtaacatgtatactttatctgggatagaacgtattttgcaagtcatttcattctaatgggtcttgacatcctctttaataataatgtcaataacagcacagcagaaacatatatgaatgtgggactatgtgaagtgttttgcaagcctttcttttataattgccatactttttataagagtatagaaattggggctcagaaaagttgaaaaaatttctccaggtcacagaattgctcaggatggggccccattttgatccaatcctcatgactttagaatcatactttaaaaatattttcatttttaatactcttctcaatcacataggattttttataattaggaaataatgaaatacataaataagaaattttactagtaattccaccacctcattttttaaatattaagtgctaattttactttttttctatcataatttgcatatgaaaatgatgccttgctattttttaggataaattatgagaagtagaattactgggtcacacagcagcaaggtttttaaaggttttaataaacaggtagtgtgttcttattttctattttattcctataaaagatgaattttagtttattttataggtatatgcctattaaaagcttgtcttaactttaagaaatctttgacgcaaagccagtaattcctaatcctaaaaaacatggcattattttttacaagaattaccttgaaatgccctaccttaagacctgaagtgcaatttataattaatgttatatatggctgcaattaaaaaatatatataaaatgtcctgatattaatgtaaataatacattaaagaaagtaatatgtaataaaataatatgtatttcaatgtggaaatgtggggatactatggcactaaaagagataatgaaatcatcaggtactatttgcacctataccacaaatcaacatgaatgcaagagctaaagtgtcctctgacatgtatatgttgtgacaactcacagtgatcagtgacatgaactttccagatggtaagaaactgctggtaaacttctaaacaaagcatagtacaatattttcttgatttgcatgatagtggtattccttaaataattcattatatatttaaaagcagttttaaatatatatatttaaaaacataaaaactttgcatttataccaaactaagattatgttttaggctcagaaaattctaaaaaggcttttaactgatatctgcaaaactttcatttttattaattttctttttaattttattaagaaacagattcttgctctgtcacccaggctggagtacagtggcatgatcagagctcactgtagcctcatactcttgggcacaagcaatcctcctgaatcagccgcccaagtaactgggactacaaacacatgtcatcacacctggctaattaaaaaacaaaaaaatttagagacaggatcttgctgtgttgcccaggttggtctcaaactcctgggctcaagtgattctccaacttcggcctcccaaagtactaggatgacaggcatgagccactgtgctcagacactactttaaaaaattcccaggggaacagatacaattcttggtcacatgagactgcctggaaaatgtcggggcttgtagtaaacttttccccatcaccccacctacttaatgtcagtagcacctgctatagagttccccaatgttcccaagagggtagtatcactgactttgaaaagcactgctatggaccgaatagtctaagatttgaaaagaggactaagaatcctaaattgtcagattaattctttgatagtgaatccttatgcctctgttatttccacttttaagagactgaacttgaggctcaaagtcctcacattttcagtaggctttgcatttgttatgtcaaataaatttttcctccatccttcctttcttcctttcctgtgtttttttaatttgccagagcctagaagtaacaatgatgtggcataagataaaaattacttaatgtagtacttttggtttaagggaattattagcaaggataaggcaattaagtatcaatggcaatatcatcatgccccactaaaaaactgagtcacatatgatttctaattccagttttattcttgaaggacaattccattttttatttttcattcaactattttaagttgtctcctgatatacatttatattctttttaatttcaaaagctatcataaattaaatttctgtttgatattcacaacacagataccacaaaatccaatattttgctgcaaacagaatgcacaaaaatgtcaggctagagagtcctaaaaaatgtgtgcttttatcagttttaataacctataaatatactttttgtttactcagcattggagaatgtgtacttacttgctctttggtttcagtgatggatttacactcaaccatctatctactcacatggtctctaaagttcctggtactgtgtagtaaggtgtaatcttccaaaacaacatgactttttccctatgtaggaaatagctagcacaagtggatatcaaaatataaccttaaattcatgatcgcaaagtggtgaacaaattagaaaatcaatacagagaaatgtgattacaaaaattatcacttctgaaaacttaccatcttacctttattagtccagaacagattctgggaatggttataataacatttataaacaattagctattgaaataatagatgttccattatatttttataaacatagaaattttataaacataaaaatgaaggaaacacaaatatatacatattaaattaaaatgttttacagatagatatcaccagtaaatatctacaatggacttttaccattctaatttaaaaacttgaattcattgtgcacataatatcatatttagtaacatggttaaaataattttgctggaattttgtacttgctgtacatgaaagaatattagacctgaattctgttggtacatgtaagcaaaataattgccttactaacttgtattctttcagtactagcttaccagtgtggctggattttaaatatgaatgaattctaatttgagttcttgaaagataagtttttaatgacagaagttataaacttctaaattttccatggtttttgaactgttctagttattttcttaagtatttaatatatctgtatcaacaaggaatatgattagtaggataaaaatacttctaaataggtcctaaaatagcttgtttatttagcaaatatatattaagcagtcatcatatggcagatattttactcagtaaagaagctacaaaacaagtgaggaagaataacttttactgagaatttttactaagtgccagatttacttgtatgtacttagcactttatagtatcatattcttaattctgacaatatcaccactgagcaggtgtttgtatactgcagatgaatatgaataagacataatggctttcctcaatcaactcacattctgttaaagataagtgaaattagcatggtaaatgaaattataagtctgtaatcagattgctgtgagagccaggggagcattgctaactgcctgaggaatccaggagggcttcctagaggaggaactgttaaggcagaccttttgattaatgaagatattgacagaaaagctagaggagggtattccatacaaatgaggtgtttccaaatgagagaggctcttgactatcaaaaacagcagtttcttatggaggaaacttgagattgttgtgaagaaatcaaagaagagatgactgggcatagaggtgcaggggtcttctatgtccttatgtcctgtgaagttacgtagactgtaagtacatgctagagaggagtggtaaagaagactatgcccaatttgtaggaagtttcagaagcaaacagacaatggggtgtagatgagactatgggaaaagtgagatcccgatactgtgggaatcactttcccattcacctctcatttcaggttttctatttaaatgcaatgatatttaaatctgagcatatgccaaaaagcaataatgaatattaactgctacaaaataatcttatggttacagggtatttctgaactaaacatgagtgatttgggaatgtctattcttccatgccacattagctcagctaattaagaattcaagtttaacgaactataattttagcttatgtaagtacataccaagatttctattcttcctatcttaaagactgctttttagtggtgcctccttaaacagacattattgttttcatcaaacaatgcattttttaaaaaaaactttagaataagagtacttctgtttaaatttcttccttagtgcacatatttatgtaatgatatatcaatatatatctgagtggtgaagtataaatgtcattgtattggtccctcagtagtactgtgagacatgtagatggcttccctcgtcatggatggagaatctgaagctgagaaactttatttcttctgagtgacctctggtttttttcaagaagttggaaatgagccacaatttctgatgtttttctttccattactcattctactttactgtttggttttctggtttcattaagcattctcccacatttatatggaaaatttgatgttttaaatttttgagatacatctttggtttaggctgttgttaatttcaaggaaataatcagcaggatacaagtaggtggtttaaattacgacagaaatatttaacctacgatgttgatacacttttggtgccaaagacagggaaacatatggtttactgggatctccatgaagacaacatctttgttaatgttatttttaaaccaattatttttaggcttagtggataaacgaagacctgacatatttggtttatgccacgtggattcatttttataatttatttctcataatttgttcattccttgccctgtcctttctcctcaatctgtccactttaaaacccattagttactgtgaaacaacaatatatgtgtattagagaaactgaactagagtcacaaattcattatggagttagataatataatagctggggaaattgggctatgcttcctaaaggaagcggtgtgtcatgtgtgacatgtctcgtgtggtccatatggtgagacttgtggcctcgaggaacacatacttgttacctcagttatttagcactttggggcattagtgtttctacataactgggatttctaaagagctggagattactgatttaaatttattttacttttttttacttgtatttttagttaaaatctttccaaaatataatcaatgtatcttcatttcatgacaaaagatcaactttcctgaaatggataaatccttatacatttttcaaatttccaccctcaggaagaaccccaatctttgctgtgttatcagtgtcgtcttcctttgtcaataatgtatttttaaacctgggagagtgtcaacagtccacacactgactcttagatgactgcaggacaggctgtacttgttcctatttacaccctgttaaggagatacagtgaggaaagaggacaccctctcattgctttaggagttttccaaagctattttctatgagcccttacctatagcttcatcaggagaaaaatgataggaatatggaccaaaacccaagttacatttatttttaagttccttttaatgttttgcctttaatacaccatcaaaatagcattttacatgatacagtttaattgaaagtcctacaataagatcaaaccacttctccagttacattccaggtgcttattgtagattttcttggttttattacttaagaaaacagagtagtacactctggcactcaggaaactcccagaacatggcaggatcaatcacgtttttcatcatgtttctggttagtctcttgttcccaactcctctatgaaaatgtaagtgacatttaataaaactcatggttctaacttctggaaaaaggacagagagccaaagtacataaaaagattatagctgtaactataaacttaattaataaaatactatagttcaatgtgaatgaaaagtttctagaggaaaaaattcttggccaggcccggtggctcacacctgtaatcccagcactttgggaggccaaggagggcggaccacgaggtcaagagattgagaccatcctggccaacatggtgaaaccccgtctctactaaaatacaaaaattagctgggcgtggtggtgggcgcctctaatcccagctactcgggaagctgaggcaggagaattgcttgaacctgggagtgagaggttgcagtgagccgagatcacaccactggcctccagcctggtgacagagcgagactccgtctcaaacaaacaaacaaacaaacaaaaatcttatttccatctaaaaacccagcaactaaagcaaagccttttactctaccaatgtctttcttgttggttatttctttatctttgctacatatgtagcatggaagagattgttttcagaagacatctaagaaggcagaggaaaaaggtagccttgatttaggactttaaataacaaatacagtagagaattgaaagtagtgagatgtctttttttttttttttttttttttttttgagatggagtcttcctctgtcgccattttggagggcagtggcatgatctcggctcactacaacctctgcctcccaggttcaagcgattctcctgcctcagcctcccaagtagctgggactacaggtgcgtgtcaccgcacccagctaatttttgtatttttagtagagacagggtttcaccatgttggccaggatggtctcgatctcttgaccttgtgatctgcccacctcgggctcccagagtgctgggattacaggcataagccaccacaccgggcctaagatgtcttaaatccatatgtaggcatgtacacaaagttgctatacttgagaattgatagtatacaacttttcaaaagaggatcctttattttcaaattattcaaattataaaattatttattacacgacatattagactcattaaaaaagttatagctacagggaactttacaggccacttagctcaacaaatttattttataaaacaaatgggcctggaaaagttaattctcctttcagcatagattttccttcctttcttgtttccttccttccttccttttttcaaagcattttacatatgccactggaaacagaatttccctttaaaaaggagaaaaaagaccaacacagcacaaaatatttagctccctttggatttcagggtaatgttctgaaaaatgaaaatcagaatgcttcataaatttcaactgttaatgtcatcatacattcatagcatgcaagaatttgaatactacgttggttgcagaactcagaaagtcacattagtttaatttaattgcatttttatatcattaattattgcctatcaagcaaatttgagaagtccaatgaatctgtcaggattttttgagtctctgtatgtgtgaggaaaatttctttctagggaactgtccaattaacaatgggtttctttaaatctttttacagaatcctgcatttgagctagtttttttaaaatacaagatgctttctataggtctttacattaaattaatttgtcaactatcatttatttgataatttatattctagctacaaaatttgttgaaactatttcaaaaaccagatccaggtttcaattccaagttcttcactattcagttatcaaagtatcattttgactacatttgtaaaataagtcaggacatgtatgcagagcacatcatacataatcgtactaatatttgtgttattgtatattttaaatttgtattaacatattttctcatttatttttttcaaaaactcaggtatacattatcactattattatttatgactgaaatttacacaagtaagaaatgtgtttcctccttgttgctcctgttttctttctgcataaatgatacttgggggattgagatatatttgagagtggcacagctgtcctagctctttccaccagggtgtctttatccaggcagtttctcagttcaatttcactcctatgtttatttgtagacccatctcaaagtgcacctgctttaagaacaacaccctagatcaaatattagtccacaaaattaagtcccttttctagttctctatgtagcaacaactatcagcactacatattttagtaattaattatattccccgctaacattgtaatggcctccagatgtcttttgcactcaacaattgtttgactcgacaattttatatcactttgtaggaataaaacagcattgcctttttatcacagtgagccctaaatatgtgtatttacatactgggatgagggtaggtacgtaataaatatccatatgtaacttcttgcatagcatcacaaaaagtttacttttagggaggggaagaggctttgagtgagaagcccaccacacgataggaatgctggtgcctgagaatggtaatagatggcccaatagagaggtactcactgggattaatgccgtagtttaaaatattgtccaacagcatattaaacacagttttagcaccaaatagggaaaatcacaagtacaatatggtcagaaccaagggtgtaggcagtggagcagataaagaatgtcccagcatttagttctttggctactgttgcctttcactgttctgagaaaaagaaggcagctattagttttgacaaagcaattataccaagacgcagctgcagggagctgacctgatatttgcccccgatagttgtcatagcagcaggctgaatagagcagcttgatacaagtgctactgcagacactggaggaagttctgccctaaatgcaacacgtttgaacattaatatacaagtgtgtgtatgatttcttagtagtggccatctttctcctttattggattcttatctaatttttaagtactcatttcttaggaaatccctgcttaaaggtaacaataatgatgtgccccttaagtactagtggcaccatccaccagagtagatactatgtatctagggtaatgctgcagggggagaagatattttaaacagtatagctgacaaaagaaaggtttagatgctgtaaactggttgttgctttttaaaaaactatatgtactttgtctatacttagtaaataatttttgttcttatttactttttgcttatatgcatatacctctatacatcttatacacaaaagataacgatttgaagtgatgtataaaaagatgtaaacatatacaatacattatgtacacataaggaagacggtatttgtcaatatggtaaataatactttgggtacattgttgaggtaattatttgatgtttttaaatattacctctattttagtagcctaaacttagcataaatgtggaagtgctttgtcaaaactgaagttttaatgacaacattaagatatatatcattatgaaataatcttttataatgagttacaattcttaataatacataatatctaaacactcagataaactgttaatatgtataaaatagcaaaaaaaattctatttcaatgatgactaaggtgtgtgataatctatgataattctgcttaaaacacaaaaaggataaaagttttaataatatgtatgatcaacagagaatctatgtattcaaagtaatgactttatagaatttctaaatcagtttctaaatcatgaccttatgacattatgaaatagacatcaagaaaggaagacaaaaaattggtatatccaaatccatgagggtattctttgttttattctttctttctcaatcaatatatacttccacctataggagaaattttaaaattgtattttgtcattcagttgtttgaatgtatgaaaattgtgcagctgacaggtaaaatatatatacagtatgaatagtatggcttttatgcctaaagcttgtggaaaatgaatatgttgactctatagtttttaaacagaatttcaataattacaaaaggatgtatatatgataaattgcactggatacataataaattaaattcgatatttagaatcaaaagtacatttggtttatgttatgaatcaaatcagaaattaggaaaattttctaaaagatttggaagcacagttttgatgcaggaatgtgtaaacattaaaaaattagcttgttaatatataaactaaactttaagaatgtatttcaaaacataaactatattagtttcagtagcacaaaattgagggtatattcaatctaatctaaatccatatgtaatatgaagagatgctcttgtatatttttcccccaggaaaaaattaaagacaatttgtctgctctttcaggccattgagatgcaactgactaaaggtctctgtaatacagcctgcagactgcaagactaagtgctagaaatgaaagcagctatgaagtacacatttagaaatgggaaatctggttaacatttttcctaaaaaataactttatgtagataataatcaaattatttcattgatgaagttatcagtgaaacacctgaacaaaggcttcactttatttttaagtctagaagtaaaccaggagaaaacaatctggtatcagtgatggctgaaagcaactgaaggagggcaatgttaagaactggcagatttaacacatatgaatctcttgaaactgttacaaaatttagtcaaaaatggtgtaagcagaagggaatttattatcttgggtgactcaaaattgtaacagtagggctaagtttacatatggttgattgagtgtctcataattatgggtcttctctcagagatctcttggtcctgctccatttttgttatttctattctcagacaggttatcctctcatagtagcaacatagctgcagcagctccagccttccatcttccccatatgattgggttacatatttatccctgaagcaattgctgaggccagagaaatggaaagtgtataggccacatatttagttttggagccattggtggagtaaattctgtaaaacacatgaaacaagagtagggtaggaggatcagatacagttactaaaaggggaagggggatgaatgctggaaagccgatgaaaaacagtgttcactacagtggacattactggctttctagggctgccaacacaaagtaccacaaactcagtgatttaaaatagcagaattttattctctcacaattctggaggttaaaagtccaaaatcaaagtattagaagggccctgctccctcaaaaacctctaggggaggatccttctttgctgcttctagtagcccagacattccttggtttttggcagcaaaattccaattcctgtttctgtctgtgtctcttctcctcttcctaaaagaatacaagttattttgaagtagggtccaccctaattcagtattgcctcatcttaactagatttacttgcaaagtcccttttttcaattcagatcacattgataggtatcagggattaggacttcaacatactttttgtggggacacaattcaacccatagcaatatattctttgcaccctccacaattcatgtccttctaacttgaaaaatctatccacctatcccaacatccccagaaatcttaattcatccagcatcaactctaagtccaatctcctctaaaaatattcaactcaagaagtcccaaatattgtctttaaatcatctcaatccagtgtgagtaagactctggatatggtccatcctggggcaaaatttcactccatctatagacctgtgaaacctagaaaacatgttacctgcttctaaaagacaatggtgggacagacataggatggacatttccatcccaaagggaaaaaatggatcagagttcccaagcaagtttaaaagtcagcagggtcaattccattagtttactaggactgagaataatcatctgtagccccatgctctgtcttcctgtcccacctggccgactgcaccttcctcttggccagcctgggcagtggccgcgacctcttcgccaatgatgtccagctggctggcctcaacctctgggctcattgctttgcccttggaatcattcttgtttcattcaatcccatctctgtcccttttcagtctgggctgacagtttttctgctggtataaaattttcaaaaactttgtcagtctcctgtgcatgtcaaggtaatccacactattagacatgagtattctttacacattcttcctgaataatctcatctctcttcctggagtctactaaaatggttgattggacccataaatcacatacctaatctctttagtgtatagttgtccagccacacctgttttcagagcatgctatctgaaacattttccaaatcatcaagtgctggttcttcatgtaggcaaattcaatccataacataagctaactccagtttttacattgcactttttgaagaatgcatgtatggctttatgctcattagctatacctaataagaatttaccagcagaaatattgaaggcacataatttaaagtgtatttacagatgcaaaatatataactaccaccaactctctttaagtgagggaaaactacttacacattattttagagttttatttatttaaagatttggggtacaaccaatatattcattttttttgtatttttaagttgcacaaattttaacatcaggagactgtaatagacctctctctccttctgtctcgtctctctctcatcttccctctctccttccctctctctatgtccctcatacatactatataaaaactcttatacaatatgaaattttgtatcaaaatatgaagaaattacagtaatctaaaatcaatgatagatatgcagagcataagtattggagttgtcatttaaaaagaataaggtgaaacatgaaccaataggtacatgattgctctttcatgaatgtagaaaatatacgtagtctattatgttgttattgttaaaaaggtaaaatgtttcacacatacacacacagccccccatctatttttaaatgctcttaatcatttttcctaaatgttttgcttagttgtaatcatagttattcagtttaagatgcaaattcaatatagatttaaaagggcattgtctagagacaaagctgttacccagtgattcacatatgcataccctgtacacatcctctaattggagcccactgtaattacactgcaaataagcacttcttaatgatgatgaagaagccagttactaaggagctgcttcttgaaaagtactgtcattcatagctgtaaagggctaaacaagccttaaattatatcttccgttctaaagtcaaactaaaaataatctatacatgtcttttgtttatgtgccccattgttttcctctaaatatgaaagctcttaaaatattcagcagtgacttatgcattatggaagtgaccactgaaggcagcgtttctgaaaagttatatgcaagttagcatcaatgcaagcccaacagcagcccaggtctagccctgttcaaggctcagggggtaaacaccagggctgcctgggttcaaattccttccctcaatttttacctgagctctccactcacaaggaggaaagggcatgcctccttgtttttgtgacacatcagggtcccttgttcttagaagctcagatgtgtaaaaaatgctgtggatgcttttagatcaacttaagagtgccgggagctgtgctatagcaatggcaacagggtccaacccaaagatgacacgctcattaggtcttacaagtatttccagaaataattcaatctacccttgatttgagacaaatgatttacttcaacaagtcctaaaaaacactgctccagtattctgcaaaaataaaatacataaaatacataaaaataaaaggtattttatttaatcatttatttattagtaatctctatatatagattactaatagatactaatctatctatattattaacctatctatctatagggtagtaagtggcaaaagtgttttatttggcctgaacgttgttgcaaaatgttacatttgaatgctcttgaatttagcactgtcttcataacttcctattgttcaatagtcagacctctttagtttcgcttggtccctagaggaagttgagtttgacaggatttttgattcacctagtttttggcaagtgtcttatcacccaaacatatatgccaaaatttttgcattaaaaattaaagccttgctgattcttcaaaaaataatttgaatgaaaagtaagtttagtctttagatgttttacttcttccaaatggcacaaatgcacagacactgcctcctttacacgtttctttagtagacagaaaattatgttaaaagaataggaataagaatgctgtttaaatttgatacttcccttttctagatcttagcatgggtgaagatgtggttttgcccttgagaggatacttgctatattataaataacatatatatcagtaagaatatattaataacatacgaataaatatatgaatacacatcagtgagtgtatgaatgtaagttcaactcatgctgaattatgaacctcatctttaaccaaccactgaattaaggtacttcctttttaaaatttcaacattttgtgtgattcctgtgagctgctttgaaaccagcagccttgctcagtgcagaacatgaaaggggaacaattgagcagatttttccccctcttggcatgaatctatcagtactcattttgaactgagctgtctgtcattcctgacaagtcctgaggggaaataagcctttgggtcccaaaatattaataggtaaacacgttattcatgtttggccatagcaaagatacgtttaattttaaaatgaggccagagtccctaaactagaataagatgtttgtacaatgacaacaataaaataaaatcatttaaaatgaagaatgcctgggattaagtgttctgaaaacccacagttcataaaatgtgtttaaagcagttgaggcaggagtgagaaaacccagtaaggaaaagacagcttcaattagcaatccccaaaaggtgtatatttcagaacaaggttcttatttaaaaattagccttctggctggatgcagtggctcacacctataatcctggcaccttgtgaggctgaggaggaaggattgcagaaacctaggagtttgaggccagcctgggcaaaatagcgagacctcatctctactaagcattaaaataaaaaaaaaattaactaggtgtagtagcacccacctgtagtcccagctactggggaggctgaggagggaggattagtaagcccaggaattcgagcttgcagtgagctatgattacaccactgcactccaacaagggcaacagtgagaccctgttgtaaaaacattaattaattaattaaaattagccttctatagagtttaagacgatcatgttggattttgttttatataccctatctgtatagcattttacactactcaaaaagctttatagaaattaatattacctaatttatgtggattcctgagatcagacagaactgtaccccttcatccatccaaacacagcaggataaaaggagggggtagtactgggctcaaaattttactgaaactctggacaagctgctgaacagtagttcagcatacttgcccacagttcacagatctacacacacaactgtgcccgtcatttcttttgcaagacctcacaaaaggcaaaggaggaggaaagaaagttatagttcatttgcataatctaggctcctggtaattaaaaattattaattaccttgctgatagttgtaataaaatgaaaaaaaagctgcttatcagcaaatccagccttctgcatagtgcctgggttgaaacaaacagaacaaatcccatcaaagagaggttttcaagtaaagataatgctgaattcatggagaaatagtctatgtagttccattgtttttcactttgattgcttttattttaatgactattttagaataaaaacaccctatcctttctaattgaatgttttacttgaagctatactttaggacaaatagctaagtttagaagattaaaaaacaagtttgaatgtttgcctataaacatctgaagttatacctaaacatagatacatttagtactaggcatgtctaaataatatttatatttagcaattattatacaacgttttgtttactagcaaaacagatatgaaaatagtacatttttaatttgaatattggcacagattttacattaaagtaaataagcattggatattaaaactatgtaatcagacttctctttttatttttgccatttgctttcttaattgcctaacaaaattaatttatacttgtggttcactgagtgggtaagagttgctttggataccattttccttcaacctatcctagccacctataaaagagttcccagatgactttgacagagtacgcctgataaagattgttctctgatgagccgccggtccctaatggagaaaggccagaattgcagcccgagaggctgaagagttacctgcttgtcatcttcaattcaatttaataaatattaagtgcttcctatacacaggccattatctggaatatgcaagatgaatttaatcatttatttagaactcatgaaacatagagagtcattctagagcttggaataagatgggaaactgagactaactttccccaatcagaaaatagaagcatagcactccaaaaaattgaaaaatgtttactctatcactcttacactctccctgaaaatagttaaacttgctctactgcatccttaaccttcagtcacttagtgttgttagaccatagctttgggagtcacttagacacctcccccactgctgtgctactctgtactcgataatgttggaactcaatccatgtgactttgattcctcctttgcaatttgggaataaattttatcttgtagaagtgtgaaaactaaatgaaatcatgtatacattgcatacaacctagtgcgtgactcagagtaagcaccaaagaggaattgactttgttacctggttcccaggagagagaccttactacttttcaaggagagccctactagttccaaatatcatttattgaaatttctttatttctgttgttctgtaatattcacccttttgctatattctacgctatttcatgacacaaaataagtatctcctctttcataagacagttcttcatatatttaaataaattattagaagccatatatctcgccttctccactcttatttaggatgagcatttcatgcctctagcagagcagtccgtctccttatttactgcatcccatcgcctctcgcctattccagcaattctccctgctctctctcctccaggatcactttcccctttacactggattcttcccatcagcatgtgtaaatactattctcctaccacaaccaaaagaaagcaaacaaaccgaaaagcaaaaaaaataaaatattatctacaccttccctcagtttccacatttctctttccctttacaacagtagtccttaaaaatgttgtcttaaatgactattgccaaattctctcctttgatttcatcctgaaccaagtcaggtttttgctaccaccccgtcaccaaagttattcccttaaaagtccactgatgacttccacatttctagagccaatggtctatttcttagttctcgtcttacttgcactatcaggggcatttgtcacggttgattactttgttttccttgagaatttgtgctgcaatttacttttaaaacaacatacgaattcttttcctgcttccttgcagttccatctcacttgcctatgctggtttctccttgtcctctaattctaaaatttagagtgctcctggctttagacctcttctcttttctcctgtagtcccaccactttcaataccatctgtaatgtgatgactcacaaattgatatgcccagccaggactcctccctgaactccagatccatatatccaaccacttcctcagcatgtactcttggatggatgttaaatggagtaaacataatgtgtacaaaacagacctcacaatatcaaccccaacccagttaatgtccttcattcttacagttggcctgaccagaatccttggggttaccattgagttcccccttcttttcacattacacatcaatcctttggcactaccttcaaaatatgtccaaaagtcaatctgcccacactgttcttaccttttgtccttttccaactcaccatcatgactcatctgaattattacaatgacttcctagccagtcatcctcttcctcttgctcttatccctcatttagtctgttgtttatatgttgccagagtaatcttgttaaaaaatttcagtttatgtcattattatttgactgaaaacttccagtggctttccatcttattaagagagagcaccaaagtctttactaggctctaaaaggctgcacttagactttgtgtcccttctctcacctcctctcctataatttcctaccacacagacttccttgtagtgttttgacacagtggctatgatcctgtctcagggtctttgcacttattccttctacttagaatgctatccccaccccagcattcacgtggcttgctcctttgcttccttctttactcaaaaaccaccttttcagtgtggtctttcctggccatcccatttaaaattccaaagcattatccctcaaattttatatcctcctttcatgctttttatttctttttggtgctatttactgtcctataaaatgcatattttaaatatttactttgtaaataaatgtttgttcatttctgcattagaagacaaacctctgagagaaggcacttcgtgctatgtttattctctacactgggtcattaccaagcacacagtgggcattacataaatatatgtagaataaatgagtgactattaccctttgtcttctctgcactaattaaaaacctcctattcatgtgggttcatttttaagttttgagatcttccaggaacctgcttttttcacacacataggtttagtttattgtgtgtctcatagtgtggcacccaaggagcctttgacttgctcagtatggcagagtagtgaattcttccaactctggagtggaagttcacaggtttagatttcagtttctgtgcttatagttgtgtgaccctggatatgtctaaaatatgcaaacagaaagactgcattttttctaccataatggcaacataagtcgttaaaccttttaaaatgggttaaaagtgttgagaaacaacacatactaaactcacctcattttctttgtgatggaactattaaaaaggtggaccattgtggttttctagaagtagaacaaatcatttgacaaaataaagtagtgtgtactgaaatatagtatcgttaggatggttcacatctaatggaatgacgacatccaaacactgatgattggattaatctaactagaaaaaaggttttgcattgcatgtcatgggcctaagccctatcccctttgttactcaatatttaaattaatgagacagataatgtattggtagggtactgaacaattgtgtgataagaagaaacagggatatgaagagggaaggggaagactaaacaacatgcaatgttaatggaaagataatttgaacaatttcatgcaatgttgatggaaagataatttgaacaatttcattacaggctggtatttcacaagatgaatttaataggcctaaaaatatagcctaacacttaagtatacaagtttacctatacatacaaagtgaagaataaatgtcctaactttggcacccgtaaaaaatagagatataatgagataaaacgtttattaaatacttactgaacacatatactgatcaagacactgtagttttggtgaatagtagagaaagaatatctgcttccagtgagctttcatgttagcagggaaaacaggtaacacttttgcaattaattataattgattttagtctaacaaaagagttatggttgcatacaatggggacctaatgcatagatgaattaggcaaaatatttataatgtcatcttaggtcacatgaataaaagtatattatacctagtagaagagagtaatatttattgagcatttgctctgtgtcagaaactatgctgattgtcatattaccttaatccacacaacatccctatgaatcagacattattaaactctgatttcacagattgaagaacaaaggaacaaaaggcttatgttgccattatggtagaaaaaatgcagtctttctgtttgcatattttagattatctttttctatcaaagttttcagatggagtttaccatctcacattttaaagcctttcaaatgtcaagaagctgaaattaaaagatacaaataaaaacttaatgtacctatcctgattctaactatattatattagaaaatttgtcctatctataatttcatacatatattaaggttttaaagtgtgcatgccttttgatatggaaaattgaatccttgcattttatttgtacttccttccaaaatgctactataatgactataagtgaatatataaagtttagatttacaaaaagattgagaatgaggaaggactcaggaaaggatgagacatttcaactcaattttggaaaatgaaaatctgccccctaactgactatagggtgacatcaattagaagccactcagtctctgtcgactctggaaagtctaagaactgaagacactacatattatagagaattgacttatacaaatatgaaaataagagaattgactaaagtgtatctaacaagttgttagacccaggtcccatccccaattctgtattgccaggagacattattttcctacccaagtaggaaatggagggttcattatgtagtgaaataaaggcaaaaaggtctaaactcaggataccagaaacaataatagtggaaaaatatgctaaaaatgggcagaataaattaaattattcaagctgaaagctatacatctctgctgcaggccttttttcagtttttagccacaagtatggagacagtctgattatatcctccactgaaaagactagaattgttccccagaaacgaagaagccagaggggggaaattatagtcctggcacttaaatatcagaagcaagacatagtatagaaggaaattttaaagcaaaatataatttatatcctcagaaagataaagcaaaatcatatttcatccttgaagtaaatagcaaatgcatgaaaaagaacagcaagcaaaaaagaactcctgggatacaaaaacatatactgtgtatgatagaacttttttaaataagtggaagatcatttgttaaatcactcagagttttctttttaaatagacaaaaaatagaaaataaagtagaaaggtaaaaaatatattgtagagggtcaatttaggagggtgagcatctggctaatgagagttagagaaagagaaaaagcagagggaaagaaattatccaaacaaaaagagagagagaacatttctcagaaatgaaggatatgcattaccagactgaaagagcacataaaattaccaggatagtaaatgcaaaagaaaagaccatggcagtcatattatcatgaaagttctggaacacatgaaataaaggcaaaatcttaaacattccagagggtggggtgggggggaggagcacatataaagaatcggaaagccaaatatgtcaaccaacaaaaactgtcccaaacactaaaaatcatgggtgcaaagcctgtaaaattctgaataaaattcctgctcacccaaattatagccgagaagagagagactgaagggaaaggaggttaaagaatgatgctgtgtggcaggcctggagaacagtctttccagattggaataagaagtctccaggagataggtgtaccgggaaatattaagtgatgcaacacctaatatatttgacaacatggaaaatattccaagagggttgtatacttttgttagagaatttgggaagaactagtagtaatggctcagaatactagccaaaccacaccaaaacccccaaaatgagttttaatactgaaggaacaaacatttggagaggtatactcattgctcaccagttggctcaatagtgaacaacaccgtcatcctgggtctcagcaggagagagatattaataatatattcaaaataaataattgaagagtatctaataaatgggctatttacataggcgtggggtgggttagggaaatcaagatgagatggtgaaggactagcaagagagaggaaccctcaccactgagagctaggaggagcaatgggagggaactgaggccctgggagagggaatgtctgtcaggatccaggttctgccatggggaaacacagcatctgcccaaccatgacatggcaggaaaggataccgggaaataaataggccacgcactgttatctttcaaacactagactcttgtcggtgtgtttcactgatttgaaaccctagagtccagagagcaagtaagcccagcttacttaagttcacagtgggtatacccccaggaaacagtgttagagagtgcatttggggccataaattaagaatgttcattgtgccagaaaaaaatagtgttgtaatttcatgttgttaaaagaagttctaaactatgtgaatactacgtggcacaattaaacaaaatcctcaagagcatagtcagaaatctttggatacaaagaaagttttatagcaaatgtaggatgtatttctgtgtagtgtggacacacacatatgtacacgcacacatgcacttagcctatgtcttcacatgactgcctttttaaaatcattcttttgatggcttatcggtttacatgtttttctcagaaagaccttccctcttgaacacccatccccaatcattagtttacatcacccatttttttcattattaatggttatcactgcatgaaataatttttttttttatatattttatccttcctcttgcctatccttccttcgcagccctggaaatcccatgagggcagggatcatgtttattttttctgttgatatattcccagcacccagatgaccgtctagcctagtagatagaaggcatccaacagattattaagtttttattcataaacaaaattagactgtataagacttggtcctgggttatagacatgagataataaaaaggggacggttgattatgattctcctgagtctctaactcaggaaactggataaatgaaagcatcattaattaagatcaggatttcaggaaacagcaaattatggctggagaagtgattgcatgggaagttaaagtgcacagtttcggatataatgcctaggaagtaatcgtgggatatgtaggttgttatgtccagtagccacttggaaatgtggacttaggaaaaggttttaattgcaattttagatttagaagtcattggtaaagaagtggtagataaagtcataaacaacagatgagatcttgcagggaaattatgcagataaagtaaaagactcctagagaataaaaatggaaggaaaatagaagcttagatatacttttctaccaaaacttaacatgaggtggagtaatatatttcaatatcttaaggaagataaaaccactactttccaaatccaagtagtgttaaataacattgataggtgcatatgtgcatatttttgagaagttacagtagagaacacctaaaaattaacaacttaaataacaagttgttcttaatggaaataaaattataaattttatatttaatgtctgaagaaatatgccaacagtgatatttgtcttcctattgtatgcgctacacccatagtcaatatgataaatcagaacactttatagggctaaactgaaagtaatgtaagcagtactattaaacaagggaatattaacaaagagcatagtattttcctcatgtatacaccatataacacccacacatattctggcttatgcaacttgttttaaatccatcactagattatttttgtctttagataatttcatgttatctatgcgtgttcctcttaaaatttaacttcacattaatataaaagcattatcactcaggcatcaccatattgatggcttatctaattaccttagtttgactatttcataattgatatgcttgaaataccaaaacagatgggcaatctttacactaagtttaaattaaattataataacctataaactttaatctcaacacataggaattaagatcacaattttatgactccttcaagatatataatccagatggaattatgtttactatatgattgaacataatgctcatcaaaagttgctacaaagaaatccattatgtagtgatattaggaagggatagttcttcattctgctcagccaaccatgttggcacacccgtttctaatttcaaaaccatctatgattatatcctaatgtcagtgttgaaatcacatcatcagtccaagtttttctacttgctcgaaaagaaatatgaaaagatgaaaatttactgtgatggctagttttctgtaagacattaattgtatttttcaaagttttgtttcttagttgagcctaattttcttaagtcagtagtgagaacaccaatgttgggtaactgactcctgtgaaaaatgcatagtatctgagagggcacttttgaagtatcaggcctgaattttcttgacatgcccgtagaaccatttgtgacaatcaatctaaccataattttaacataaattgtaggtcctgtcttatactctgggaaagttgataacaaatgaaaagaaagtcaagttgtttccttaatttgtcttttaaagtggcatatattgtttttatttgatttgaaataaaatgttacagtcaaaacagcattaacacctatgagtttattttagccttgaccaataatgtatacatattattatatatagacaaaataaatatgtagccttattaccaaaagagaattgttaagtaccagacatgaattaaatccctttataaagctcctttatgtgtcacaaatttgattaaattgcagataaaataatgcagctcttcaccctgcccaacatcatgctctagacagctattatgcagatgctagccttgatcttccaacatcaccacattaataggattgtgtagtagctaacggttaactcctataaaaaaatgtacctccattgtgcttctaaaagtttaacaacaaaggtatttgttctgaatttttattacagctgtaatatttttatagataatagactgtaacataaatattatccttagattattgctttgggagaaaatgcttattgttaaaacacaactgtgttgatgatctttttagattttgtttatcttcaagggaagataaacattggtaaagattatcttctttaatgtttattattatttctttcaaggtcttttttttttttttttttttgaaatggagtctcgctctgtcgcccaggctggagtgcagtggaggcgatctcagctcactgcaagctccacctcccaggttcatgccattctcctgcctcaccctcctgagcagctgggactacaggtgccaaccaccacgtctagctaattttttgtatttttagtagagacggggtttcaccgtgttagccaggatggtctcgatctcctgacctcatgatccacctgcctcggcctcccaaagtgctgggattacaggcgtgagccaccgtgccttgcctctttcaaggtcttttgtagcaatctgaaaactaagtaactaatttatatacaatgaaagtctttattttctcttaaaatatattttactatttgctgttattgcatttttcataaagataattatataacagaacagaccctgctttttgtgtgtgaaagtgtctgggggatagattagagaattaaaaagaacagtatattctgttcatttggaacactaagggtgtggaaaaggaaaatatcatcttttttctcctttacttttgatgaaagccatatctaagcctgctttatctacataacacttttcaatttcacacaacaatgttttaaaagttctaaaatactacaaagaaaaaaattaatttgttattcaacagatacatatattaaagatttgcaaattacattaaaaattaaatgacaaattatccgaagatacaacacccattaattatgagaaacttcctatatattggtcattttacatggcctagttatgacactagtaggaattgtttggttttaaagtcttgtatctgattccaaactctttcagctcaccgcacaacagccagtaagttgagagacaaggatttggaacaaggtcagtgaccttatttagagagctagcaaactaagaacatggtggactaatgtcttaaccatcttaagtcagtaaacatttcaggttggttttatgttaagggaaggggaaaaaagaaagggttggagtccagaggtgactcatgaccacagatatctgggtgccagcatgggtctggtctgaggaggccatgaaatgcctccatccttggtcgggtcatgactctccgacaaatactcaacactacattgttacgtgtgggtacactatttttatcttctgggttagttttcataaggaactgttatttgctttcaactatacaccaaattcctctcgtagttagcttggcctacatgcagaaataagcaaaagcagttaccctaaaagatatcaccacaaaaggagtgatgagtttaggagcaaaatggagttagtcatgctaggcctccttttcactgctacaatttccccactctcaaaggttcattccaaaatcttgtggaattgaggacaatgggatgttgtctcccatctgggtactactggttggatggggttgatgagggatgactgtggaataaaaccatttgacctggctaaggaaatattccccttgtaggcttgtgggttcccactatcactttgcatgtagtgtctaatgagaagaagttgagtaagaaagaagcatggaacttctgggtgcatgcttcctgatatacagcatatagttgtactctatataccctatatacagcaacaactatatgatcagagttgtcatgtactgaacaaggtgtaggatggcaaattcagcagtgggggataggttagtggaagtggcaatagactgagaaatcctaactacttgggttgccaaacatatgaaaatctccaaaagacaagcaagacacatagggttttcatttttatttcatttatccttttgtgaatgagtaactttaggtccttcaagagctcatatgcccactgttttcctggtttctggaatggtggggtgacctgacccaagtatgatatacccatggctttaatccatcaagtttaactgatgaatgggtattcagcagcacctctaacagtcccattcacttggcaacaaattggtgttcaggtcctttttctttccaagtctttaagaagacccctcctggtcaaaaaggatgtgagaccacatctgtgggatgagtgatcctgctagaagaaaagtcatgaacagaagttagtacagtgcctacagttaacatatttggcaattgctaaatctcttaaaatatcagttcgttctccagctgaaacttgcaatgacctatcatataatgtttcaaagagattcaatttgagcatacttgagggagctactctaatctatggcagggcaactggcaatgccttattccaagttaaattagttctttgaaaattttgatgcttctttttagactgtggtttatcttttcaatttttctgtcagttatcgtctccaagctgacaattcaaaggtttcaggaaggaatgagttacagcttcccttgacattcatgtaaccatcatagtcttcttcaaatcagggatagatgggtgttaactacagaatctgtggcccctgcatcaataagaaagtcagtaagtttcttccccactatcaattgtactgggactcctatggggatatgatatcaggttggctaaacatacatatttaacaggttataggagaatctatgagtatttataaaggcagtcctaacacaggcatatttacaaaacatacaggtaacatatggttaccttcaggtgaagacttaacacttgcctgtcatggccttatgtcctgtttatgatttggtatcttattgccacaaagagtttgttctgttagtctaatggtcattaagtctgctgagttattttctctaaaccataaaagggaggagggataacatgacatatctgacctcccatcccttagttcatggctgggaactaagtttttaaggtttttttctggggctcccttggccaagggaggtccatttaattagtgagggacataggattctacttttttcgtttatataccctctttttggtcaaaatatgccagagacagcatcaatgaccaagcttttatttttttccatatcattgctggggtagtgtggctacctgccctaggtccatactatccctcgatgggacccctatggcaaagagagttagacccaaatgacttaaagctagttaataattctaggcatctgtgggaatggagttgggcagatactcattaaccattataactttttcaagtaacataagagccaaaaaccaaaagccaaaaagcaagattataaaatcaatttatctataagttttatgtgttgaaccatcagccatttaggcatctgtgaatccatctttgatttggagagtttgaactagttttagctctcgaaacagaccctttaaaatttcatgtgcccatctcttctgcaatagtccctgggcatagagggagggtggttgattttgtataactttaacagcagtatgtttgcagtgcaaaatggattggcctagtgggattgaattgtttttaaattctgaagagaaacaagacataaagtattagcaaggtttcaagcaaaaaggtcataagccttgtctagttatgggaatgactgaaaaaggaagctcacaggtagctaaacattcaaactatctagcatcaaggatatagatagaggcacaattataaaatgaatccaaatctctttgaatagtggcctatccctgtgtctcatgaaagcagtttactttgattgtcatcttttcccagatctaaagatgaggctttggttaacttgagtttggtgtcagataatggcaggagtgagtgccttctttagatgagatatgtgtacccaggagtcaaaaccctgtaacttaacagcacaaggattgcttaatagtacctgataagtattgatatggtttggttctctgtccccactcaaatttcatcttgaattgtaatccccatatgtcaagggaaggacctggtgggaggtgattggattatggatgcagtttcccccatgctgttctcatcatagtgaaggagttcttacaagatcggatggtttaaaaagtggaagtttccccctgtgcactctcttctgctaccatgtaagacgtgccttgctttccatttgcctttcaccatgattgtaagtttcctgaggcctccccagccatacagaattgtgagtcaattaactctcttttgtttatcacctggctggaagttataaaaagattctgaaacctttaagtgattaactttatagctttgacaagtctccagtaatctgagacttagttttaaaattttattttgaggatgtttatcaaagatgttaaagggctcaaaatatttgaacaaaacagaataatagttattcatttaaccaaatgtgataatcaaaaactttaaaagcaatacagaaaattacatacatgtagaaattttaagccttttaaatttcagtttgcccaagtaattaaaaacctataaatataacatagggattattttgataaaatgtaaaaactttgttttttaggccagttacgaaaaaggcaaagaaaaacctgcaatgtgattgcttctccttatgggaaactcatttagataacctggaagtcaaacttgatgaaaaaaggactcaaagtcaaacttgatgaaaaaagaactcacattccatcaaacacaggaaaagtgtgtcccaggttattagtatgtcatggaaatgcatgactcttagtgactgcatgggaagttcttgggttacatggaaaaattcagacatatcaagaaaagctgagtacaatatcaagttgtattcaaggaaaacattgcttttctatataaaacatttccgcatcagtctacaacaacagttaaaactggaggaaaaaagttatggaattggatgaagaagttgaaggagagcattatcatcttaggccttctcaacagaagaaaaagctgaaagcagtgagatacaacaaaagttgaacttctgagatatgaatctgaaaagttttcaaaaagaaacaggttatagaattaaaaatcaaaattctagtaattttattaggagcaaaccaatgccttaagaaaacctcatttaacatagaggaccaatcatagaagaactattataaataattcccttttaaaaaaaaaactaactgaatcacatcaaaattgtttttataaattctctttcacaaaccttattacaactttcaaaaccatctacagcatacttggactttctgatttgttctgtacttccctcttttctcaataactagccattttactttaggaccaaaatttaccatataagatcctttcttacacacaattattctctttttaagctttcctactaaaaatacatcttcatattcatagccttcttcatacttctgtcttctacttactggttcctttctaccttatttcagaaacaacttttaaataatctccatatcacctaaatttattttttctcaatagtaacacagctttacatgtcttataatttattctctcatcaaagcccacatcttaccttgacactttatatagagaattattatgtcaactagaattcttacttttagtaaccttaaattttagtgaaaacctaggaggcaagaaatcctgaataatctatcagatattaatatgttatggatgaaaacactccaaaatttttataaacgtgtttccccatatcaaaatcctttcttaattgaaaatgactcagatatccaatcagcacctatttatcaattgaaactaattttaagattttaaattacacaaagtaaatagaatcatttattctatttacatgtactcaattctttcacttatgacactttacctaaattacatcttaactcaggtattaaacaaagccagtcatcatttaaatttatttccctgttaaccatttttaaagcctgtgaacatcagggttcatctaagtaagaaccttaaagttaactcatgagcattttgccaataactcagatgattcagctgttttcattgaacaaacgatcttgtattcgtcttatttgtcaaaaaaatcacataaacaaagactattgtgtttttggttgggtttatagtcttatgatctgatgccaaaccctgatatcttaaaatatctatcaaaggcaaatataaaataatcagtaaacccaaaaatgtgtggtgaaaattccaaagacatttctattgtattttagtaataattttgaaaccatttttatttaccaaagatacctaaattcacatgaacttgcaaagcatttgagcttatttaatgtacaagtactcatttacttataaaccaatttgtagcatgctagacataacaaataatgcatctacatacacataaacacatctaaacagatatatacacacacaagccaagatccaattgtttttaccttaaaattctagccataagatggcatcacaaactcactggcctgtaaatgccacccctgtggtctactggctaacatttggtactttcgctggcctctaaaagatagctggatccaaattatgtctgaaaacatatgccaaaactttattttccccagtagataatctggtgaaggatgtagaccaaaattatgggtaaaacagttttcatggcagtttaatttttttaaaaacctgttttatctttttttccttccgtttcaaatgaattttcaatgtttacattttagctagaacttgctgaactctataaggaaacagaatttccaagtaacttcagattagttggtgctatataaaaagtgagttttatctcaacgccagtagcttaataatgggaaattcaaagcaggcagaaaggaaagagagcaatagaaagtgatatggtttggatatttgtccactccatatctcatgttgaattgtcatccccagtgttggagctggggcctagtgggaggtgtttgggtcatgggggcggacccctcatgaattgcttagtgctgtcctcacagtaatgagtgattctcagtctattagttcacccaagagctggttgtttaagagccttgtacctcctcctgtctctctcaccatgtgacacacctgcttcctcttcttcctcgatgaatgaaagctttctgagacctcaccagaagctttccagaagccagcaccatgcaaaaccattagccaaataaacctcttttctttataaattacccagacttaggcatttctttatagcagtgcaaaatggactaataaagagttttagaagacactacttaactctgtagttgcaggttaacaatttgatctctgatttttcttgctataatttgcctatcagtttaaaatgtacacagaaatgggccataatatgtaacagctgtaatcccagaaaacctagcatgcatttgaactttctcatattttaaaacatatagcccagggcccacaaaaacaaagacaaatgcaaatgaactgcttctcaaatcagatacaagtccaacactattccccctctccaacaggataccccagggtaaaacaaaatggctggttcaaggaatgaacccaaacagagggaaaagggagttcccggctgtaaacaccagagcaacttgtcctgcttctgaatcgagtccattcactcatagagatttttcaataccttgtttcagcagtatgcatagagacagccagtactgccaagggaactagcaggggtccctggaggaaaaagtctccagcagctgatagggacatagccaggaattccttagctggggccagctggccaggagcaacttctcctggctgcaggcttccccaaattgtgagtccaaactatttctgcttgctgcatgacagccaatgcattgagagacaaagagttggaggaaggtagacaactttatttcagggagccagcaaacagaaaagatgggggactaacatcctaaaaaaccatcttaagtcagtacaaatttcaggctcctattatgttaagatcagggtgaaaagaaaggagttgggattaagaggtgaccaatgactgcagacatgtgggcaccagtgaggggcttaggaggccatgaaacgtctccatttttggtcagatcacaatacccccacaaattctcaacacaacattgttacttgtgtattcaccctctttatctcctcaggggttagttttaggaagggagtattatcatctttttttcaaacaataaatgaaattcttcccctagttagcttggcctaaattcacagataagcaaaagtatttaacctaaaagatagcaccccagtggagtggggatgggtgttgtgaggttacaggcaaaattgagttaataatgttaggcctgcttttcactgtcatagtctgactagagtgtagagtgccataagggcaggtgacagaaaatgtggctggcaagattgttttcaaactctgaagagctctgcatgcaaggaactttgggttttgttctccaggaaaaaaagaagtctcaaaagtttttaaagatcaatcaacataagtgaataaaaattaacttaagaagatgtgaatatgaaaaaagaaacaggattggtatgttatcacaataattcaaatgagagatgatgagctttgaagttacgcattgacaataagtgcttctcagatgacaagaattgtcattttcaacatgtcactgacaggacttggaaattatttgactgaaggaagtggtactaagagaagaaaaaatggcatggtgcattaactagaacaaggaacactggtgatataacgggtgttgtttcttcataattaaaaatttttcaagggctatgtggaaggaagaggaaataaatttaataccaaaatttaaactgaaaaatagacaatttgggcataggcctcagaggggaaaactgagactaggggtaagaatttgagagtgactattacatataggtagtaactgaaaccatatctgccatgtgatcaccagctaaagcaatgcaactattttaccaaaagagaatgttgtgtcaaaaggggttaagaaaaaaataatttaggaaatatttttggttgggcacagtggctcacatctataatcctagcactttgggaggccaaggcagaaggattgcttgagctcaggagtttgagaccagcctggccaacatagggaggccttgtctctacaaaaattaaaaaatatatattgtctgggtatggtgatgcccacctgtgatcccatctattcaggaggctgaggtgcgaggattgcccaggaagtcaaggctgcagtgagttgtgatgacaccactgcactccaggctgaatgatggagtgagatcctgtctcaaaaagttattttaaaaaggagattttttaaaataaatggagcccaattataaacaatggaatggtttcaaaaatggttagagttgtcctaaatgtagttttttttaatgaaagaaaagaaaaagaaacatacaatgatgatattattagaagaaattattttttaacttttattttaggtttggaggtacatgtgaaggtttgttacgtagtcaaacatgtgtcatgggagtttgttgtacgtattattttgtcactcagatattaagcccagtacccaatagttatcttttctgctcctcttcctcctcccaccttcctcaagtagaacccagtgtctgtttccttctttgtgttcctaagttcttaacatttaattcctgcttataagtgagaacatgtggtatttggctttctgttcttgtgctagtttgctaaagataatagtctccagctgcctccatgtcccacaaaagacatgatctcattctatttttatggctacataatattccatagtgtatatataccacattttcttaatccaacctgccattgatgggcatttaagttgattccatgtctttgctatcatgaatagtgttgcaatgaacattcacatgcatgatctttatggtagatgattgctattcctcttggtatatacccagtaatgggattgctgggtcaaatggtagttctgcttttagctctttgaggaatcaccatactgctttccacaatggttgaactgatttacacccccaccaacaaggtgtaagtgttcccttttctccataacctcaccagcatctgttactttttgactttttagtaatagccattctgactggtgtgaggtggtatctcactgtggttttgatttgcatttctctaatgatcagtgatactgagcttttttttcgtatgcttactggccgcatgtatgtcttcttttgagaagtgtctgtgcatgtcttttgcccactttttaatggggttgttttgctgttgtaaattttaagttccttatagatgctggatattagacttttgtcagatgcatggttggcaaatattttctcccattctgtaggttgtctgtttactctgttgatagtttcttttgcagtggagaagctcttaagtttaattagatcccatatgtcaatttttgcttttgttgtgattgcttttggtgtctttgtcatgaaatctttgtctattcatatgtccaggattatattgcctaagttgtcttccaaggcttggataattttgggttttacatttaaatcttcaatccatcttgagttgatttttgtggaaatgatccagcttcaatcttctgcatatgactagccaattatcccagcatcatttattgaataggaaatcttttcctcattgcttgtttttgtcagctttgttgaagatcagatggtcatagatgtgctgccttattttggggccctctattttgctccaatggtctatgtgcctgtttttgtacctgtatcatgatttggttactgtagccttgtagtatagtttgaagttgagtaatctgatgcctccagctttgttcttttttcttaggactgccttggtttcatatgaatttttaaataatttcttttctagttatgtgaagaatgtcattggtaattagataggaatagcattgaatctgtaaattgctttgggcagtagagccattttaatgatattgattcttcctattcatgagcatgagaagtttttccatttgtttgtgccttctctgatttctgtgagaagtgttttgtaattctcattgtagagatttttcacctccctcgttagctgtattcctaggtattttattctttttgagtccattgtaaatggaattgcctttctgatttggttcttggtttggctattggtggtgtataagaatgctagtgttttgtacattgattctgtatcctgaaactttgctaagttgtttatcagctgtaggagctttagggctgagactatgaggttttctagatatagaattatgttatctgcaaacagagttagtttgaatctctcttcataatcggatgtgctttatttttttctcttgcctaattgttctggttaagacttccaatactatgttgaatagaagtggtaacagaggccattcttgtcttatactggttttcaaaagaaatgcttccagcgttttcccatttagtataatattggctgtgggtttaccatagatggctattttttttcttattccaaaaatgtaatatgatttaatgttaaagacaccatttttttctttgttaaaattaaaagatgtttctgaggtgaaaaatactatgatacacatataaaaccaatggccaaataacttatatctgtaatcacatttttgaacctccagaaaatatttctttaaaaattttgatttggtgataataacaaactccaaattaaatgttaccaacctataaaaaatacatttactttttaaatatggagttttttggttaataactaaatggaaagtgttacatttaaacctgtaatttaaaaaatgttgagtctccatttttacttttaataactaagctttatgttgatcggggaagttttaagagtagatgactttgcattgcatctagttacttcttgctagtcatgtatacatataaaattagttgaggattatcactactgtatttattttgtatttttctttaagcctatcattctcaaatttgtatttttcacagtaatgcatttttaaggaatttattcatattatcttgattgacatattgtaccataattttaaaatgtatagggtacaatgtgatgttttgatatatgtacacagtgtagaatgattaaatcaagctaattgacatatctatcacttcatttacctatcattttttatggtgagacatttgaaattcactctctgagttattacgaagtatatatcattattgactacagtcatcctgctgtgcaatagagcacaaaacctgttcttcgtgtctgtctgaaactttgcaccctttgatcaacaaccctccattccatgtctccccacactggctcagaggctgggtaaccataattctactctctacttctctgatttcaactttagtatactccacatataagtgagatcaaacctttattgttaataaaatcatgtagtgtgtgtatgtgcatgtaaatattgctacaaagagaatttgttaaaataataacctgttatttgaagagtttgataaaattctggtaacaggtatcctgcggtgactttggcttctcaagtcagaaacaaatttaatctggtttccttgtcatttcaaagcttgtcattggttgtctggatttagtcaaaacatgaatttacttattatctgtcttagtgggtttgggagcatctttgtaaagaacaaagttctgtgttgggtacttaatcatttgtatggccagcaaggacagcacattatacagaatgctcctaactacatgaaagaaattatttcctgtgtgttgttgtatatgtgagggtatgcgtatctgtatctgagtgtgttttgttgatgccatcaaaaatcacttctcaacatcctaaataataatcacattccctttaactgcagacagtttttcttagcagaaaagcattttaaataggagcactggatctcgcagaatttctatgaattttcctggaaactcagcaatttacttagttctggaacacttgctatcaaatgcaagaagagaagcttttagaaggtagagctgttttccagtagtttatatatgaaacaaattgcactcccttgccccatctgtactaatggagcaaaggagacatttagagcagtaacttcaacaaaaatactttttcatatagattacaaagagcatgtaagggcaggagaagtccagtagaaaatcttagaggtagcaaaggcaaactgaggccttcattatccacttgtttactattttacagtggtaatattcttagaagttcagtttaaggctctttaccttaaaacagtggatcactaataccctgccctgaccacatcacatgatattctcaaaatgtaattcaatcctaatgcaaaaatgccttgtacacttcaaagtgctataaaaatatcaggtaaaatgcaaacagaaacaaggtatatgtattactgaatatagcagtaattttattgaagttttctgatctttaaaggcagagaaagttactgaaaacataaaaacattcattcgatggtagagaatataaagtctaaacagtggaattcttggaagatttagaaaagttaatgaaacattttatatgcaatttttattaaaacctattgtcaaaaagttgaatcgaatcaatgaaacttcattttataaataacatgtctatcaaaggtactgcaataaaggtaaagcatttcttaggcatctagagtaagttaggaattcagtgtgttggctcagggtccaaatcagtttaacaaactcaaattttgtatgtgtccagtttctaaggacaagagtacaaaggagtacaaacctgttttctcaaacagtgtgccaatggcaggccatctgtactcttctaaaccactctcaatcttgcccttaatctgtaaatatcacccatcctcttataaatccctttttttggatatatgaaatgcatattgatacatatcaagaatatatttattgataagcccagagccttgttatgtaagtcagcataagtgtttctttaatctcttatagatttttaatcaaataaatctaatcaaaacaactccgtgcattatctagtgtattgtatgtggtcattcactgattcaattttattttcatgatattataaaaaatttgaaatatgtctaatgaaagctaggatataaaattattttctggatgggtgcagtggctcattcctataattccagcactttgggaggctgaggtgggaagatagcttgaggtcaagagttcgagaccaaccggggcaacatagtgagacagtctctacaaaaactaaaaaaagaaaaaaattagccaggaaggcagtgtgcacctgtggtcccagctactcacaaggctgaggcaagaggatcacttgagcctgggagtttgagactgcagagagctatggtggtgccactgcactccagcctgggtgacagagcaagaccccatctcaaaggaaagaaaaaaagaagaagaaggagaaggagaagaagaagaaaagaaaattacttcatggtgaataaaatgtatttcattgccttgtaatgatgtgaagccttgtagcattttaatattatcttcttgtgaaaacaatcttcatggtaacccaggaggcaagctgtcagctgtgagaactttgggaactcataatgatgattatttcatttatttatttatttattatttatttacatttagagagatggtctcactctgtcacccaagctagaatgcagtagcacaatcacagctcactatagtctcagactcttggacccaagtgatcctcccatctcagcctcctgagtagctaggactacaggcacattccaccattaccagccagctttttaaatttttttgtagagacagggtcttgctttgttgcccagggtggtttcaaactcctgacttcaagtgatcttccacctcagcctcccaagcattgggattacaggcatgagcgactgcaactggccctggaactaatgattgttaaaatttgcttccagtggaaaatatggctccagggatatttaatttttatgtcattaaaaacctttctttaaaaacagtaataataatcattcaagatgaaaacatgaattaactttatattaaacttttgcccaaaagtcactatggaccagattttattggaagtttcatttattgtatttctcaacatattgtggactgccaaaaacattaataatgcaaatccatgtctgaatacaaatgaatccctacaaggccagtgttgattattaatggaataaattatctggctacttagtgcagttactgtggtttggaataccagttaataatgaaagaagggaatttttaaaaaatgtatctcatagtttgaattgattctaccatacaagagatcaaagagaaaatactgtggcaacaatgccttctccctttttcctttttctcatcaataagaaactcttctgcaagcgcatttcattgttattttccaaatacgaagaagtagacttgtatttttcagaagagccaccatttttccaaaaccagaaactcaagttttatgttgcccaagttatttctgctacaggaatgttgggactgtttgaggctaccttttcccaaggaccccaaaattgccttgaagtatagaacattgtgtcttctttcagagtttccatagctacaagtatttgcagaaagaatactttgcaccttggtagttttcataatgctttatttgtggtgattttataagtgtaaaatagaagaaagcagagctgctagtctggttaaagaggacatgaaagcatatttatatgccttcacccataaactcaggaagacactgagccatttcccccagaagccttacaggtctatggacatcagcttgaaatcaactacttacaggaaattgttgtatgcatgagaaaaattaatccatgtgagcatcacaggttcatctcttaatcttttggcaagatttactcatttaataagcttaacctgaatatgacatgcctattatagtatggaagaatatatgtgtaatcatataatatatatattatattatataaatttctttctccagacagaaaggtttgctctccaagatgggagatttttcactgtacctttatgaaagtttgatggatagtgtgtgaggtgtcgtaatttttggtttgaccactttccagccacccactctgtcattgtaacatgccatctggttccagaccctaatgatacctatatttctctaccactatttctttattgataattcttgtttgcagtagcactataataatgtgattatttacctctgacctgcgtattagcacacacacttccagaaacaacagatttgttgaaatatcatttttaatgtctaataagttaaactcccttactatctataatataaaagttcatcataagtacaaaaggaaacatatattgtttgcctacatatcaaatagaaatatgtattttaaaaagttctcattatcagctgtaaatttgatgctggcccaatatcattttttatagagaaccacagtataaaactcaccctgtttttggttccatatgaattttaaagttttttccaattctgtgaagaaagtcattggtagcttgatggggataacattgaatctataaattacctcgggcagtatggccattttcacgatattgattcttcgtatccatgagcatggaatgttattccatttgtttgtgtcctcttttatttcgttgagtagtggtttgcagttctccttgaagaggtccttcacatcccttgtaagttggattcctaggtattttattctctttgtagtaattgtgaatgagagttcactcatgatttggctattactggtgtataggaatgcttgtgatttttgcacattggttttgtatctgagactttgctgaagttgcttatcagcttaaggagattttgggctgagacgatggggttttctaaatatacaatcatgtcatctgcaaacagagacaatttgacttcctattttcctaactgaatatgctttatttctttctcttgcctgactgccctagccagaacttccaaaactatgttgaataggagtggtgagagagggcatccttgtcttgtgccggttttcaaagggaatgctttcagtttttgcccattcagtatgatattggctgtgggtcatcataaatatctcttattattttgagatatgttccatcaatacctagtttattgagagtttttagcatgaaggactgttgaattttgtcaaaggccttttctgcatctattgatataatcatgtgatttatgtcattggatttgtttatgtgatgtattacgtttattgatttgtgtatgttgaaccagccttgcatcccagggatgaagccaacttgattgtggtggataaactttttgatgtgctgttggattcggtttgccagtattttattgaggattttcacatcgatgttcattagggatattggcctaaaattctctttttttgatgtgtctctaccaggctttggtattaggatgatgctagcctcataaaatgagttagggaggtttccctctttttctattgattgaaatagtttcagaagaaatggtagcagctcctctttgtacctctggtagaattcctaccagaatccgtctggtcctggaatctgtctggtccaggactttttttggttggtaggctattaattattgcctcaatttcagaacctgttattgctgtattcagagattcaacttcttcctggtttagtcttgggaggctgtatgtgtcctggaatttatccatttcttctagattttcaagtttatttgcatagagatgtgtatagtattctctgatgatagtttctatttctgtgggatcagtggtgatatcccctttatcattttctgttgcatctatttgattcttccctcttttcttctttattagtcttgctagcagtctatcaattttgttgatcttttcaaaaaaccagctgctggtttgattgatttttttgaaggattctttgtgtctctatctccttcatttctgctctgatcttagttatttcttgccttctgctagcttttgatttgtttgctcttgcttctctagttcttttaatagtgatgttaggatgtcgattttagatctttcctactttgtcttgtgggcatttagcaaagacaatcccaagcaaaaagaacaaagctggaggcaaaatgctacctgacttcacattatactacaaggctacagcaaccgaaacagcatggtattagtaccaaaacagatatatggacaaaggaaacagagcagaggcctcagaaataacaccacacatctacaaccatctgatctttgataaacctgacaaaaacaagcaatagggaaggaattccctatttaataaatggtgctgggaaaactgtctagccacctgtagaaagctgaaactggatcccttccttacacagtatacaataattaactcaaggaaaattaaagacttaaatgtaagacctaacactgtaaaaaccctagaagaaaacctaggcactaccactcaggacataggcatgggcaaggacttcatgtctaaaataccaaaagcaatggcaacaaaagacaaaattgacaaatgggatctaattaaactaaagagcttctgcacagcaaaagaaactataatcagagtgaacaggcaacctacagaatgggagaaaatctttgcaatctacccatctgacaaagggctattatccagaatctacaatgaactccaacaaatttacaagaaaaaagcaaccccatcaaaaagtgggtgaaggatatgaacagacacttctcaaaagaagacattcatgcagccaacaaacatgaaaaaatgctcatcatccatcactggtcatcagagaaatgcaaatcaaaaccacaatgagataccatctcacaccagttagaatggtgatcattaaaaagtcaggaaacaaaaggtgctggagaggatgtggagaaataggaacacttttaagctgttcgtgggactgtaaactagttcaaccattgtggaagacagtgtggcgattcctcagggatctagaactagaaataccatttgacccagccatcccattactggggatatacccaaaggatgataaatcatgctgctataaagacacatgcacacgtatgtttattgcggcactattcacaatagcaaagaattggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactatcacaaggacagaaaaccaaataccgcatgttctcactcataggtaggagctgaacaatgagaatacatggacacaaggcagggaacatcacacactggcgcctgtcagggggtgggggctgggggagggatagcattaggagaaatacctaatgtaaatgaggagttgataggtgcagcaaaccaacatggcccatgtattcctatggaacaaacctgcacattgtgcacatgtaccctagaacttaaagtataattaaaaaaaaaaaaaactcaccttctttggtactttctaacagcaaagaataactttcagaattaaaatataataataatctgcaatttgctgactaccaaatctaaagtaataccaacaaaatgtgattcagggttccttccttaagacattttcatttaggattatgctattctaaagtagtttacttttccagggatttctgtgatttattttttaaatcttttttatttctaatttttgtgggtatataatagatacatctatatatatatacacatatatctagatatagatatatctagatataatatatatagatacagagatatatatatctatatctaatatatatagatatatatattatatatagatatatattagatctagatataatatatctagatatatagatatatatgtatatagatatatctagatatatagatatatatgtatatagatatatctagatataatatatctagatatatagatatatagatatatatgtatatagatatatctagatataatatatctagatatatagatatatatgtatatagatatatgtagatatatctagatatatagatatatatgtatatagatatatctatatacgtatatagatatatctatagatatatatatatagatatatctatatatgaggtacatgagatgttttgatacaggcatacaatgtgcaatgagcatatcatggagaatgggctagccatcacctcaagcatttatcctttgagtcacaaacaattcagttacactctctgagttattttaatatgtgaaactaagttattattgactatagtcaccctgttgcactatcaaataatagttaatagttcattatttcttttttcttttttttttttttgagatggagtctcactctgttgcccaggctggagtgcagtggcatgatcttggctcactgcaacctctgcctcctaggttcaagtgattctcctgcctcagcctcctgagtagctgggattacaggggcccaccaccacgcccagctaatttttgtatttttagtagagacggggttttcccatgttggccaggatggtctcgaactcctgacctcaggtgatccacccggctcagcctcccaaagtgccaggattacaggcatgagccactgcactcagccatttattctttcaatttttgtttttacccattaaccatccacacctcccacttcaccatcccctcactccccttcctagcctctggtaatcatccttctactctctatgtccataagttcaactgttttgatttttaggttccacaaataagtgagaatatgcaatgtttgtcttacttggcctggtttatgacttaagataattatctccagtttcatccatgttgttgcaaatgactgaatctcattcttttttatggccaaatagcactccattgtgtatatgtaccacattttctgtattcattcatcctttgatggacagaggttgcttccaaatcttagctattgtaaacagtgttgcaacaaacataggaatgcagctacatctttgataaattgattttctttcttttggatagataacccacagtcggattgctggatcagatggtagtgcaatttttagatttttgaggaacctccaaactgttctccatattggttgtactaatttacattcccaccaacagtgtacaagggttcccttttccccacaccctcaccagcattgattatttcctgtctttttgatataagtcattttaactggggcgagatgatacctcactgtagttttgatttatagttctctgatcatcaatgatgttgagcaccttttcataagcctgttttccatctgtatgttgtcttttcagaaatgtctattcaactcttttgctcattttttaattagattattagatttcttccctagttgtttgagctctttatatattctggttattaaaccctggtcagatgggtagtttgcagacattttctcccattctgtgggttgtctcttcactttgttgattgtatcctttgctgtgcagaaggttttcacttgatgtgatcctgtttgtccatttttgccttcgttgcctgtgcttgtggggtattgggatttctatgatttaaatagcgagagtttaaattacaattagacattctagttcatacaccaatttcagtcaattaatgtttgcattaaatatatctcagaggaatgattttttttaaaaaaagtaatgcttggaaaataaatttatatcaacattcaagtttttaaaatattgtcccatgttttcctttcaatttttttcttatttttacttcaatttgctttgagatattttgctgtttattttatagtcttactataaatgaaaatatttgaaagcctataaattatgtgtctcatgtgtacagctgagtataatggtcagagttgaatgggtcagttagatttgattcagtttgatgaacaagagcaaagccataactgtgttatgctgatagtcacggcaataatttcacaatatagatggtcatagtattctcaatacaacagtactactgtttcaatagagcaaactaatttcatatttcctcgttttcacccctttggggccacaaaaaatgtatttgaaatttacttgttccattaaccacatactcaacatttaaaagctgcaaaatacttctgattgtgacaaaaaactctcctaagaattccctagaaatctctttataattctttcctattaacaaaaagtaaaaaaaaaaaaagatgaagaatgcagaaggaaagtgaattcatatatgtatatattttaagtcttataaattcacagctgaaggggaattcaatctgtattgctattgaaaatatatacagtttattgcaatttaaacgttttatttcctcacagtttgacatgattagaatgattgaagaaaattttttaaacactagcgtagcttaaaaatgagcaaacaaataaaaaactgaaaggtttggatgtattcacatccttgtcagtctgttataacgcatgtaatggaatcagcttggagtcggcactcaaattttgttataaacaaaataataaaaagagaaagacacacacacacatacacagaggaagagagagacaacagagaaggagagaaaggaagataaaaggatgcaaaatggatttcaagaacccaacttttattaaatatttattttccattgtaatatctcttcatttaatttttaaagcctagcaagttattttaagcaattctaacataaaaattacccttccaacattttccaagtgtgcagtacaatattgtcagccacatccacatggttgtgcagtagtgctcagaaccaacccacctccaccctttcatgacggaaaccctatacctttagaagactccccagtagctcctccccaagtgctgaaaaccctcattctactttatgtttctttgtctttgattacttttgataccttataagtggcatcacacaatatttgtttttttgtggttggcttatatcactttgcacaatgtccttaagttcatccatgctgtagtatgacagggtttctttcattttgaagctgtatagtattctattttatgtatgtaccatattttctttattcatttatctgtcaagagatgtttaggcttcttccaccacttggttattgtgagtaactttcttcatgtcattttatattcaattgaaaactgtcaattgttccatctccaatctgcccacattgttattttgatttcctaattttagtttttagcaaagatgttgaaaatgtgcatctgtgcttacttaacattcactatatattttttcttattcaatgcaggtatttagataacaataaggtagtcctgttcaaggtgaaatagcactgtgaggtgataaataatggaatgctgtctgtccttgcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggtgagtatttatcatagattgtgttttttttttaattattatactttaagttttagggtacatgtgcacattgcgcaggttagttacatatgtatacatgtgccatgctggtgcgctgcacccactaactcatcatctagcattagggatatctcccaatgctatcgctcccccctccctccaccccacaacagtccccagagtgtgatattccccttcctgtgtccatgtgttctcattgttcaattcccacctatgaatgagaatatgcggtgtttggttttttgttcttgcgatagtttactgagaatgatgttttccaatttcatccatgtccctacaaaggacatgaactcatcattttttatggctgcatagtattccatggtgtatatgtgccacattttcttaatccagtctatcattgttggacatttgggttggttccaattctttgctattgtgaacagtgccgcaataaacatacgtgtgcatgtgtctttatagcagcatgatttatagtcctttgggtatatacccagtaatgggattgctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttgtgatttgcatttctctgatggccagtgatgatgagcattttttcatgtgttttttggctgcataaatgtcttcttttgagaagtgtctgttcatgtccttcacccactttttggtggggttgtttgtttttttcttgtaaatttgtttgagttcattgtagattctggatattagccctttgtcagatgagtaggttgcaaaaattttctcccattttgtaggctgcctgttcactctgatggtagtttcttttgctgtgcagaagctctttagtttaattagatcccatttgtcaactttggcttttgttgccattgcttttggtgttttagacatgaagtccttgtccatgcctatgtcctgaatggtaatgcctaggttttcttctagggtttttatggttttaggtctaacgtttaagtctttaatccatcttgaatttatttttgtgtaaggtgtaaggaagagatccagtttcagctttctacatatggctagccagttttcccagcaacatttattaaatagggaatcctttccccattgcttgtttttctcaggtttgtcaaagatcagatagttgtagatatgcggctttatttctgagggctctgttctgttccattgatctatatctctgttttggtaccagtaccatgctgttttggttactgtagccttgtagtatagtttgaagtcaggtagcatgatgcctccagctttgttcttttggcttaggattgacctggcaatgcgggctcgtttttggttccatatgaactttaaagtagtttgttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaattgcttcaaagagaataaaatacctaggaatccaacttacaagggatgtgagattgtgtttttttgctttgttttgttttgttttcttttggtgaggggaggtggtggtaaattttttaaacttgagagaagaaaatggatagactgtgatgagaatagtccgtgagaatctgctattaataaaaacaaggccatttaatacataatgattgtctctctacatgggtgtctcccgcttttgttgctgtctctgaaagtggcagcactattatataactgaatgattgctgtttatactaaaaaaaaaaaactcaactagagaaatagcaaatgcttttcttctaaatagtgatccattctgccaccaatgctgtaatgcacattatttccgtgttcaaagaggcttttgatttggaaaatttgaggggccaggaatttctccaacttcatgaaacatacacagtcataactaagaacatacaaaatgaaacaacacatggaaaggacgcatgggtctccagaagatagtttgtcaatgtcaatggcatgctcggtcagcagtgttgtactggatcaagcctgtactgactcttggttggtaaatttttaggaattttctgaacttatataccaggttgaagtctaaaggagtctaaagtcagaaatttaactgtataatataaagctatgcatgtatgaggaaaaaatacatggatagtgttcttataattgggtggtaagaaaaactttcctaactatactttaaatccaggagaaaagtttcattacacacacacacacacacacacacacacacacacagaccccttttgcatgacaaaaacaccataaaaaagtaaaaagataactggaaaatgtattagctaactctaccacaaagaattagcaggtcaatatataaaggtcttctataaagaaaaactatacccaaaatcatatgataaaaatactagaaaagaaacacataattcacagaaagacagtgcaaatgttctttaaatatttataaagttgttcaacctcagtcactcctgataagagagatgcaatttctacccatcggtttagtaaaaatccaaatgcttaacagaatttttttaacaagactgtggttaaaaaggtactatcatgactagctcaatgcaaaaagttagagtggaatttgacagtatatattaatagaaaaaatgaatgtacatttaccatttgacccagcaatctctctcttaggaacctatttcaaagacccactgacaaagttacagaaagagatatgctcaaggctatttagtgcactgtcatttataaatgcaaaaaaaaaaagttgccaataaaagtgcccagcaatacatggctgactgattaaattatagctcatccaaacaaaagagtataaatagtaataggaactatcttttttatttttaggacagggtttcactctgttgcccaggctggagtgtagtggtgtgcccttggctcactgctacctctgcctcccaggctcaagtgatcctcccatctcagcctccagagtagttggtactacaggtgcatgcctccatgctgggctaatttatttttatttttatttttagcagagacaaagtttttaccatgttgcccaggctggtcttgaactcctgatctcaagtgatgtgcccaccttcgtctcccaaacttctgggtttacaggtgtaagccaccatgcccagccaggaaatacctttatataatattatatagtgatctccaggtagtgaaaagtacttatagaatgccaacattcatggaataaggatttatactattggatgcataaactataactttttaaaaaaagtttatgtagatgtggcagtggggagaaaacagtataaggggcaggaataaaagcgagaatattcctaatgtgtttggtttttacactgtttcatatatttaactttggaactatatatatttatgtaactattaaactgtttttttaaattcttcaaattaaaagaaaagtgatgcaaataaacttcaattgtttaacgagttgttggcatagcctcacatagagaggaactcgtccaagtgattccaaaaatcataatttgactccataagtttgaagccagtgattaaaccttaaagtattttcagtaatcatattattatttggggactgttgtctatatattgtggttaaaagcaaattgccaattatgtgggtgtcagtgaaagctagcattttcagcacgggtcaaagtagacacagatgtaaaatcagtacatttaaacaaaaactccgtagtcttgtatttgaattggtagtaccagtaggaacttccgatgtatttttttgttttttaaaaaacacaaaatatatctccttttcccggaaatgcttggaaaccatggccaacttgaatttaaaattttgaattaggctgggtgagcttatattttgggagaaattacattattagtctgagtttatactctaggaaatcacttagtttacagtgctggaagtatgtttcatatatagctagatagttttgggggctcaatgcaaaatgaaaacatcaagcctcttgtttaaaacttaaaaatttaaggcattgactgtagagaattaacctaagcatggaacttttctaagcacatggtactgtgggactacaaacacttcatgacccactttgcccttttaatttacttagtaagccagaggaaagcattgctttttcattaaaggcagagagctaccagtggtaagaaagataacgtatacaaataaggaaaagaataatacacaagtgagaacactttgaaagagtattttgagaagaaaagagagcactctggggcagctaccaatcctgggtaaaaattgataacaaatccaaaagaaagttttgttatgcattgttaatgaacagggctcccaaagtccttcctgactttcaaccaattctccatagaggaaccaaaataatttttaagaaaaggcaaatctgatcacgtcacttcaccatctaaaaccttctatgggctttcattgttcttagggaaaggatgtgagccagctcttccagcttcaaggtctactcacctgaagttttctttcacctgcttctcccccactctctcctcattcattgaacacccttttttaaatccagaactccaagtctagatgaagtatagatatacactctcatagtatcctcaatttaacctctgaagcatgtatgatagcgcacacacacacacacacacacacacaatcacacaacattggtacctattcctcaattatatttttcagtggtgcccaaaagccacataggaaatttggtataaatcccaggtatgcaggcatataagtgtttagaaagcatgttttataaatgcacagtttggatatacatgctgtagtactatgttgaggtctattttttctgtatgtttctccccaaaaactttcctatcataaaatgacagaggctaaagggacatgagaaatcatttgatagcaaccacttcattgtgtaaagaccacaaagaaagaaacagggctggaaatttatgtgacttgctcaaggtcatgtataatgattttggagttgtttagttaattcatgccttggctcttttttttttttttttttttttaaggcaaggtctccctgtgttacctaggctggggtgcaactgcaatgcttccacctcagtcgtctgagtagctgggactataagtgctcactgccacacctggctaatttttaatttgatttttttaattattttttgagacaggatatcactatgttgcccaagctggtcttgaactcctgggctcatgcagtcttcctgctttggttcttatatgatgagatgatgatatctcaaggacacagcaaccaataacatcaaacacttcaggctgtctgtgtacacttcaaatgaaacaaaagtaacagattaatcagtatggcatgcagaaaattaaaaatgatgtgaatttctttgagcaatgactttgggctgagtgtagctgaatttaaataaaaaacagcaataacaacaacaaagatcaaaacactaatcttggcaaacaaaagctttagtctcaaaccaaagagaatttgtctagtgtatatttgagaaaggattctagcaatgtagtggtagcaagggaagtgatgtttcccttgttacgtatcaactctaaataccagtttcgttttcttcacccaaaaaatgtatactacctgtaacaatgatattgtctcctgctcttttacttttgtttgtttagtttttgcttgttttaatcacagaaaggcagctagattgattgggcccacaatgtcctttatttgtgtactttcttcataaattctgggaattccaaatgttctgactttttaaaatggcattatcatatctatcatttcttcatctttaagacatcaaaatagtcattccctgtaacagttttggagctctggagaaagaaactacatacatatgcataaatcttgagagctaaaaaggacataacagaagattagcattatattagatgccagcctcatagctgatggatgacaactccagttaatctcagtttgagaattcttgagtttaggatttgtagagatctgaaatgtgtggaagggagtagtaacttctaagagatcaagtagaactaaccttacatatgatttaatttataaaataggtgaaaacaatcagaattcaagccactctctggagaaattgtgaagtatgatgcaggttggcaatagaattaggagtgcaaagattgaagggaaaatgatgtttccagaacctttaaaacaaatgtcattaaaataacactatccatgcagattatatcatgttcaagacaaatctataggcagaagaataaaagagcataccttagcagcatttgaatttgatttaaatattttggagttctcatgttcaaatctttgtaactttaagagaagcgaagttggataaggcagaatcaatgacatcaagtaaacaaaaagagatatattcttcctcttcttgtctatatgtcaaaatcctttaggactctgattaaatactccgttattctacctcatcatccttccactctttggaagattgatcactcccctgcatgtgtctttattctaatacctatcttattgaattgagagatacattttcaagaaaatttcccattatacatatgcattccttgaaagcagaaacttcatcttgttcactgttatatccctctaagtaaggtcagacatatagcaagtgctcaataatatttgcttaataagtgaatatttagaaaaaatagaatgatatcaaaaggaaaaaggctacagagataattatgtaccttggatggcaggagggaagggttaatcttagataaatcaaagcaattggaggcaaggagaatgattaaactgaacttggggattctgtgggtgaaagaggaaggctccagttcattcatcagtttatgggtctacagtagttttagagttttataaactcctgtttaatagcaatagaaaatcttgcccgattggagacttcatagcaaggaaatattctgtctaccaatgatgccaggatgcccttcaaatccatcattagccaacctccatttgtttggagctggcaaggggctgcacccaacaatccaaattttcaagttggagaattatcaaaatgacagcagttacaatctgtataaagaatttattcaaattatccaactgaaatgaggagcaagcaagcagccaatcctcctgttattatcacaccatttacataggactttggactgctttctttctatcaggaagttcacattgagctgtctaaagagggcaattgtagttcactgcagttattcattggatctcttgagtctaaattatatgcataatgcataagttaactactgatgtttctgctctacaaactccgtggggggagacttttcaatttgtttttcaactctgttataaactgggctgatatacagaccaaaatctatcaagaccaaattgtagtaataatgaccataatcactaacatttgtatggcaatttctagttttcccaactcttaacattcattagcttccttgctcttcattaatatttggggttttgtctttaatgattcctcagctcaggtcctttagttatgagcctaaggaaacttggccataagattcaccatcacactagaactggtttacagtggtgtgactggctgtgtgtgttgatagtgccagaaaccagcattctgaaacatatttttcatctgaaatgttcaaaggagcatttttattcattcactgccttcacttcttacctcccttttacttttcattccacgataaccagcttctccccaccattttgctgaaactggcctggctaagtttatagtgactctacttattgccaaacaaaagatggatttttgctctttacttgactagatttcttaagcatatttgaatcttgatgattagaatgttgaaatgtccaccctgttggcaactatgcttattagcctcttaggggatcttcactgtatccaaatgagtatgggaataatcagttggagttaaggatgtcttcttaaagtatgttctctttttctcttaataccctaaggagcacaatattggaagaagaagaatgtttcatatcaaacattttagagaaatatcttgaaatacataaattcttgaaatacaatttcatggtaccttgtgcttctcagataatttttcttttgctgcctttctagaatttcttttgtactcatgccccttcatgcttggattctctcaacatcccacacttttccctttaatccttgtgttctgcataatgaccaagatagaactcatagctcttacaatttcaactagaaaatactcccaaatgtgcataacaaccccaatctttcccctaagtttcagattttgtatccagttctctaccatgatctagacatccagagaaatctaatatttgatttaacaaaatgaattcttcatccccgtgcatactattacctgtctctggggttatctcatgcagagataccctcccttgcatctgactcatatcagctattatgttccctaagataccgtttctgtttacctcactaattttctggctaaattttcttccaatatgttcccatgatattctaagcgtatttcttattattttacctgtccattatgtgctgctttctatagactatgcacaagggcaggcaaggtgacatttttaaaactgtcttactaccaagtgttagtaggtaactaccttatatgagtgttcaataaatattaaatggatagatgaatgactgagtgaaagaaattgcttcaataaaatattatgcctcttaagggatcttgactaaatccagttgaccatggagataatcacttgaagttaaggatgtcttcttaaagtttgttctctttttctcttaatatcctgaagagcacaacattggaagaagggaaatgtttcatatcaaacgttttagagaaatatcttgaaatacataaattctgctttgaaatctattaagcttaaacccctagttcaggaaagacatgtttaccataattaaccagggtcataggaaaatgtgcttttcttctttagcttacactcttaatagcttgttctggctcactaaccatatgcaaagatgtagtgcagatgtgtggggagggaaccattgtcatcctgctccaggagaccagctggatgtttcttttgtgtgaaaaacacataaagtctattatgtaaaactttgtagataattttatagagtatagcctaaaagtaattcacagaagctaagcaatcccccacggtgaatttgtatgacctttacacaattggaagatctgcgtggtagtaacatattatgtgaagaaaagtgactgtgtgatctaattgaagtaaacgtaactggaattatgcagttattatatatccaaggaggtccaatgaaacctgagtgagttgtcaaagcacattctgcagcacacagtgaaactttggttataaaagaaacaatgtgttatatttaggaattttttctgccagtgtgcagcttgctgaagctctcccatctgtttccttgatgacctgacttaaagtattttcctattttaaatactaatttgtatccatattttgatagttttctctttctttcaaatataattttatgtaggcctgtgccatctaacattatagccactatccatatgtggctattgaaattaaacaaaattcataatttagttcctccaccgggatctatttcaagttttcaataggcaaaatagtgagagcctactgatttaacaacacaaagaaacattcccatcatcacagaagtttcagttggacagtactgattccaaactcaactcttctcaccttattcacattattgcactggcctttgggtcattttgtcattgcagaataccttttctatgtctattccatcaggttctttgtatttaatcatttatcatatatcattcactcctcaatgagataaatggggtcaatgaacaaccttatagaaacttaatgctgattcttaaatagtaatgtttttagttcaaactgcctggcttttaaataacatccggtcatgttaaggttctgagaagaactaatcccagtgtgagttataatgtaggcattgaaaaccactttggcataggctaggattacttaaaaactagaaacaaaacaaattttaaaagaatttaattgtgacagaatttgaaactgtgtaatgtttaaggaaagcaagcttaaactcaaggtatttgaaatgtgaccacatttttgacactgagcttattctttgtttccagatttcccacaaatagtatgataatgacctataatttaattgatattgtgaattatttataaagatatatattgagatacatagattcagagagatgattcttatttgtaaattttgatgatttacaattatgttaatcatttgctgaaaaattgaaagtaaaattgtgtgaaaaattatctgcgaatataattaagcagctttcagtttatctggctgagccctcaaatctttcactggtttactgcagggcagaaagcctccaagaaaggccctgaaaagggaggtgagtgaccctgtgtgttccctgaactatccagcacttgtaattggttttatagttcaacattgatcaggcttttctggcagcagcttcctaaaagcctgttctctaactgtacagtaaaatggatatttatatactcttaagagcctcttgggaattttgtggtgtgcctactcactgaagggaaggaatgaaaagtatcctgggaccttccttcttgagtctgctagtaaactgtttagggtctttccaggtgacatgggctcattacggttggcttgggttgttttctttaaacagcctcctttgaactttgacacatcctctggggagctatctgaacaaaccagttaaatatcactggtctcaccagccctctgccacttaggaaggggttctcctggggatctcagaatgtcctgctttttcaggaagtcagaaatctcactctttatatggacattgagccagccattgtccacattaccctttcctgggctcgggtactgatggaatttccagaaataggaaccaagcttgtttgcatttgcctacctccaccaaagagcttgggtctgtctacttgaatcattccaagagtgtagtcatgctaaatgtgtcttcgtttttccctcttcataaacttttcaacctttgagcatgatgacaattattatgctaacatcttcttttgtgatttcaaggcacaagttaatttttaaatgtcatttggctcttaactcacttaaaaatgttttttctgtaaacccttttttcatccacgaacaattgctagaactagtggaagtagatacatttgaatgtgagtccacacagtgcaagttttgcctcctgagttgttgcttggtccactcactaaaattcagaattaaaactgattacaaaattaaatgtgtgattgacgaacattctggccaatatctaaatggccacggagggaaacaaattatttcttataatttaaatccattaggaaatataatcctcttgtgtgttctgaatggatctaaaagtagcttgtacagtcttctgaatttaggattttttttgttggtgcctatttcaggtgatataggttattatgtcttttgtgttatttgggacaatattacaagaattttttttttacattttattcctgaaagcatatttatgagcacagtttatccataattgtgaaggaggtcatactatgtttattttcattgtgttttttcaaatcagacatatctttcgtacatttataatatactcagctctccatgtttacatcctttaaaagccattcttcatgcaccactctgtccatctgtggtctgctcccatgatttcttctgtttcttgtaaaatattaattggtttttttcaggaatataatatatcagcattaactatgccatacagtagatttcttgaacttactcctctaatctaactgtaaacttgcactcttttgccaacatctccacaatattccctactccctattcaccccagcctctggcaaccaccattccactctctactatgtgaacaaattctttggattccacatatgagtgagatcatgcagcatctgtctttttgttcctggtttatttcacttcatataatgcccttcttgaaaactgctaagtgagtagaagtaaaatgttctcactacaaaataactaggtgaggtaatgcttttgttaattagctagatttaaccattccatgatgtatgtgtacttcaaaacctcatgttgttcatgataaatacatacaatttatgccatttaaaaaataaatttgaataaaatactaatttgctttctaagcaacttaataacaaaggtgagaaatgaggagacaggcattaacattaatgggaatccatccaccctgcctttcttcatatacaagaaattatgctgtctaggttcacgaaaatgattgtgctttatttttaaacctctggatgtttgatgaagcaatgtaaatatttgataagaaatcactaagagaagtcagacacatgtgttctacatctaagtacagattctttaaattttctattccttaaaattgtaattttgccttcatggcttattgactaatagtataaaagaagtaggtatttcagtgtaaatactctatatttcatatgagttacagtttcataacataaaaaatatcttatgtttatggttggatgattgtagattaactgtgatttcttaaatatgcagaatatccatgcttgctgacctttggtttagtttagtgattcaacttaattatagtctactatttgctagacttccatcatttattcatttacaaacttagagcctggttttctcttccttaccttaaattattagactctaagagcaaaaaggatactctagaggtagcaggatctacccaccccaatttcatccctactcccaaagcaacaaatattaaaattagcttgtctataaaacacttacacatcttcttaatacgtaagttgattaaaatttgctgattctcatttgacaaaaagtaaaaaagaagtctcttagaagtttaaaaacaaatggatcaaacttaaaccatctcatgtgtactttgtcctataaatatataccttataaatatgaacttatatttatagtattctatataaatatcttatgtgctgtaatattattttataattattatctacttacagtaaaatttgagggacttaaaatatgtgaatacagatgacatatcataggtacctacatatttgttaggttattgatagtgataggaagcagcaaattgccaaaaagaggaccatttttttaatgttgtactttaaaacagtgagacaaattatttcacagcaccttaagaaatttgtaataatattttccaatataataatgactaaactgagggttgtattggatttttataatactaacatattatagtatccttaacagctatcaatttcattgttaattactagtaatctcaattccagaggagctaattcttcactaattcatgtgtcttaccttatgaggcatcagtgtttctgttatagattttcattgtcccaagtttttaaaggagtggaataaactaccaaatttaatcactctgggataaacgtgtgtgtgtgtgtgtgtgtgtgtgtgtgtgtgtgtgtgtgtgaaatacaggaatttaaaatatttcatatgaccattaaacatacagaacaaaaagcaactcctattaaatcttgtattgttgtaacaggcatctatgttatagtgaacatgtcttagtaattatctcaaaatattgaatgtgatttagaataccttccctttgggatattgtaagggaattctcctgaatagagtatataaatgtgatggttaattgtatgtgtcaacttgactgggctataagatgcccaacatatgaccaaccatttttctatatatgtctgtgaggtgtttctgtatgagattaacatttgaatcagggtgggctcagtggctcacacctataatcctagctgaagcaggtggtttgcttgagcccagatgttcgagaccagcctgggcaacatagcaaatccccatctctgaaaaaaaaaaaaaattacccaggtgcccaggtgtagtagcatggcctgtagccccagatactctggaggctgaggtgggaggatcactcgagctctagaggtcaaggctgcaatgagtcatgatcatgtcactccacctgagaatgggcaacagagcaagactctctcaaaaaaaaaaaaaagataaagaatcagtagaccgagtaaagcatattgccctccctaatgtaggtggacatcatcccatcaattgaagacttgagaaggacaaaaaaggtttaataagagggaattctcctgcatgacttcttgagccaagacattggtctttttttacttttggagtcaagctgaaatattagttcttcttgggccttgagcctcctggatcttggactaagagtcagctctcttgaatctcaggtcttcacactcagactggaactacacaactggcccttctggatctctagcttgctgactacagatcttgggacttttcaatctatataattgcatgagccaattctatatatatatggaattgtgtgtgtgtgtgtgtgtgtgtgtgtgtgtttacatacacacacattagagtcttaactttccagggatttccagggattagtatgaattgtggtaagcaaggggcgtgataagacgaaaacctccaaaatgccctgaggaaataccagacagttttattcttttacaaatttattttatttcacttttaagggaacagaaaatcaataggccgcaattttttactgtcagttgtaaaatttatctgtacatttgtgtttattcaatctatttccagaaatatttgaagactctttaaagatgtaaattaaatgttctagctttgttagagcactgataactcaagaaaatagtaaaaatttactaatgagtttgaacttgaacacaagtttaatctccaaatgatgaaatctcatttaatatacagacaaaaattatgcagcacacagctataagatagtaaaattagcaagtggaaaacccaggttcaaatcttaatgtagaaacttccaagctatgtgaatttaggcaaacaattaaccccctacggtatttacaagtaaactataaatagtactattttccttgtttatttgtcagcttgttgaaacaggagaaatgaagttgaattatgaatggtaggggagtacaaatcataagattctcttttctttaacagtggccagagaacccaatggtctaagcaattgtgatatttttgacctcataggctctctgaagaataataaattcatgctttattctttctggttttagggattgcttcctgttatttgaaaatgtatacatgtatgtaaatatatacataaacaaataatacagtaaatcattatgccattatgtagtatgtttgttcagcttaagttaaaaagtaactcttctctctcctgcagtatttgtatcttttcccagaagccaaaaattgcctggaaacagaagcatgctaggagtctttcgctttacaaatttctaaaactgctgggacactgattctcactttaggttatcctgtgatttatcaaaggattagttaggtctccacaaaatactgaatttgaagcttgggtagaaaggtcatttactgaataaactcagtcagtttacatagctgagtactgagaattagcaaatgcaagtagaggaaagattagaaaggccaatgtggcaaataactgcttctctttaaaattaatgtgtagaaaacccccttagataaaaagcaaaatgctgagatgttcaacagcaatttttctgtctttttttaaacaaggtgaatttagatcagaaaaatgaaataaaacacaaatggataaagacagtgggaaaagaagattttaaaatgttttaattggtgtaaaaatttagaatttaaaaaaagcaagtccaggagatttgagttttgcagtacttaatttttcaaacgtgtgggagattgatatttacagtcttaaactaaaattaatcttttaagtaaacattcaaaattgccctcaaatcagtccaggaatatattatgaaggagatctaatttaacctgcaaatgctgtcaatgtttgatccttagctttgctagaaagaagtcttacaactttggtgggggagtacagtctataaggttctcttttctcccttgcataatgccttaaacagttacttggccttgacagtgatacatttcttgctttttgtattttcttaagtatgtgtacaatatgtatcttagcaacttgttacgttgtagaaaatgatactatttattggtaacctaatattgattaatcaatgttaactaaatagagaagtgtaaacttaatgacatcaggaggagttaagtgtttgaaagcacaatcatattagggttacagttagacctaactggtttgaaaatggctttggtttgacatagactgcagaagagacaaatagttaccaccaaactgtagtatcaatcttttctctaatcaaagggtaagttatctgaagatggagggttccaagaccttatacttacctctcatatttggtcctgttgttatccaccatttgttaaaggacaaattctcaggtggatgcataaataaaatgtagttttttttttatagcagtgacccagataaaatacaatcttgcagaagtattgaaagaatttttatgtgagggtgtatgacattacagctgtccctctgtgtcagtgggctccatatctccagactgaaccaacggcagatcaaaaatactggaaaaaaatcgaaagtaacaatacaacaaaaataatacaaatgaaaacatacagtataacaaatatttatatagcatttacgttatattcagtattataagtaatcgagagatgattttaaacatatcagaggatgcacatgggttatatctaaatactgtgccatttaatataaaggacttgagtatcctggattttggtatcctggacccaagtccctaaggatactgaggaaccactgtaactggctttaatatgaaagcttaggggaattaaatatttattaactaataatgagagtaactgttcaccagaaggttacaattgtctaggtactattgatatgatttggctctgtttccccacccaaatctcatttcaaattgtaatccccataatcactacttgttgagggagggacatgatgggaggtgattaaatcatgggagaggtttccctcatgctgttctcatgaaggtaagtgagttctcatgagatccgatggttttgttagtgtttgacagttcctccttcacatactctctcacctgccaccatataagatgtgttaacttctgcttctgccatgattgtaagtttcctggggcctccccaggcatgcagaattatggctcagttaaacctctttcctttataaattatccagtctcaggtatttccttatagcagtgtgagaatagactaatataggaaattggtaccatagacagggggaaactgctataaagataacctgaaaatgtggaagcaactttcgaactgggtaaggggcagcagttggaacagtttggagggctcagaggaaaacaggaagatgtgggacagtttggaacttcctagagacttgttgaatggttttgaccaaaatgctgataacgatgtggataatgaagtccaggttgaagtggtctcaggtggagatgagaaacttcttgggaactggagcaaaggtcactcttgctatgctggtggcaatttgccactgccctagatctgtggaactttgaacttgagagggatgatctgaaattagaacttatgtttcaaacagaaacagggcataaaagttagaaaattttgcagtctcacaatgagatagaaaagaaaaacccatttctggggagaaattcaagccagctacagaaatttgcataagtagtgaggagcagaatgtcaataccaagacaaaggggaaaatgtctccagggcatgtcagagatcttggcagcagtaactcccatcataggcctggaggtctaggaggaacaaatggtttcctgggccaagcccaggacttgctgctgtgtgcagccttgggacttggtgccctgcatcccagccactccagctccagttgtggctaaaaggggccaaggtaaaggttcagccattgcttcaggggatgcagtccccaagcctttgtggcttccacatggtgattgacctgctggtgtacagaagtcaagatttgaggcttcggaacctctgcctagattttggaggctgtatgggaacacctggatatccaggcagaagtctgctgcagggatggagccctcatggagaacctccattagggctgtgtggaagggaaatttgggattggagtcctcacatggagtccccactggagcactgcctagaagagggccaccatcctccagaccccagaatagtagatccactgacaacttgcaccatgtgcttgaaaaagcctcagtcactcaatgccagcccatgagggagctgcccaaggctgtgagagaccaccctgtgcatcagcatgccctggatgtgagacatgagtcaaagaagatcatttcagagctttaagatttcatgactgcccaactgggtttcagacttgtatggggcctgtagccttgttgttttggccagtttctcccatttggaatgaaagcatttatgcaatgcctgtatccccactgtatcttggaagtaacttttttttattattattatactttaagtttagggtacatatgcacaatgtgcaggttagttacatatgtatacatgtgacatgctggtgtgctgcacccattaactcatcatctagcattaggtatatctcccaatgctatccctccccccttcccctaccccacaacagtccccagagtgtgatgttaccgtacctgtgtccatgtgttctcattgttcaattcccacctataagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcatggttggacatttggcttggttccaagtctttgctattgtgaacagtgccgcaataaacatacgtgtgcatgtgtctttatagcagcatgatttatcgtcctttgggtatattcccagtaatgggatggctgggtcaaatggtatttctagttctagatccctgaggaatcaccacactgacttccacaatggttgaactagtttacagtcccaccaacagtgtaaaagtgttcctatttctccacatcctctccagtagctgttgtttcctgactttttaatgattgccattctaactggtgtgagatgatatctcattgtggtttagatttgcatttctctgatggccagtgatggtgagcattttttcatgtgttttttggctgcataaatgtcttcttttgagaagtttctgttcgtgtcctttgtccactttttgatggggctctttgtttttttcttgtaaatttgtttaagttcattgtagattctggatattagccctttgtcagatgagtaggttgcgaaaattttctcccattttgtgcgttgccggttcactctgatggtagtttcttttgctgtgcagaagctcttgagtttaattagatcccatttgtcaattttggcttctgttgccattgcttttggtgttttagacatgaaatccttgcccgtgcctatgtcctgaatggtaatgcctgtgttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggctttatttctgagggctctgttctgttccattgatctatatctctgttttggtaccagtaccatgctgttttggttactgtagccttgtagtatagtttgaagtcaggtagcatgatgcctccagctttgttcttttggtttaggtttgacttggcgatgtgggctcttttttggttccatatgaacttgaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttaattgagcagtggtttgtagttctccttgaagaggtccttcatgtcccttataaggtggatttctaggtattttattctctttgaagcaattgtgaatgggagttcactcatgatttggctctctgtttgtctgttattgatgtataagaatgcttttgatttttgtacattgattttgtatcctgagactttgctgatgttgatacactgctagcaagactaataaagaaaaaaagagagaagaatcaaatagacacaataaaaaatgataaaggggatatcaccaccaatcccacagaaatacaaactaccatcagagaatactacaaacacctctacacaaataaacttgaaaatccagaagaaatggataaattccttgacgcatacactctcccaagactaaaccaggaagaagttgaatctctgaatagaccaataacaggagttgaaattgtggcaataatccatagcttaccaaccaaaaagagtccaggaccagatggattcacagccaaattctaccagaggtacaaggaggaactggtaccattccttctgaaactattccaatcaatagaaaaagaaggaatcctccctaactcattttatgaggccaccatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccactatgatcaagtgagcttcatccctcggatgcaagtctggttcaatataggcaaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataagagctatctgtgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacaacatgattctatatctagaaaactccattgtttcagcccaaaatctccttaagctgataagcaacttcagcaaagtctcaggaagtaactattacatttgtgcaaaagtaacaatcactaacttgcacaaactcctagacagaagggcattgccttgtctcagatgagacttaggacttggacttttgggttaatgctggaatgagttaaggttttgggagactgtcagggaggcatgattggttttgaaatgtaaaaaggatgtgagatttggggggaggtaggggcagaatatggtttggctctgcgtcttcacccaaatctcctctcaaattgtaattcccattatccccatgtgttttgggagggacctggtgggaagttattggaccatgggggtggtttcccccatgcttttctcatgatagtgagttttcacaagatctgatagttttataagtgtttgacagttccaccttcacatgtgctctctcgcctgccaccttgtaagatatgcctgctttccctctgccatgactgtaagtttcctgaggcctccccagccatgcataactgtgagtcaattaaacctctttcctttttaaaataacccagtcttgggtatttattttcattttatttatttatttttgagacagattctcactctgtcccccaggctggagtgtagcggcatgatcttggcccactgaaacctctgcctcctgagctcaagccattctcctgcttagcctcccaattagctgggattacaggtgcccaccaccatgccgggctaatttttgtatttttagtaaagactaggtttcaccatgttggtcaggctggtcttgtacacctgaccacaagtgatccacccacctcggcctcccaaagtgctaggattataggcgtaagccactatgcctggcctctggtatttatagcagtataagaatggactgatacaactatgtaccccaataataaagcctcaaaattaaattaaaaagtaacaaaatagcaaggagaaattgaaagtcataatgatagccatagagttttgacacaagtctctcagaaaaacaaaaaacaaacaaaaaaagttacaccagaaaaacatttgcatttgaaacaaataattaaaatttaatctaatagctatatctagaatctgacccccaactgtctaacaatacatattctttcacatatattgaccacctaagcaaatggaaacatccaaataatcattaacatacagatcgcattgtgttgataactatttataattatcaaagatgaaaatgctacataactagatttatggaatataactaatttagtattttggcatacacattagaaaaaaatataaagttaatgaaccaatgatttaacctgagaagtcaaaacagagaaaacccaaagacaatagaataagtgaaaaaattgattaaatacaaatcaaagaagcaatagggaagactaacaaaggcaaaagcagcattcttgaaagggcttttttaaaaatatgacaagatgaataaagacagatgaaacataatagaaattttaaaaaataaaagtttaaacagtataaaattaatatttttataccattatacttgaaagtttagagatattagaccatgttttacaaaagcataattggccaatattaattcaaaaatggatattccaaatgaacttgtaaccattacacaaactgaatcagtattataaaaatctgcccattaaaaaatatcagactctgatggttttacaaatttttaccaaggcttcaaaggctagataatcttcactttagacaaacaattctaaaagaaggaaaaatggataaaagaggagaaagtactccagctcattttatgatgctactaaaattctatcatcaaaaagagtattagaaaggcaaattatagtgtaatcagacttgtgaatataaatgaaattcattagcatgttgaatctagcaatgtatatttagtgtgatattttagatatctttagcccattgataaatatttagtcatctggagaaggaaattaccacttatagaatatctagtataaccaggcattgtgctggatggatactttatctatattagctaacttagctaaaatcctgaggttttatagttgattttttttttactctttggcaaaagaactacaatatcatcatgaataccttgattaaacatctgatcacaaaaataagaaatgaaatggcctacaaacaaagttttcaaggggcgaatttgttagccaaccagggaaaatcacttcatttactgatagcaagtttattaaatcacattttactgcaaaagctaaataattgtgtccagaaaaataagccttcttaagacttttagcattatggcaagaacagtgcttgaaagcttgaggaaattgaaatattgctaatatgaatagtcaattaacaaacaaggtaactctagtttgaagtagttttccttgcctcttgagttgagatggtactaatactactctgttgttgcttattggaggagtcaatgataagtttgaagtgatgaataattagcctctatgaatagtaagtgtggaacacctataggtgagaatattttcaaagttgcaaaaaaactaattcaatacaatccgaagtggaactaagaggtgtgaagcacaaagagggttatttggacatatttacaaagtttgttaaaacataaagcatatggttattccttgaaagagccattagcagttgtattgtggaaaacacttcagtatttcattcatggttaaaacagtgctatcacctttaaacttcatttgttctcatcaattaaccatgttcattactgtgaaattttgtcagaatagaatctgaatatactgagttgtcctaccacacagcagttggatggcttcctggtaaagttttattacaattttttttccagatcagggctaatattaaattttttctgaataagaactgccctcagacactatcagtaaacactcaatggttttggaaattaatttttgctgcagaattggcaatgtttcttgttgaattcgatctgaaattacaagataaaacaatacttatatgcaaagcttatgctgtggtaaagttattttgatgatggccaatactgtttgaatcacagtaatagaaaactgcttataagcttcttgtcctatcagaagttaaaagaagaagtaaaatctccattcccaagcagatttgcgtggatatattttctgagcacataccacagactcagcaatattttagtacattgatgcaaacgcaaagtaaattcttatatttcacattccttttcactgttcagttgaggagcttccagtttaaactttaataggaagtaattaatctgcagtgtattgacctaataaaaggtaactatcaggagaaggatctaatagaattctataatgacttttaagtgatgaatatgctcaattaaaataatatggttgtgacttgataaaagtatttgaaaaaaatttataaaaagacattttcaaagatgaaacacttaaaatatcactacaaatcttcattaatagatgaacatttgcagttgattttgatgaaaaggaacactaacggtgaagctcaattaagaaaaaagctttttactctcctcagtagtagacctttatttaaaaacaaagactcaattgttatagtttgaattttgtccatgagaatgttgtaatctgctttctctctttttgtataagtacctgcatattattaatatctgcaattctgcctcatggcttaagatgactaaaatatttactaccttgttctttgtttaaaaatttcaccaacccctgtagtaaagaattaatttaaaatgttcttcacttatttaaattgttgaattaattgccagttatccagacatttcatagtctattgcttgggagtggaggtcctagctgaagaagagaatgtaggagaaggctgtatgaagctaggaattattttatattcaactcaggactcatggtaatatttagtggtaaagcaaacatgattatttaggaaatggacaataacttatttttctctatcagcaatggttcatgtggaaatcactgtactcaagcaattacatttttataattttatatgacttttatggcaataataatatttccatatattagaggttactttacttgaataagtcacattaaaccatcgtggtttttgtctaactagttttgttttaaccataactagtgctattaataacatcacttatttcctatttcttaattattggctatagaaagaatctggcacttctcatttattgattctacaaatacaaacatccatcagtcactgattattattgaggcttcctttgtgccaggcaccaacacatctccacagaatgatacggtaaatgagacacaaagcgtgcctgcgtttatgggccttgcattcttaccttcagtctaatttttgataaataaaaatgtatgccatagtctttcaaagagaatttacactgcaaaaacaaaactttgtcctaaggggccctactacctaaggataaatgacactaaaatatgaccataaaaataagtctatttaaaacaacaaccaaaaatgcaccataaacgggagaagtattcaactgataacttaatttgaaaaagaaaatgaagaaaaagaaaatgaagaagtaaaatgaaaatatacattttcatttaactgaaatttatttataacttaaatatccctcaaacctcaaaaaatgaatcaataattcgttttggtgtgtggagcttaatttttcaaacagcattgtatgttagcatgaaatatcttttgtctcttatattttcagaatgatcataaagcaggttcgcatcactttggtaaaaatgtgggcacttggataagtgtgggcctagcaagttgccttggtatgtgcctttaaccttggatatcaaaatcctttctcttgaagtatcttttgtgtcactctccttggtcatttccttgttaactggtccagcttttccagagccgtgcttctcagtagccttgtgtgagattttagcaggtctccaagaatactttcctagacttaattaaatgtagcatctttataacatttgaatttttacttgtaattgatatgcattctaatcagatcatattgttggggataatgaagccaaaccagtcaagtatgggattcactcaatgaggcagaaatgaatggtagcaaccatcagtgagggccatttggtccctagtgaaatatcttgtttatttgcaaatatttttattttagcttgattccttgctcaaccccatagtagtgaagacatggataacaaacactcagctaaaggactccttatggttttggtttatgcactctatcctgatcctgcagatctgaaaaaagccaagataatgatgtcaactttctttcagacaaagaataataataacttgggagatgtgaatagcctctaaatggcagagctttctctagactatgcctgtgctaacaaaggtctgaaggaaagtgaaagctaggtcttggtttggaagcttagaacactgagccagcggtagggtgtaattcaaaaactgccgattagaataaaatcaatctccctcactttagaaagaactggagccctagcctcaaccctttctcaattttacttaaggatgccaatcaacttggattgacagcaaaaaccatcaaaatgttacaccttgtaatgaaataatgacagtcagccaaccagatactagataactacatagctgagaggaaaaccctttcaatatctgttataaatatctgtccttgtactgggcttcttaaatataaagaaaaacaaaacttaaagtgggttcatctggagaccactactcctgttataatgcctttttaatccactcagaattttccaaataaactcaatgatgttaatgatttgcctcaacacaggttcagtaacttctgtttgcaaatgtgacatcgcacatctctcttccagcttgtcgtgtcagtctcatgattttgtaaatagcagaacaaatggaacctaagtcctgctagaaaaatcaaagctttgaaaggccactacagaagtggaaatacatttctctcagatgtcagagttcttgtgtgctagtcttgtctctgctctaattaaattcaagtgaagctatttccctctcatgggacatctgtctcctctgtggaggtagagggtggagggggttgggtcttgacctatctccatcatgcttcaaggagaaccaaaaggataaaataacatctcttgttttagttcatgaaacgaataccattatctgaaaatttacgcatgtttaggaaaagtctgttaaaacattttcaagttatagaatcattacagttttggaacacatgtttagttatgtgcttagtactgttttattcaaggatttaaatttaatactgcaaatttaataactacagtaaatgcttaatgtcagctaagaagtataaaagtgaacacttaaagaataattgaaagaagtatcttctcaacacaaatgactgaataaaagattttaaataactttataaatactttttaagtaaaaatttacaaaatgttgtcaaaaagcatacccaccagatggcttaaatatgtaagaaaaaaaggtttcggcacatgaatgtgttttgtgcaaataaatacagagatgacattaaattcctaaacacgtaagtcagtattccaaatgtctaggttctctgtggtattgtttgcagtaatcacttattgcacttctaaagcaaattccaatgtaatatgtcaacacttttaatactaatcaacatggtaaacaacatctgcctgaaatgaaaaataataataataaaatacttaagtcaagtcctggttgtgccacttaaacgttgtcaaactctaaacatattcctgaagtcctttagtccttagtttcctttttgctaagttgactagtttgtactctaaagtcattagcatcacagtttttttaaattgcaaattgatgcggtctaagatatctgttaatgaatgtaacaaatgaaaaatgtttgtaattcccatcatgttatgctactatgagaagcgtctacaacatatggaagacagatttaaaattgaatttttcaaaaaacacatgttccaagaaagttttcaccatctctctacagcaagaggtgatttccagaggctgatttcggcatctgagagaagaccgaagagaagccactcggttaccattacattgctcattaatctttctgagagtagatgtatttgattaaagagatcactagcttcttgtggaagaattcattaattcattcaactataatttattgaatgctcacatccaagatgctggaacaaataatatttatgtctaattttgtgatgattttctttctaggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaa

SEQ ID NO: 146 - DNA, 257588 bp, Homo sapiens
gaggaggagctgaaaatgcagatttagcatcaagcacagacctacactcgctctttctctccggtacacacagctccccacattcgcacccctgcccgcgcgccgggccgcctgactgcacggcttcccctccagccagatgctggagaacacacactgattcgctgctttccaagaccctgttcagtctctttctctatacaaagatttttttaaaaactatatataagaattctttatttgcaccctccctccgagtcccctgctccgccagcctgcgcgcctcctagcaccacttttcactcccaaagaaggatgaagggtggttgtgtctcccagtggaaggcggccgccgggttcctcttctgtgtcatggtttttgcatctgctgagcgaccggtcttcacgaatcattttcttgtggagttgcataaagggggagaggacaaagctcgccaagttgcagcagaacacggctttggagtccgaaaggtaagctctcccatgcatttcgcatgttgtttcaaaacggggggacgggggggcagccctgcgcaatctcattgcagatttgcaagttttctctctttctcatgcgatgcagatattctgccatgggctctttaacacgatattgcctccggtgatctttcaccggttatgtaattaaaatgtccttcatctgtactagtaaggtcatcaaaataatttactgctctttgacttgatggcgaaaataggataacacctttcacaggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctggagaggtggattttgagggggattccctacggagaagtcgaggtgtcctctcctgatgcgtgggcggccagcctggctttcccactagagcgtggggatccccattccaagaagttgccagagttcgacagtttgagcagataggtgagcctcccagctttggacaccttggatctcctttggagactccagggtactcatcctgggaggacagagagaagggcgctgggtgggggctgtggctgacctgcgtgtctctcctgcaaaagatgtatcagggttctccagtgtccttaggggacctggcgcaggctggggtggagtgtgggtgcagagagaaggtggggcgaggggaacccaaaggacagagatgtggctaccagagggctgggtggaggtccctgagattttaggctccatctcgctcctgatcccaggaagagagaggagtgagatgagcggtgggtgcttttggttattggttttgccttgaagggccgcgcagaccgaagctcttattagtctcttctgtcctgacttcccaagcctcccgcctctctcccagccaccgccagggctcctccaggtgtgggggcctctccctcctcctaagggcgtaggcagtaccggaatttcgaccccagaagggtctggcgacgagtttgacagaggtctgggaagaggctctgggtccgccggtggcgcgcgggcgggtcttgcggaaaggaacttgttgctctggaaagcgtgggtggagcaggggaaagaaggcgccggcggagggagcaccccgctgtggttttggcccgtggcctgccggctgttttgagagacaccaacacaataaagaagccgaccttccttcttcactcccccccaccccaaacttggcaagacccaggacccaaacgccattataaaatataatagtgattattattagttatacggaagcttacgtgctggagtccttacatagatttttacttaatcttctcaacatctctgaggaggctactatcattattgagcctatggccccgttgaggaaattggttcagaaaagggtgcgagataaaaacaggcaagggcttcaatccagatctttcagaagtgaacccatgctctttactccttagtacccacccaagcaagctaggtgctttcaggggatgtggggcattgagataagttgaaaagggattttaattcttgagtgtgatcttgctgcagaaacctgtggctccctccccctcccccacaccttttcatgggtgcgggggagtgggagggagccataggtttctgaaaaccattgttctcagtggttttctcttctctttgctgccccctttgaaaatgtgcccttaggatcagagatcagataactaggcctctttgtccttcattctttcttggagaggagcacactgattttgcatcacaacctgaaacctgcagttcccatctgagagacctctctccttacttctccataacctctcaggtagtaccccacaaccaaatccagtgattttttttccccttttacacgtttaagtaacagggactgcctggtgcaacatctgcctagaataaacctccttttggatccatgtcttgtccattcttcaagacctaaattcaaacctttcctgatgctacagaccacagtgagctttccctcctccaaatttttatgcgactgataggcaaacactgcactacataagctaataaatgccatcacttttcctcattatttcaggtatataagtaaatatgggttcagttgttgtatttctacttaaaaggtaaatattcagggatgatacctcctatatttctcatttcctccctgtaaccagcacattactgttttgccagccttgaaggaaacttccttgtctgtatttattatcccaggtttcccagacaccgtcctatcttgctttcatcatactgttttgtacttttgccaacatttgttattgtgcatcttagaggcccttatgtccttctccttccttgctctgatgcttagcatgcttcccaactccctactgctccctgctccgaggctcagtgtcagacacaaaagattctcagtggttatttattcatccatatgaaaggtcagcaatggaggctagaagaacatgctttcttattaaattatctcattctaagctcacaaatctatgagagaaattactggcatcagctgtaattctcagatgaaaaccttaaggccttgagaagttaagtatctgcttatatctgagaagtaaaagaactcagacttaaaaccaaatttgcttaactgaaaaataattgcttttctacatcatgctgcctccaggaagccttccctgactgccaagaactcttcccttgagacacaattttagagctctgctattttcccttttctttttacttttattatatttatcatttattttctattaacacatgaacatgtcattagctaatgggtacgtgtatttatgtcttcaggtagactataaatcttccaagaggagaaatgacatactatatctttatatagtctccatatctagcatggtggcctgtatatgaatatttaattgtttgtcaattatttgattgattcttataagaccatgaacaaacatttgttttctctctaaaatgaaataaaagcacctataactttacctctgaaaaggttatggagattaaagctttctattttatcatgacctggccctggcccaaagacctatgtctatcagaaaagatacttaagtctaggagagtgaatgagtttacagtaatgacaaaagcattattccaaagagtgccttaaaattctcaaaatgctactaattttaattgatttgaaacagaaaacaaaaattatttattgaagcaacctgttgaagattaaccaaaaatcaagtgagagttagggtttaaaaagaacctgatattatcctaggggtttcattgtattatggtgtgttttatgttttatccacagaggacagatgctgaaatgattacacaagtaaaatcatgtgaccatttttataatgtgtgagaattttttaattttgaaaacaacctaataatcattatgctgccaggtagtaaaaaattaataaatttctggtcgcttcacttttattaaagtataatttaggaaagaacacagcttagggaattttcacaaactgagcacacatgtgtaaccagcacccaaatcaagaaataaaatattaccagtatccctaagtccttttctcactcacttgctttgttttcaggttttagctattataaatatagcttttgtggatattaaagtctacgtattttggcaaacacatatatggccttctacagggaatcctagaaatggaattgttgagtaaaaggatatgcatgcatacagctttataagaccatcagttttctattgctgtgtatcactaaaaaacttagtggcctaaaaccacacaagtttgttatttcacagttttcatgggtaaggagtctggcacattttagttgggtcctctgctcgagtcttcacaggctgaaatcaaggtataggctgctgggtcccatctagaggcatgaccaagaaacaaccctcttctgagcattttcacggctttaaaggaattgagtttcttgtggttttagacctgaagtctttattttcttgctggctgctgggccaggaccactctcatcccctggagacctctccatagccctctcacacctcacccttcaaatatctgccttcaggaagagcccactctccttgcaaggttaacctgattcgttcaagcccaccaggattgttttccttttggttcttctgatgaactcagagtcaactgatttaggactttaataacatttgataaatctcttcacctttgcgtaatctaatcacagaagtgaaatctatcatcttcacagtcccacctaggctgtccacactcaaaaggaagatgattacatagggcatgtacatcagggagcagaaatcttgggggccatctcagaattctgccggctacagacaaacagccacatggctttcctaagtagttataccaatttacattcccttcagcagtatgtgagagttccagctgctccacattctcaccaacactagatattttacatctgttttcttttagccattctggtggtatgtagtagtgtctcatcgtgactttaatttgaatttccctgattatcaactgaagttaaacacctcttcatatgcttattgatgatttggatatcctcttttaaacacatttgtttcagatgctttgtcctgaaaagtttttcttttgggttgtccatcttcactttttatttgtaggatttctttacctatgatggatagaaatttttggtcagatatatgtattttgaatatttgataccacccatttaatgatatcgtaatgtcacaacaatgttcaatccagattatatgcttttacttctactttgtcaggcagccaattgtaagtcaaaggaagaattatcttgcagtatttccacatcccctatcccaaagttctttagatcaaaattgacaatatttggaggaaaaaaataaaaacagcatatagatttgatcataagcattccctgaaagatttcaatctaagaagactttaagggacagttcttctggaactaaaagattttccacagtagctaagggaaaatagcaacctgtaaccttgcttccctagacatggctgccattcatgttgtgccttagatcgaatccaagctaatccctcaagacctgtctggttgacctagaccacagtgttctctatccatttggtgctttgatgatgtataatcgattcctttccctgataccagtcatagccatcagaacgctcactgtccccaatacacctcttgtggctgaagaaaatgaggaacaataatgttgaaaggtaaagatgacaggatttggaatcagatagcactggaaacttggctaggttactaaatctctcagaggctcattgtcttctgaaaatggttaataaaatatggtggctgtgaaaaataaataatgtagttagtgcatgtaaagttctgggcacagcactgagtgcataggataaaatagctattactgcagtagtaacaataagctggttgtgcactagtgacactcttttcctcaaaaaagtagctgtgggttatacttgtgagggagtgacaactgattgagtaaggaataggaacccagcccagcagcaatccacccatgggctagtcatgacccatgagatgacctggcccaaattcagtaaatttaattcattatagaccatggtaattatctcagccaattatactggattcctcaggaaatctgactggctagttgctctagagaggagaatgcagtacagttaccatgagaaagcccattcaggccatgggaaactcagacattttatctaagtttctaatagctttccaaccccagtttccagcaaaagacgcctgtaacaggctgaagagctaagcaccagattcattgctccttcttcatgggctgcagcaagaccacatttcccagcctgccttgtaaataagcgtgatcatgtgacaattctagcctgtgtaatgcaagcagaagtcatgtgtacttcttccatgcctgatgcataagaattctctatcgattgtttctctgtgttctgctctcctctggggcttgatgtaattgagaacagtacattttgacaccaaatgccaaagcagcatcacaagatgaaaggagcccaggtccctggtccgtgaattagaagaccttatatgagtgagaaataaactgctattacattaagacactgagatttgggagtactgcccaaactaatatgctgtcagtaaatatccctttgcttaagttgctagagtgaatctctaaacctcgaaggcaaaccgagccagatcacaacaaaaattgttccaaagttctgtgagagcacacatattttcacaatatactaccaaacaacttttcaaatatttgtgatttgtcttctccagcaacaaatagaacccattctacacactgttcttcctgctggcaaccaacgtgccctactcataataggtgtttaatatgtgctccttgactatgactacagttggaccacaaggtggtgatttgtccataatctcaggttgaaggtgctggaaaaactattttttaagaaactgttcctgtagaatccatttctctataggcagccattcagctaggaaatagaattaagtgacaaccagcaagtgggcaactggcatgcttctttgtttctctaaaattccccaacttcgatattatcagtagtagaacagatgagctctttgaacaaagaaagtaaagtctgcagttacaacctgatcaaaatccaaaagaagggaaagaggggaaatacacctttttttctcaattgaatgaatatctagaaatcaatttctatttcagaaggtcttattagctatagatcataacgtcatagcacatcagatagtgatgctatagttaggttcacaataattatatattccactcaaactaactgctcaaagaggtctggctttaagaataaaacatgaaatctgaagttcaatttttcattgagttcagatccaacgtttcaaaaagaaactctgtgctgaatttgtgaattattatttgagatacaaataatcacgggacagctcaaaaactgacatttctatttgactttccttattaaggtgtatttatttagctaaagtccacaagtgattaagaagtcaagaaattacatctgagtcaacacttcagtctgaaatgtatagttgtgtattaatggatggtttatatgcgagacacatatgaaaataatttaactgccttgacaattttttgtcactgaagctaatttgaccacaactttttggaaattgttgtgatgtgctgagattgtcgataaaaataattgaataaaacaagttcttacattgaaagtagaacaatgacacactcttaatttcctgacataaagtagacttcagactgttacagcgtattggcagtttctccattagaaaattgacaagaatggggagaaaactgtaggatcctggggttgctctttgtttacaactttaaatttgacattaacttccataaatatccaattgttctcctagtttttcctaaatagattcatttcatgctcattttgtatcaaaggcaaaagagtccaaagaaaagtgaacaatatacagaatcactattggaagcatcaagaacataaagataataacttaggtttaaaacatttgcaaagtgttgtaagtcattagagaaaaaagttttgacctggaatatttgggtttcactcttctaaagttttaagtagagggcaaagagatggtcagccttgctttctgtgtaaacacagtgtctggcaaaactaagtctacaggaaatatttgttgaatgaattacttgattgatgttggtattagatgtagtagacaattgaatatctttcctcttaagatttaaacaatgacacacacaaacaaaaaagtgaatccttccatttgtgagatggtaaacatctcaatgtcaagacagtatttttacacattgcaatattcatgaataccgtgagtggacataatcaaattaaatcacgagataagttaggaaccctgataatatgaaaaatgtaataactttgatatttttgtcagaatcactcatcattattttaaaaaataccaagtaataaaaaaatacaagaaggtcttttttaattatctcaaatctcattattcagaaataaccattaccagctttagataaactctattgcagatacttctgtatgaatatgtatagagagaagagagatatataaattgttttatagagctgagatctcatcatatgtgctattttaagttttaaatcattcagtttaattattataaaatttaacagaagagaaaatcaaaagaaaactatggaaattgttaaacttcagataaatatgctatacaaaggagatattatttcctaatatacctccctaaaattcataagaaattattgtgtctcatatttaggagtttgtagttacatattttatacatacatggtagataggttacatatatttaattacatgtttacttatttaattacataattcaacttttgtgagttatggactcagtgctttgtaaaatggggaaattagcatcctgacactttctctcagcttccctacttccacattccaatgtttgttaggtatatcattatttttgcattgtgttacatataaatattaaccttctactaataaccataatttatagtattgcttatattagttctttcttaaaattctaatgttaccacaagtccttttatcagaacttcaattacaaattcatttttattcatcttttgagtagctaggttttactgaaacatgaagaaattagcctaagcatgaaaaaggagctgtctcagtttcagattaaaggggaaaaaattggcaggggaagtcctgtttttaggtcacagaggagaatgtggtgataatatccacttaggaatcacaattatttcagaggattaagaggcaaggtcaatgttcagagggaaggaagaggtgttaggatgggggcttcaaggagatggaagttcagacactgctagtagacatgagagagggagtggacaaaggacagatcatgatttctgggcagtactgcagaggcaagtgggaaagaatggatttatggtggcaccagcagacatcttaagaatgtcttaagcaacattcagattagggttgagaggtgagagaaatggaatcttccaaataatagagtgtcaatgaaatagaagaataggtaaattggaaataacagtgagagagatgaaagggagagagctatggttggtgagtgggatattgaagctcaaggctccaaaaattgagcacttccagataatgatgaagttcatggaagtgaattatcaaagtaaaaaggagatgaaggtgatcaagacactaaaagtaacatgcacaaggatttgttcacatacacctcattcatgctatggcaagaaataggattgtcaaggaagactgttgagagaaaacaaagcgaagtcctaggacaaaatgttggagaactttggacatgaaaggagaaagaggaaccaggagaggagtcagaacttggacggttagagatatggaaaaagaatcaagagcacacaggcctgtgaaaggaaaggaggagagagttaagaaggaaagaaggaagcaacctcagccactggttttagagacaaagtcattgttgaaataggaggagtcaccctagcacagtggaagaggagacgagtgttaatttgggtccccagatgtaggccctggaataaggacttaaatgcaagtagtttacttaaagagtgattctacaaaatactggtagaggagtggggaattgagataaggaaaggaaggcaggaataaagggtacatcataaagcaagttgtcactgtgggtaactggaactcaatcccactggaaaactgggagctggtgtagaatatgtgcttcagagttatcctgcctgaggggtgaggaagttggggtatttatacacgcattgcattgacatattaattaatgattgagagttactccaggctgatgttaacactccagcattttgtcctggcatatgctcagacagagcagaatttggccatccagaaaaatacttgcaaacagatgcagaggctggcacccacaaaatggtaaggcctatccaagaggatctgagtgtgaaagtaaacatgtctgctacaggaaaaaagcccaatcatgaaggaaagcatcaagtgtgatgaagtggaggtaccaaatatagaccatcccttcaagaggtatagtggttaaaatagaaaaatagtgttacagtcacttgatgtggttttaaaggtatttatgaattaataatttcttagcacttgtcagaccactggagattgctatcccaccagaatattgtgacatacctagccaatcaagtctgcattactctaactggtttttccagtcatttacatttttacaaatgataattataattatgaaattacagcctttcagaacaggaagggatcctagaaagacattaatttaacccttcatttaataaatgaaggaaataaatgagggaaagggcatcgaacactatgtttgtatgcttaactattccaaaaagcatttgagccttgttgctcattggcggtggtttagacaatgcattattgatatcactgaaccagctttccagactggatgagatagacaactagattgggtgagactcctataagtgattagccacatacaccaacttggtctgaccatactaattcatttcaggtcctcctgatgtgcttttttggtttgtttttttaccattttacccgtagaatttttataaattctgattttccaaacaaagctattcatagactcaaggattccacaccaacaaccattgggtttacacttggtaaaagacagaataggaatttatacttccttgactactcccttagtgactaaacagtgctatatatttagtaagcactcaataaataccaaaataaatactgagaaaaaaatttaaaggcttagcatcatcattagattttcactgcacacccagccgatgtctcatgagatggtgcaatcaggaaaaccaagtatgctaggaagggttataggaacatcctatttagtgcctgtgttaagtggatttccttaattgcccttaatagcctaaaattttgtgacttaatcattaagaatccagtgacagaggagaataaggtgacccacaaatcctattcctctttgcctttagcttctcctctatttctgtgggaagaaaaaatatcacttttatcagggcaccaccaattctcttcagtgatgatggaagctcaaacccaagaaggtagttgacatccaagagtcaattctagtcagttccagctgactatgtttctaggaactgtcagccaagaatgggagaccaagagagaccttgaagaacctaaaatgtgggaagaaggatgggaaacaagccatttgtgatctcttgaagttcagtagcagcactttaggcagaggagaagggacagggatccttggagagttgtgtcttaaatgaggtttgtcattaacccaaatttggacccagcagccgaagccagaaacaaaccattctggccataaactagaaaatgaggagaggaccaaagaagagttatgggagtttcaagccaatggaccaagaaattagcaagagctacagtcataccacagggacgtatagaaggagaagattattaaggtcattcaacaaacatatactgagtaagttcagtaaacaaacataatgcaacacactaagacatggatttgggaacaagtaagcaactgggattcaatcttactggcctaagatgattccaatagatagatgaaaaatcaaaccccaaggtgaaaacactttttttttttttttttttttttttttttgtgagatgaagtctcactctgttgccaggctggagtgcaatggcgcgatctcagctcactgcaacctccgcctcccgggttcaagtgattctcctgcctcagcctcccaagtagctgggagtacaggcgcacaccaccatacccagctaaattttgtatttttagtagagacggggttttaccatgttggccaggatggtctcgatctcctgacctcgtgatccacctgccttggtctctcaaagtgctgggattacaggcataagccactgcacctggcccatgaaaacactttttaagtctctgcttgtgttgcatttactaagtttcattggccaaagcaagtcacatggccaagtttagagtcagtgtgggaggagactaaccaagggaatggatacagggagatatgaacaaaacatggatccaatttcctactacaggcccctctgacagttacaacttatctgtgttgtcccatcaaagggtgaggaggctgggatgtttaacctccagctaccatttcttcttggttgatggttgctcctggggaacttcaaatctctcatacttctgcctgctgtaagtagaccaagcatgcttccactgccagagaacaccctcaggagagcggtgcctgaaagacattggcatctgtatgtactctgtacaggtgacctccagggtggaccaagggaaggcaggcagtgcatcaatatcatgtgctacacagaggacctaaagttacataaaattgaggttcgtcagaggctagaaagaaacagtttgtgagtgaggctgtatgtcagatcccctctacgtgtctcattacctaggtgtcactctagacttgatataaatcagtggttcagtctttagggggtacatcatagtttgaatcccattgtggactgttagcccagccctaaaatagttggtgtttgtggctaatccctcataggagtgtcacacaatctagttgtctgtctcattcagtctggaaagctggttcaattgtatcaacaatgcattgtctaaaccacagccagtaagcaacaaggctcaaatgctttttgcaatagttgttaggcacataaacatagtgtttgatctgctttccctcacgtataaaatgaagggttaaacgaatgtctttctaggatcagttcgcgctgattacagacaaatgggagtgctccatgtaaacaagtccagaaagtttttgtgatagatttaatatatagtgcatgtgaggccgtgactgtcagcagaaggaaagtcttcacaaagcaggcaataatacattgaggtaaatttacaatgaggcttataatttcaagaggtttaaaggaagaggtttataaagaaaaccacaggatgtgcaatgaaatgggcacggtttttcggaggattgcaagtagttttgtctgtctagatgacaagagactgggagatgaggccaaagaagtgacctggggtcagttcatgaccagtcacccatactatgctgaggaatttggattttgcaggtaggtggaaggaggcatcgaagggtacttgggaagtgtggcaggatggccacatacaggacatcctaggataagaagttgagctaatagtgacttggagaagccttgatctctgcctggtttctttgtcctgtggaatcactaattctggcaacaagtagcacatcatttaatagatgatgccactaggaagtcaggttatatgtctttgattccattgtcactggatgatggcatcagtgatactaatggcttgattaattattgtccttgtagtcacactgaacggctggtagagcagccagttctatccatgaagattagtccagctaagaacaaaacaattaaatgcacctcccctgacatataaatatatgaatgcagaacaaatcccgtaacttagaagccaagaagaaaagaaagaacagtggtgtatcaccatgatcctagctcacctaataggcacattactccctgatattccaaagaaataatgctcatttttaattttttctttctggaatgatatatggaaatgttgcctgaggctagaaagaaagtttgtgagtgaggctgtatgtcagataaccactacctgtctcattatctgggtgtcattctagacttgatataaaacagttgttcagttcttagggggtacatcatagtttgaatcccactatggacagtgagctcagccctagaataatggataaccatggacaacacaagctgcttcatactgttttcctgcttatggggaagagtggatcctggaattacagaagagaattgagcattatccgtggagaacaaatgcttaggaatggcataggagtaggcagggctggcttacagccaagtgtactgagtgctaagtcagtgacttacccctctctcccctagtttcccttccacacagcctcttacaaatcagctaattacagaagaacattcatacatgagttcttattttattaacaagtgtgtgttgagccctatgaagatgaggcacattgaaaggggttgattctacagacagaaagataacaggttcaagtttatgcccaaggacaagcacacttatagttctatagttctatagtctagtttataagaattcatacaatctgaggtctctattttgctattgcaaatgtctactttatgtgttggggtgtgacaaactgttttagcaattggtctctcgttctaaatgcaaaggaccttctcagaccatgctaacctggtgacacatcctaataagttgaggctgaatgagatcttttgtcacatctggttactcaaagacatgatgtcctcactccacaggccttgtgctattgagagaggagctgaagtcacacataaataatttaggctcctccactgcatgaaaagcatctgtttaaggagctgtcaagctgtccacctctctagtgaaatcatatttactttattcatctaaataatgtggcttgtttgccttctgtgtgaaattgtcttgcactgtttctcattggtgggttttatgggacagcatatgattttctgtgcatccatatgccactctacctctgggaatggaatggcttcttgttcagtagttttgattattatagccctttatagcttatgagtcattgggtttactcaaaatgtccagctcctcattctcatttttttctctatggcccagccatgcccgtcctgaaaaatttttaaaaaggaataataaaaataaataaataaaagtcatgtactctatatttcatttccaatgagttgcttcttgtttgggtaattttttattgtattagagacaaggccttactctgtcacccaggctggagtacagtggtatgatcatagttcacagcagcctccaactcctgggctctagtgatcctctcacctcagcctcccaagtagctaagactacaggcacacaccacctaatctgactaggtttttattttttctaaagacaaggcctggcaatgttgcccaggctggtctcaaactcctgggctcaaatgatcctcctgtctcagcctcccaaagtgctggaattacaggccaccatacctggccttgtttggataattatagcaataggagtccaccgaagtaagttgtgtttttttagttatttggcattctcacacttggatgctcagaaacatgtgagcaaatagcactgaatgtacccacaattatgtcttgtgctcagtttgtaagtcactattacgtaggtgagaccagagcagttactgtgaagtggaggtagctgcatttaagactgtgaacagcgcatcaagaagcacacaccacaacgtgtgtaatgcccctgccatgatacatcacttcaatctaatgatgagaaagcagatgatcccaattgagagacagtctgcaaaataactggcctgtactcttcaaaagtattaacgtcataaaagaaagacagatagactaagaaactcttccaaattaaaaaaagaaatgacaaccacatgcaacatgtgatcttggattgaactttgggccagattttttatttttttttccataaaggatgctattaagacagttggcaacatatcagtgatgtctgtaaattagaaaatgatatcacattagagttaactttctgatgttgatacttatactgccttgttcttagaaaacacacacacaccatctacaacttattctcaaatgattcaccaaagtaatacgtatatgtaggaaaataattttttaaatgcagtaaaatgttaacaattggggactctgggtgacatggctatatgagttattttcactattcttgcaacttttccataagtctgaaattatttcaaaagtaaaaaaattactgctaaaagaaaaaatgtgtacattgatgcaaaactaacattgaggtctctccctctatgaaatagagctgggttaaactttgtcaccaacaatgggtttctgtcccagctctgccactatagagcagtgtgaccacatccacataattcaactttttgaacctcatttttctcatctatgtaatccagatgtcaactagaaatacctggacccttgagatgtagataagatccactcaaatccccataatgtaccctgtagaagtcttaacccttcccaatattcctttaaattctaggagtggagctagattttcgttttacttctggatacagttttctacttctaccaaaactttccagttaataaattatgtctccttcctacccaaacaatcattcttcacaatggttactcaagtgtaaaattcagccaactcccttgatttcccttcaccaaaaaactcttaccattcacccaaggcatctgtgactagaatgtattttcctgaagatgtcacaggtgccaggaggggatttatgttgcaaacacaaagaactttaagtaagcacttgctttgaggagtcatttcatcccctcatcactgggcacgggcggtggcctcttcctgcccagcctcacatttcttgccagatcctcgccaccttcttttatctgccccttggtttctttagtatctcctcctctcatgggtgtgggcagattcttcccaggcagagcaggtcagatctccttgctctctaggcacccatgacctcaggtacccaccaaccatcacagaattatcccaaatagagacagtttcctcccgaagaagagctcagatgattacattctcaccctcagagtctctgcaaagtgagacatagtgctagatacacgtggaggtcatctccagtggaaatatgctgagattctatgaagtgcacctgctttaaaaaaatggaaattactttttcaagcagacagatatcaaacacaagttcctttcctctagccttgttatctgtgtggaatttaatagggtaccaataaggtttcactaacaaattacactttatacgaccttgccaaatgcagcattcttgtgggttattctagctttttaaagggatatcttgcttgtgaagatactagcatgtaattttctagcttagacatctacttttcacccccttttctcctttatttagaaataactctgaacccaaagctgatgtttgggagtagttaacttcttctcttgttttctatagctgctccaaagagcttggacctgactacagaccaaagtaacagagaatgctagcctcatctgtaattgataggatttttttttttgctagaatatctgagagtatttttacctcgtgttcaatctcatgagtttcttttcattccatatctcttatgatgtgccttctgtcttgtgcttagcagagtcctagacagctcagagctaacaagtgcaatgtgcatcactcattggatcacaaattgagtttggccagcacaatgctttcaatctgtttgacttgtggaggagcacgtaccctccagtttaccacaatcctcaccactttctattgtcttttacctgattcgcttagttagacagcctgcttgacccccaatatattaaatgtcttaccaatgcccaaagaactccataaccttagtcatccacactgaatagcacaactacttaataactcttgctagaatctagaacctcctgatctttttaatttactcagcaggtatctatgacatgatactctgcacctaggacatgagcaaaaccggtgttgtccccatagagcttgcaatccaggcattccgaggactgtgttctgagagataattctttccagcataccaagataattttgaaagatgaatatttaggcaacatgtcagtacctcaattttctttttcatttaagattcttctgctccctactactgtattcgaaaccagcctagtggatggctcttcctataagcaagaactatttccttactataaagtgtgtacaatccacttggctgtgggttggagcggctctattagaattgactggggatattcagttggaggttgacaatgagaacacgacaaggcagatgatcagagaaattacagtaattactcacaatcagtcttcgatagtaagtcacaaaattaaaaaggagaatgtaagtcacaaacgtaaaaaggagaatgtaaaagtatgaaccaagagaggttccatgttcctggtttaacagtggaatagtaaatgcaggatatcctccagaaaatgcctgaatgaatggtgcctctactctctgctatggaagttagttgggtccaacgcattccatgggggacgtggtccaaagtggacctgaagagtgtggtctgtcccctagtggtcctaggctgtcaatcagactatcccatccttgcctgggagagcagctgttgtttcactgatgataaataattctgcttgaaaaaaaaaaagtggtttctctttagtgatggaaatagatacttaatttgtgttttagattagacatagtcactcttatgttgttgataattaagaaataaaatcactctggaagttgttcttctctctccctttgctctgaagttgaaactcaggcctgtctattaggtacctttagaattatcactgagatcattttaccttgcacacaatccagggaaaccagtaatcatctctgggcagatatcagtaatgtgcaaaacccatttcctacttgacttggaaggagaaagaaatgttaggaagagtgaaaaatgaatggggaaaaagaacacatcagttcttctccacatggtctctcatcctccagcagcctaccccagacctaaattcaaatgagcttccctttctctcccatccctactcctgggcatcatgttctgcctataagagattgcatgcaattgaaggaaataaagaacggtctctgagaaagtcaataaaatgcagagcttatccctgttggtaaaattcaggtccccaaatgaaatggacaagcaattatcaactgagccagttttcaatccttggtgattgtttcgtctgccagtttttgtttcttaaacctcttgacagcagtccctcttacaaataaaattataaaaatcctatatagcaaatgatgtccagtgttctaccaaactagatcccgactaagcctgactgaggaccatgaaaaccagcacagtggacaaacacaaagaaagcagccaaaggaaaagtgaagagtctgatccgggaagccttaactgttctgagggttctgaatccatttgagaatctgtaataagcagtagactctcctgagaacaagcgaatgcacagatgcacaaaatttggaatggaggccatgccaaggtcacagaccctctggagcatctacagattccctaagggaagagaactctagtgtttaaaagaagcaggaaataggctccatgagaatttaacacttctttttatctgttcacaattggttgccagttccctggagttccctactgctgggaaaatggagtgtgtgggttcagagaggtgctatagcttggagccatagttttcaatgggaaaaggaagtaagaggaaaagaaagaagacaatgagaagtgttgctgagatccatacatttttgtggcataatgagaatttctaaaaactctgcaagtctgacttagcagcattattatactgtcacccagcctgaatcttcaagctgacaatttgctgcgagttcttcattcacttctttttctccttccttctggaaccatgcatattttgccttaagagaacaaagtgatgatataaaaaagggtgtgtgtgtgtgtgtgtgtgtgtgtgtgtgtgtgtgtgtttcaatgaagaaaacatttcaaaacatactaaatgcccgcagtatgagaggcttcttactaggatactcaggtgaatgtttgggaatctaccactgtgttcaatatgtctttgctatttgcaagatttgcagtctacttaagaatctcaggaatgcatcgatcagccttacatccttgaggtctgtgtaggcagcaagtaccttatactactgtaagtcacatagcatctgtctttctctccctgcggtggagcttatgattgcacaaagctcttaagcagctgcttctcagatgctcagaagacagtggatcttgggtctgcactccaaaagcaagagacaaaaaaggcccagaaaaataaccaatgcctacaggttagtcttttgttaggttcatgatcagtcaatttacctgtttattgcataagagtaagctcgtcagaggttcaaattttagctttatgagaccaattagctccattttctttcatagccaagaaagaatcccaaagaatccagactcaagggtcccaagatcacagcagtggggatgtcacccatcaacctggctgtccttgagtcccactcatctccatcaggaattccaggccaaaatctcatggattcctagtcatggttacaaaggggctgggacgtagagtaggaccaccacacaagcagtgtggatttacactcaggagagctgggatttctgcagagagctcccattcatctggtcaggccctggcaccccctgagccacagtgtcttctctaaaaaaatgaggcagctagaccaagccaggtatgcaactcagtagcctaaggtaacacaaccgtggaaagggagcttagtgtgtgaccataggaagtgcaggggtaggtgggttctgatttgaaactaggaaatacatgacctttctgaggtcattcaaatttaaattttaaaatatttttacatttttaacttgcatcttggaaataatttagactttaaaaatgttgcattaagtcgggcgcggtggctcacgcctgtaatcccagcactttgggaggctgaggcgggcggatcatgaggtcaggagatcgagaccatcctggctaacatggtgaaaccccgtctgtactaaaaatacaaaaaaattagccaggggtggtggtgggcgcctgtagtcccagctactcgggaggctgaggcaggagaatggcgttaacctgggaggtggagtttgcagtgagccgagatcgcgccactgcactccagactgggagagagcgagactctgtctcaaaaaaaaaaaaaaaaaaagttgcataaatagcacacaggtacacctatgttcatggcagcattattcgcaatagccaaaaggtggaagcaaatcaagtgtccatcaacggatgaatggataaaccaaatgtggtatacagggtggaatatttaaccgtaaaaaggaaggaaattctgacacatgccacaacatgatgaaccttgaagacattgtgcttaagtaaaataaggcaggcaccaacagtcaaatactgtatgattccacttatataacctaattcgagaaatcaaattcataaagacagagtgtagaaaggtggattccagggctggggggggaatggagagttactgtgcagtaggtacagagtttcagtttgagatgattaaaaagttctggtaatggataatagtgatagttgcataatgtgagtgtacttaatatcactgaactattcacttaaaaatcattaaaattgaaaagttgatgttatatatatttatcacaataaaaacattacttttaaaaagaagcagagtttccatatacccttctttattcagcttccccaaaattaacgtcttaggtaaacatagcaaaattaccaaaggcaggaaataaacattgatataatactattagctacaggccttattcaaaatgttccagttgtcccactagtgtccttttttctgatccacgattcaatccaaaatatgattatatttaatagttatgtctccttagtttcctctaatttggaaaagttctgcagctcttttttgtcgtttatgaacatgatgactttaaagagtactggtcagttatgagtttgtctgatggttctacctgaataaatacacgttatgtatttttggtgagaaaatcacatgaacaatgtgcccttcttagtgcatcatagcatgactcatcactggtgaagttaacttagatcgcttgggtaaagtggtctctgccaggtttctccactataaagatacatttcccattgtttattattgtatctcacctattaattttagcatctattggagatgtttgccggccacaattactattattatgacattttctgaatgatgatattcaatgtccatcatttcttctacatttattaatggcaattccactgtaaggaagagttttccctgcacctcagtttacatttaatttcttattttaaaaaaacactaaaacaagccagaatcatggtaagatatgttcctctgatacccactggcacttaacaactccaaattttctttctagtgttaaaaattctaagttctaggccagatgcagtggctcacacctgtaatcccagcactttaggaggtcaaggcgggcagatcacttggggtcaggagttcaagctcagcctggccaaaacagcaaaacctgatctctactaaaaatacaaaaattagccaggtgtggaagtaggtgcctgtaatcccagctactcgggcggctgaggcaggagaattgcttgaatccaagaggcgaaggttgcagtgagccaagattgcaccactgcactccagcctgggcaaaaaagtgagactccaaaaaattaaaagtaaaaaaaaaattatcagatccataatgcttcctgcaataagaaacaaaaggtcaaatttcatactacctgatagtgttcaaagtagaaagtttttggaaagcaaaatacagcacacatacattttcttcctctcccctcactttttttattttattaaatcttaatattatccagagtatatcagcagggttaagtagagaaaacatttaagaaccattgagcctggaattatcacacgaaatatttatgttaaatttgccatggggaatatggcttttagtgaacaggaactaaatcacaaaagctacaatgttctaaaaaatttttattcacagaaaagacccctggttaagttggctatgccttgaagatcatccagtatctgctgatctgagtccaggcctgtccccctgtgccagggatgtcccttgagagcctttatctgagctgctccaagacggtgtcatcagttgacagacagaaccaatattattgtagagttttatgttaacacagctgtgaaagctgaagaaataaaacttttttttcagctagctacttgtttctgtagtccattgctgagtaacaaaccaacccaaaatttggtggtataaaacagcaattttattatactcatgaatgtgggaatttgtaatccaggcagggcacagtggaaatggcttgtctgtggtccacgatgtgtggaggctcagttgggaagactcaacagctagaggatgactggtatggctggagttggaatcatgtgaaagcttcttaatatgtgcatttaacaccataaatgggatgacttgaaagctgcgctcttccaggattgtcaggcaaagcactacacatgcttctcaatgttgcctgggcttcctcataacatggcagcctgagaggagttggacttcttaaattgtaggtcaggactttaagagcaagtgtgttccagggaacaaggcacaagtctaatggccccttatgacttagattcagaagtcacatggcatcacttccaccatactcgtaattaaagtgatcatgttccccagatgcaagggctggaatcatggacctcatttcttgatatggggagtgtttaaaaaaaagctgtggctttaaacagccacactcttcaaaattaaaacactagaaaaatataatttttaacagaagtggaaaagagtctcttaagctgactgccctcccctttctccaaaaagtctaagaaatattccccaagtatccctctgattgaaataacctctcctttgggtttccatagcagcttgtgaataactctgctacagcacattctattctaacaataaaaagagtaacttatgcttgagtgcaagatattattccaagcacttttcatgcattatctcacttaattcccataacaaaaacattttataagtaaaaaatctgaggcccacaagggttaactaacttgccaaaggtcatagcgctgttacgaggaagagcgagaatttaaaccaaggcaatctggcttcagaactcatgttcttaaaccactccaccacagagtactgttaatagattgctgtgtgcaaatcttccttccctgtgaattgtgagctatttgtaggctgagaccatatcatcattacctttgtctctccagcaccaaacacagtgcctggcttatgacaaggaacacaaaaatacacaatagaaaaatgcacaaaagagaagaaactaaaatgtcaataaacatatgaaaagatgctcaaactttcaaaacaattaaaaatattcaaataagatgaaacattttgcctataaattggctgcagttaaaatatcattaataaatgtcaatccagtgttacttagagaatgggaaaaaggatatttttattcttatttacttttcggtgaatcttggaatatacaaccttatagggaaacttttctgaagtatctatcaaaatgataagtgttcataatctacgacttagagattgaattcctaggatatatcctacaggaaaactctcatctatacaaacagtgataatcacaaagctgttcatcatagcatttttaatagcaaattgattaagatatagttcacatgccataaaatttatcctctaaaaatttgcaattcagtgatctttagtagagttgcaaagttgtgcaatcattaccagtatctaattttagaatatttttaccacccttaaaataaatcctggaccattaacaatcactcttcatttctgtcccctctcagccccaggcaaccactaatctaatttccagctctatagatttgtctattctggacatttcatataaagaagtgatacaatatatgaccttgctgtcaggcttctttaacttagcattaagttttcaaggttcttccgtgtttttaccatgtgtcattgcttaattcctttccatttagaaataatattccattgtacatatatatcattttgtttactgttttatcaattgatagcaatgtgggttgtttctagtttttgactatcatgaataatgttgctataaacatttgtatacaagaatttgtgtaaatgtatgttttcatttctcttatatgcacccgtacatggaattgctgggtcatatgacaagtctatatgtttaacattttaagtaactgccaaagagctttccaaataggctgtaccattttactatcccaccaacagtgtatgagggttcaaattcctccctatccaggtcaacacttgctggtttgggtgcagttgggcaggggttgattttacccattctagtgtgtgtaaagtgatatctcatggttttaacttgcattctctgatgtctaataatgttgaacatctttctgtatgtttataggccatttttacttcttctttgaagaaatgattcctctaatttgcacatttttaattggatttcttgaatttattgttgaattgtaaacatttttaaaacattcctgtgcgagatccttatcagagatatgattttcaaaatttttctccaatctgtgggttgtcttttcgtttccttcgctatttcttttgaagtacaaatattcttaattttaatgaagtacaatttatgttcttacacttttggtgttgtatctaagaaaacattgcctaacctaaagccatgaagatttatttatatgttctattctaagagttgtacaatattagctcttacatttgggactactaatcattttgagttaaattttgcatgtggtatgagataggaatccaaattcatttttttcatgtgaatatctaattgtccaagcacaaaactgtgcttgaacagactattcattctcattgaattgttctagcatccatgttgaaaatcaattgaccataagttgattatcataaattatttctggattcagttttattccattaaactactatatgtctctcctatgccagtaccatactactttgattactttagctttgaagaagtgttgaaattgaaaaatgtgagtcttccaactttgttcttctttattaagattattttggctattcttggtctcttgagtttacatttgaactttaggataagcaaaaatgacagctgagattttgaaagtaattgtatagaatttacagataagttagggagcattgccattttaaaaaatccgtgaacatgagatgcttttccatttatttagatctttaatttctttcagtgatgctttgtacttttcagtgtatacatcttgcacttcttttgttaaatttattccccagtattttacttatttgatattattttaaattgacttatattcttaactttatgcttggattgttcattgcttgtgtatagaaatataattgattttgcatgttaatcttatattctgcaaccttgctgactcttttgtcaattctaataatttttctggattcattataaatttctatgtacaagatatgtcttctgcaaatagagatagtttttcttctttctttccaatcttgatgcctttatttctttatcttgcctgatggcattagctaaaatctccagtacactcttgaatggaagtggcaagagcagataactttgtcttgttctggtcttaagaaaatcattcagcctttcaccattaactatggtgttagctgtgagtttttcatagatagatttatcagattgagaaagttccctttcattcctaatttttttttttttttgagacggagtctcgctctgttgtccaggctggagtgcaatggcgcaatctcggctcactgcaagctctgcctcccgggttcatgccattctcctgcctcagcctcctgagtagctgggactacaggagcctgccaccacgcccagctaattttttgcatttttagtagagacgaggtttcactatgttagccaggaaggtcttgatctcctgaccttgatatctgcccacctcagcctcccaaagtgctgggattacaggcgtgagccaccgcacccagccttcattcctaattttttaaaacgtatttattataaaagaatgttgtattttgtcacatgtttttctgcattgggatgttcatgtggtttttgttatttattctattgatatatttattatagtaattgattttcagatgttaaaacaactttgcattcctggggtaaatcctacttggttatgatgaaaatcctttttatatgtgactggattcagtttgctactattttgatgagcatttttttgccatatttgtaagggatcacaatctgtagttttcttttcttgtggtatttctgtcttttcttcatgtcagggtgacacaggcctcaatgaattagttgggaagtgattcttcctcttccattttttggaagagtttctgaaggactggaattatttatttaaacattagtagaactaatcaggattagtagaattcatcagtatttattttgcagaaagttttaaaattactaattcaatctctttactgctattgaggctctctgataaatttttaaattctgttatgtactttttagctccagaatttctgtttggttctttcttcttattatttttatctctttattgatattctttatttgatgattcaccattctaacactttcctttagttctttagatatggtttctttgaacatatgtctgggtatagtgatatctatatataatatcatgtgaatatttatagttatatagtttagtctttgtctagtaagtccaacatctgggcttcctcagagagtttttattattttttcctctatgtgtggagcatatgttcttatttctttttgtgtctcacaatttttcttgaaaatttgacattttaaatactgtaatatgacagtttggaaaccagagttacctctccccaggttgtttgttgttgtttctaggttttgttgtttttactattgctatttgttttcctgcacccccacccctgtttttttttctttttttttaattatactttaagttctgggatacatgtgcagaacatggaggtttcttacataggtatatacgtgccatggtggtttgctgcacccatcaacccatcatctacattaggtatttctcctaatgttattcctcccctagctctgcaaccccacaggccccagtgtgtgatgttcccctttctgtttccatgtgttctcattgttcaactcccacttatgagtaaaaacatgcagtgcttggctttttgttcctctgttagttgactgagaatgatggtttcctgcttcatccatgtccctgcaaaggacatgaactcatccttttttatggctgcatagcattccatggtgtatatatgccacattttctttatgcagtctatcattgatgggcatttgagttggttccaagtctttgctattgtggaacttaaataaatttacaagaaaaaaaacccatcaaggagtgggcaaaggatatgaacagacacttctcaaaggaagatacttacgtggccaacaaacatatgaaaaaaaatgcaccaccactggtcattagagaagtgaaaatcaaaaccaaaatgagataccgtctcacaccagtgagaacggtgatcattaaacagccaggaaacaacagatgctggagaggatgtggagaaataggaatgcttttacactgttggtggttagtgtaaattagttcaaccattgtggaagatggtgtggcaattcctcaaggatctagaaccagaaataccatttgacccagcaatcccattactgggtatatacccaaaggattataaatcattctactctaaagatacatgcacacatatgtttatttctatttgcttatttaatgtctttctggactaattctataaagtctgtaatttctataatgtgccattgaatctgcttggttaacttaatagttagccaatgacagggcagaggttttcttaaagaccttgaatcaataaggctttttgtttttaccctttgctaaggggctctgttgtgtatatcgggacatatcctcaattctcaagcaggcagttttaaactctgctatggccttcacctcctgtttttaaagagacatcaagtcaactaaaggtgagcacttagggccttcttagatatttcctggttgtgtgtacagctctgcccatgtgtatggccttctaagtgtccaggaatatattagagctttgtaaagccttcaatggacatcttattccctagattcttttacaaaggtttttgtccagccttttatttgccccagttcatattgctacttcaggaaattgcaaccttaaaaatttgccactgattatttttgacaaattccctggggagtaggacttttccaactgagcaaaccctgggacagatcaaataacaacaaatcctataaatggaacttttccagatagcttccaggcaattatttagggatggagctttttaaataactctaaacccagtctgcaccctctactatgtatttggctactggttttcacagctgctgtgattgtgaggttgttcatgttcaaagatgctgcagagctatgaagaagaggatggtcatagggcaatctaaaacagcacagagtttgccattatcactgagattcaacttttttattgaataaacacccttcgggttgctgcaaacctcttgtcaatttcctgtgttctgaataagttgatttggcaatttttttcagagttctatttgcttttctatagcagtagatttttgaaggttcttattctatcatacctgaagtttccccaccccaacacacagcattatctttgaatgtaaaaaaaaatggaagcatcttaatatgcatcaataatggaaaggctaaataagtcatggtatagcccatgtaatggaataatatgcagccattcaaaagaaggaagtagtctaggtgatgaagtaatatgtaccataaaccccatgacacgtgtttacctatgtaacaaaccttcacatgtacccccaaacccaaaataaaaatttgaaaaaaggaggtagtaagtgaaagtctgtgatagcatctgagtgacaagagaagaaccactttgcataatatgtagtgtgtgtgtgtgtgtgtgtgtgtgtgtgtgtgtgtttaagcaaggaagaagatctaaaactcactcatttgactattaaggaaataatcatttgctcttacaagtaggtaggcctagaggaaaaaaaacaaaaaggtaacctaactccaatactgccaaaaaagaaaacatgaagaatttttactttgttatctgtgtttttcggttttctaaatttactctacattttctttatattaaaaataaaataataataataaatattctttaagaaatatttgagccacactgaggttctatgtgatctaaaaatctcagattggccccatctatgttagaaaacttttctatcaaatcaaccacatctgcttcccttttcttccaaacactggatggcaacacacacaccaaaactttcaatagccaatactttgagtagtggaatgctttttgatttagggactcttttgagaatctgatgaaatcatgtgtcctatttccaaaaaaagtacatatttacattatttgtctataatttgtaagcattcaattaaattaattaatcaggttaagaactgcaaacagcatgtcttcatcaatgtgaagacgtggagaaaagggagagatctgggaacttcaagcccctatatttatacagaagagaaaaagatgcccagagaggaaaccacttgcccacaatcatactgatggtaacagacctgagccacatccaggcctccaaactcccaggtcaaggctcttcccaccaagttaccttgaatcatagaacaaatgattggcctgtttaggttctccaagactcttagaggccctgtgccaaagacaacctctcattactgtgacttctctgactggttctgacctgatttcaaggatccttgagataggaaggtagagggaaaccagacctgccatccaactggtatttactaaatttagatgttcacactgtgctcagcctgataaaaggcaccaagggttcacagaaaaagcccaagacacagacagacagttgaagatctgtcacagacagctatgaagacatgactacaaaacatcgcagcataattctgaagcaaccaggtggtacctggggtatgcacactagaccaaggaaggcaaggagaatctgatgcaggtgtgaatgtaaaggcaaggctccatggaaaaggaaagggaatcaaaggatgtgcagaaagttaaaaaatgggggaaagaatagaaggtatttggggagcaggaggagagtggacaccacatgaacaaaggcaaggagaagagaaggaggacattgatagggaaatagaggaccaggactgacaggaggtttgccagtggtttccttgcatacttccctaccccatggagcccctgcaagcagccccagctttggtgtccctgtccctgggccaaccccagaagctaactatgcctatgtctacttgactctccacagcttccctttgctgaaggtctgtaccacttttatcacaatggccttgcaaaggccaagagaagacgcagcctacaccacaagcagcagctggagagagaccccagggtgagttttccccagaaacctgcctcccaatctctgctgccatggctgagcccaccaagggggtgtggaggggctggcagggaattttgaagtaaaggcacttaatgtactatgatagggcaaatgaatgctttgcagagtcatatcagggactctctgctcctttgtctctgcataataaataatcacaggcccctttgtatggctggaggaagaggaaattgggataccacccttttactggctatcttctcctgagttattattgggtgaggacttcgggttgcctgggaacatgttttggcctgtgatggatgggaagacaacaagcagtttaatgagtcattttacggaaggtttctactggtgaatccacatgctcagaggaggttgccatgccccacgttgtgaacggaaagaatgagagagccagtcagtgagcagctcacagcaggcagtggacttctcagtatccatgcatgactgtggccatgagactatctcagcctttctttttatcctatattttctagcactgatctaatttgccttcatgtctcagctgtctacttgatgttcatcacccccatttttttaatcttcagtctttaccttgctcttggactccaggtcccattttctactccctgtgatggctcaaattcaactttcccccaatcaaacatatcatcttagcaacaaagtggcttctctcccagtgttcccacttcttgcctttcagaataggacctttagtaatcatattttccaccatcccccatacctacacactcatccaattgggtagattctgatttctgttacaagaatcactaggaaggaaagtatgtaataactcagacaagttgttctctgtacattgaaggcagcgtaacctctttctcaggactctcagggaccagctgatgaaaagcgtgtcagatgtttgagttaaggactttcacatgagattcttttgagctgatagaatctgaaaactcattcttgtggggcttttcatgtgaacatttccctgggtttaatttgggcttcaattaggaattcagataaaacagtctctcagcagattgccaaatgacaggccacaggcaattttttctttaacttctcaagagttcccaccttctctaaagaggaatttctgctctaggaagccactttaactttacttttgcagtaacaattaagctgcctgtgctgccagccaaggccaagtattcttaaaggatctgtcatagaagccggcaccaagacctaagggagaagctctctattctatgtgataataaccttggccttggctataccaattcattacctggggatacccttgggcagtcatatggacagggatcttgccctgaacccaaggtgggcaccagtagacaaagatcaccctggtgcaccgtgacatttgtcttccctacacttcaaccctatgccataaccttgccatttatggccagttgttttccttttagttatgtattttcttaaaagtcccattggctactcttcttccacgattaaaggcgttgctccaagattattcagaaacatataaactgggggcagaatgaaagagacatttaaaaggcttgggctgggaaagagaactgaggcacagtagaactcaaaagtccctgtttggtcagagagactatttagcaccactggcctgagcttttcccattctaacacatatgatctctgaaatgctgattcttgaagtatacagtgacacttttaaaatataaaatgggactaattgggtaataaaaagaagagatcagtcactggtgattctaatcatttgtctttctcttcaaaatattatctgttatcaccaaaaggggtgcctatttccccttcattatctattataaggatccaggtagccaattgcctctatctggtagttgtaaccatctgccttgcccatgaagaccaacagaaaatagcagaaaaactaaagaagaccaagtatcctatatcttttccctatcttgtcatcaaggttaaatgctggggatgttgtcaataataaactcattctaggaaaataaataaagcacaaaaatctcataatttttttcaaaacgaaaaaaaaaactgctaatgatgactgcctttttccaaaatattagattaaggtctgagtctttcctgcatgatgttctcgtggttgtctaattttggcatctgctgatagaaaaatagagtggcaactattctgaaccaaaaatcattgactatgaacagtgcaaagatagtaaactaaagattctgccttgtgggtttatagctgttaaacaaaagggtaaataagtctagagtaggaataccccaatttgggggttctcaaacacattcaaacaggttgcaaaaagaaaagtaaatgaaagaaaaagggagagaccaagtagccagaaggaggtccaggcttttatgtcttacatagatgtggcaagttatgctttataaacacagaatttaagagtaagttgttttagcattccctgaaatgtactgtctcctagaactgctaacgttaactacggttgcagccccagcccccagcttccttctccttcctgtccctgcaccacttcccagcctgtctcactcactgtctacaggcttgtggtaaggaacacaaagcccagggagggtggtctgagctgctattcgctttcagggcttcatctactgaggtagctttttgaccaaagaaacctccaagctctgctagcaacccaagaaataaaaaagaaaaaggtagaaacccaaggtactttttggctttttttgacttcagaccagaaatttcaatgatgtttgcctctcatgtaacaactaatttttatgctaaaaggaaaacagaaaaaaaaggactagaaagagctaaagtgctactttccatgtgctcatctttgttcatcaatatgcagacaatagctaagaaaacagattctgatgtagactgtgttaaagatgttcgcttctctttccagttcttcctgctaaaagattagctgactgccaagtatcatcatttagatgctaaaaagcaaaagttgtgtcttgtttatttcagtaatatctttgcacagtgagatgttcaggaaatgactgagcatgtcaaatgaatgaatgattactattttttcttcagggttttaatccatgtaatagtattgcccttctcattttatattttcctccgtatcccaaaatttgtctccattaggaaataaaagtactatatagtcttctccctagcacctcttttacatacattcttaattgtgggtaacagaaaccaatgactgtttcattacttccaagttttatcacaaagaatcccatgaagaaccagttcttaatttccaaaacccaatctgccttcttcctaatcatattcacagtcgtggtacaggcaccaaagcgggacaatgtgtctggaaggttttgataatgaaaataatttgaagaggtaataaatcaattcaacactgaaatgaaataatgaaactaaaaataccttctcaacatcagggtcaaaaacaaatattttatgcccaaaagctctgtaagatttgttcaacattagctagaacaataccaacaaatcttaaagccaaacctatcttcagtccctggtcaacatatcaaaacctcataaattctacaagtacctgaaaagcttccgaagagtagatttatttaagataatatttgcttcccagctctgtcaaaccatacttgcacatctgaaatagaatattaaagtgaaatatattttaaaaacatgaaggactcataattctatgagtaacacacactagtcttatggaagcaaaataatttaattaaaaaataacctgaacttcatttcttgagagaggttatatttgagaattaaaaacatttatttcctttactaagcaattttactagaccatacaattattcctcatttttaaacatgtttcagttttacaagtcagaaacttctatcagtccaataaaaactttccttgcttctctcatctcaaagaatggatgatatttcctttgtgttctatatttagaagctatatctttctagcttctttcttatccaaatgtatccacatgtttaataaccataaaaggcagccacacgttctggtagtgatctgtttttggtctttaagggtctattcttgaatatatctgtggagttttcaagatactgccaataacccacaaaatttagcttcactggataatataatcacttcagaaatctcataataccactggagcaaaagaaaagtttcctattctttaaaatcaactggacatgatttatatgatttgtgtgtattgtggccaaactcttctttcctttcaattatagtagttaattatttgattatttattataaattaaaagggaagagaagggaaaatgctgttatcttttggaaagtctattttcttttctttctttctttcttttttttttcctgagatagagtctcactctgttgcccaggctggagtgcagtggcacgatctcagctcactgcaagctctgcctcccgggttcaagtgtttcttgtgcctcagcctcctgagtagctgggattataggtgcgtgacaccacacctggctaatttttgtatttttggtagagatacggtttcaccatgttggccgggctggtcttgaactcctgacatcgggtgatccacccgccttggcctcccaaaatgctggaaagtctactttcaaattgaaaatgtcacggagaaaaatctcctccccctcttttgtcttgaccacaccttcctccagtggataactaatggaatttgaggtgacctctacttaccatcaccatgactgcatgagagcctcacagtctgggggctgggtaaaaatagaaattagatagttttagtgcctttttaagggatttatacccaaagaataggctgttttttatccttatacttgttaactctaagaggataaggtctgaggttgtgaggtgctgctctgagaaacatatagaaattttccaatttatcttccaaatgttttattgaaggaaaaaaataaagcatatagatttgattatattttacttattaagaaacatagtcatggtaagtttattaatattatgagaaacacaaaagggaaaatagcattttgtatttttctagaactttttattctacagggcatttgtggctgctatttcttcatattctcatttccttgtagcataaattggacaaagggtggattctgagttccccaaattctcatggtttgtaaggagacttaaccactccatggtgctgctctacactgatttgtattccataattttccctgctcctctgcacaaagagaattatagagcaggaagagtcttaaggaaacattgattcagcccttgaccttgaagcattaaaatataattttaccattgaggcaaaatagacccagagagagagaaggtgacttccctggggccacacagctataactgataggaagaaaataaaactcgtgactcctctcaatacgaagtctgatttaaataaaaaactaagtgagaattgatactgcttatgaatctgtcgttctttaaacaattgtttgcactaattagtcactgaattttctcaattaaaaataatgtgctgaaaagaagtgaagttgcctcctgagtttatgtcacttatgtgaattcagtgagctcagctataaatggaaaagtgaaaaagaagagggaaataaaaagggcggcacttgagctcactgttctgctcaatttgcttatgccctggagtggccttgaactgaaggcagctgagtatgcagttggcctcggttccctggtgaccctcacagtggaagcatttcacctttctgggggtgagcctgtagcatttaaagttaatacttttgatacaaaatatttcctaaacgcaagctgacttcttcatttgctgtgagaacaatgggacacgaccagggtccattgtgaaagggaaattccacccttgtgatgtattgagacacaatatcagtttctaacccttaaggagttttcaaagttaattttaaccatgcataagttccactttgcacactttagaattcactccctaaggcgtgattcttctaggagaaattaaacaaagatggggtcttcattttggatttcccagaaacagactctgagatgcagagttgtatgccagagacttcttggagagcaaggaagagaacactgggcaaagggagaagctgagcaaatgggctttcaacaggggcctcagtcaattttacaggaaactcagaaacaggggtggcccttcagagttaccccagtgtgaggcaaaggaaccggacctttgtgcccccataatgaccagttattggcatgggtactccctcaaaggaaacatagtcttaggtaaatcacgtcctgctaccaaaggcaattctcagtgaaagaaactctgagccacatttagcagctggaggaaatgtgtgagggccctaaagaggaaatctggagagtgcaccacagttttcattacacctgccatgcccacttcactcaatttgtctgtaaattcacatttgattcaagaggcattttctgggatctttgacctttctggaagagtggacatggcttcccagatcaggagctctccgtgcccaatccagctccccatccacccctgctgcccttttccagagattgaactgaactaagaggggaaaacatgaatctgtaggcacatgagctggaccatattttgaacacaaatagtgaagccaagagacccaagtgaaacagtttctgacctagcctcccatctgtggccaaattcattttctagataacatgccaagaggtcagcgggtgtaaaccattcatgagtgatgcaagttgagagttacttgacagcatcaggaaaaggagaaatgcaatgggggaggtatgcataagaagcagggcagaggtatcttcatggatgccccaacctgtgggaaaaattcatctgttctaatcctctgctttcagaatgtggcagggaggactttcagcatctcctctgggcattgcagatatgcctggcttcccaactcaaagagctgctgctggtgctataattaactatttgtggggaacaggggagaattatttactacagctacagaaaggcacagggaaagctgctaatgagtaagcctggtttttttctagatgctgtttttttctagatgttcatttttaaatgatgggtactgttcgtgctgtcatgcttcctaaaggaaaagtgggaactctctgggaggcatcatgctagcaaagccagagatctcttggaagttttaactttctttgggagaattcttacaagccctggtatagagaaaagttaacacagagaaaattggtggctctgtatcgtctttacaattcacaaggtgaagagtctctaatggtgggctagcaaacctttaggacttcctgggaaaatcttagatgtttgaagggcaaaattctcctgatctgcctcacctgattccctccccaaccttccccaagatgcaaaaggaaatgcatttatatatccaatgtgtatatatatatatatatatatatatatataatgcatttatatagcctctattatatcttctaaaaatgattatatgtgtatgcttattaaattcataatgtaactctcttatttagttgttggctagaaaaccagcattcattcagcaaatagttatcaagtccaaactatatacagggcactcttctgcatactgaaatataacagtgaacaagacaaagtcctcctcccagggggcttgtatactagtggcaatgaaggagagaaacaaaaaacagatgaccaagcaattgtatgaatggtggtcaaaatgctatgagaatgagtagagcagagtatgggaagagggagagccatagaggggtgtttctattttataaaaagcatccaggtttggctagtctgggaaagtggcatttaaatatagacctgaaggagatgaggaaggtattcatgtggatatctggagaaagggcactccagacagaggaaccaccaaggaaaaaggcctggaatccaagacacacctggtgtgttccaggaacagcaagaatgcgagtaaagctgcaaaggaatgagccaaggacagtggggaaggagatgaggttagagaggaaaaataaagcaagatcatgggcgacatgataagctggggaaagaactttgaattgactctgaatgagatgtggcttctgtgcctatgggcaaataatagacaatggggtagaggtatggatgagggacaactggactagagagatccatgcaaggcgattgcaatatttcagaagagaaaagccagtggcataggccaggatagaagtggtggaggcagtgagaaacaaatcagatctgggagtatgttgtgaaggtagtcttcaaattcgttgatgcatttgctgatggattagatgaggaatgggagaggaagtgagaaggcaaaggtgactcctaagttgttggcctgcattactatagaatgaaatggcacttatgcatatggacaagatggtgagaggagcaggttgatggggagtggttagggaattaagagtttagttttaagcacgttaacatttgagatttgtattaagtaaccaagtggagatgatgtgaaatgaacagatggacttaaggatctaggagagaggtcagagttggagatataaattgagaggcatccatctattgttagtgttcaatgccaggagactagttgagcttacctacgaaatgagtgtagatatagaagagaagatttgtgggactgagccctagggtactctaagatttagaagtcaaagagataactggggaccagcaaaggagacagaaaagcagcaagtaatctagaaacaggatcagaggtcaagagaagaccaactttagccattgtgttctagctcgtctacattttaccatagtaacttggccatccctataattatttcttattagaggtatcaatgtttcttcacttttcccctctctgatctatttttcaaacgctttctcaacggatattgaaatacatggttcacacatgaacttatgaaattaaaggatactgatgtgtttgggctgggtagtgtgctttaaagcagcaggaggtcacatttgactcagaatgttgagaatctagctcttaaacctgcaatcccaactaggcactaactcagagccaagaccgcgttctgcaagctgccaggtgaagttaccaggaaacagcctctgtttgacatgtcaagggaagaacctgaattgggcacctctttttaattttgagaaactataaaagccatgagaaagatcatgtttgactgtaaaccaaaaagaaaaaaccttaccctccaattaaggaaaataaaattataagttgttgttgatttaattctgatcatattttcatagatttcagaaagatatagtttttaaaagaatttcctgttaagattcaaaattttttctaggatataatttctcactcctcaaacctctgcttcaaaataaattttattcaatatttagcataaggagactataaagttccttaatggtgacataaatgaacagttataatcgtatgtctatctagctactgaatatttctaagataacgttttgtgaggcaaaagtggtttgaagttggtgatgcctcaaaaaaaattttttttaatactctttagaactctttctgggtattttaaaattggtttagctatttttcctttttgatgcctattgacatgtttgtgatcacatctctttctataaacaggtttcacggtcttaaagccaaaccaagggaattttgaaaatgagtggaattgaattcctgccatttccagtaatttcaaagctttatgggttcaggagaggataacagtgcagccaggtctagaaatgagtaaacagcagttaggcaaagagattcatgtctgaataacaacccaattgctggagtttatctaattggtttgccattatctgtaccaaaaacattgtgtttttcatcttctctacgatgagcatgtcccatttagcaataaagaacttattgcttgagagaaaacaggtaagacaaaatagttttccattccccctgaaaagggagagcagtccatcccaagtaaagaatagtttaatggatgttaatttttaaggacaacttagagaatcaacatgagaaagtttcttctcccaacagaagcaaagaaaagcaattaaaacctattgtgtggaaagagacccaaataattgtctattagggagaaaaggaacatgatagagtccaatttgaggtcattcttgagttccaatacttacactgacaccaattaactgtgctctccttgaacaaaccgttgtttcccccagtcttcagttctcttgtctgtaccatgaggagtgtggactagttagtctgtaaaatgccctctgaggtcctaaatctgagattccagggactaacctgaagcctctccaactggttaatatcaaagccacgactaaaacccagcaattctaaccagtttgtgatccttcctttacatgtctttcttttcatctgagaaatagggctttttctttaaaccaatgctataaagtgtttgcaagaactagcatttatatgttggtatcctcaacttatagaacacaatttcaaatcctgtactgttcaaaccaattcaatagtaccctaaaattccatttcttgtctcgggggaaatattagattatgagatagaggttattcatccacttcaaagataatagctcctctatcatgttttataaattgggatttggtttaagatttccctggtatcatgggtgtgaaggagtgggggtccttaaaataaaaaataatgtttgaaaacctttgatagctaaacaagttcgattctttagcctagtcaatcagtgtatccaacagggataacaagcttgatgcctacacaggccatgcaaataaattacaaattgaggtgggtcagttgtaagcaaaacagctactcaagcaagagaataaacggcaaaatgatcttctcctctgtgtgaggaacacaacagagagtggtggggactgtggtgaacctgagtgtacacaccctcttaaaaggaggaagcggattcttattctcagctaattgttacctccaataatggacgccctggttgccacatctacaattttgaagaaaagtagcaactaccaatctttgtaaagattcttttatctttttaaaaaaattagtgattaaattaaaatttcttaacacactgtccaatctaaagaaaatacatcatcagaacaaatttttccatgcactaccattttgcagtccctactctacaacaccccaggacaggatgaaacctgatagaacacctctatgactagtccgtgacttcattatttgccaaggtagtccacataaaagttcttccttaagggaattccaaagctacttccttgtagcgttggttcataatccacattctcctttctgaggccaaattaatctatcttccatgtgagaacccttcaaacatttgaaaatagttatcatgccccctggaccttcctagagtaagcattcttagttctttcagatgttttcattgaatttggcacttctttcccatgccttcctgattacacctctctgaacattactggagaacaatacattataacatccaggtctgctctgattatttcagagtagtattgcatgctcacttcccgtatctcccacattttaaaagctattcttctattagcacatcttaaaatcattttagcattttgtggaagtcatagatctcacattgattaatagtgaacctacaattagctaaaatttctaggttcttctaaaatacactcataatccatccttgaaggatcgaggtattggttctaaaacaaggaacctttaaaaaggatttattttttgaattttcatcttattagagttcattctgacctgtcaagattttattagatttggattcagtctcctttccactttcttgtcatctatgattttgatcagcatcaatatcttcaacagttcttaagaaaaaagttaaatagtacaaagaaaaatgacaaagttcagaaccctctgccaggatgatatgaatctattaatatagactctaaggagtatttcacactgaccccatattaaaaggaaattctaaagcacccaaagttctgaaaaatcattcaagttaaatgaaaaaacagtgtctcaccagggaggctatttgaagactgtttatatggcttaactccaacactctgaatctggttgatttgtgtgtgtatatggctctctgagaaatcagtttatttgccatggaacaatctaatttggtcattcacatgactaaaagtaccagaccaacatgttttcaatccagtcccttgaggcaatttgaattctgttgataacttgtccacacacctgctactgatggatgtttcgtcatgaaattttaatcagagagccaaaatcaatgggtaattgttaatttcaagggtgccaggtgacactcaagtgtagaccaaaccaaatttttataaaacttaataaagtgatttcctttaaatgagtaagtcaagatatctcagacatagattaattcagctaaggatcatattctccagagctgaaatattaactatcattgaacttctatcagtgcttccaaaataattattctaacacttattcatgtgacatgggcaagtcatttaaccttcactaattgtcttcattttatcatctctaccattaaataacaatgaaagtccaaatgactggaaataaattgccttaatttttaatccctatcatggaattacaatgaaagtgcaaatgtctgccaatacatgcctaagacttcaaagctggaagtatgactccatctaaagtacatgttaatttcacaaatacattataactttgccaaagcagaaaaggtgatagtgtcacctactccttttgcatcttcttagttctctacttgttttccttgcctgcccctactccatgaaaaatatgggtgtgaattaaatcagtgttccttaaactgtgttacgctggagtccttgggttttcttccagaacgttgtgaataataaagatattagttaggataaactagattacgctgcagtaacaaattaacttttaactcccaatggtttaatatacaaatgtttccttttcactgtgctacaagtcacaagtccagcatgagctggatagatttgattaatataatgctgttgaaagtttcaccatcttgaaacgccactatcctagcacatgaattccaggacactggaagagaaagaggaagtgaaagcataataagctctacccacttgtaaatgcctcagcttgaaaatgttacatatcactctgctcaccacccattagcgagaactaggcaaaatgaatgtcttaatgaaaagaagctaagaagtgtggttctcccatgtgctcaggaaggagagacaaactggatttggggagcagtagaagtcccttgcatagtgtattttttattcaaaacaacaataaacatgtgaataaaagcccatattctattattctgggtgatccttgggattgagactttcccataagttcagcactcatgtttataattgtattggcagcaatactgccatccagtctctggctattgagaaagggtgggatacaccccgggatgcttctgttgtcctaaaatgattggaacatctctcttcatgtgtgaccttctgcaatagggcctggctcctcctctatccataggtagagtctatttattcacccatgtgaaggctctgtaacattttatctggtagaacgtggtgggagtgatactgggccaattctgggcatagccagcccctacctgacctggtagcttctactccttcctcagagaagctaaagaattgtgattaccctgagaactccatgctgtgagtaggccaagccaggtggagagattgatataccgtggggagagagagaggccaaggagcaccaagataccagaactatgagtgaagaagccatctcagaagtggatcttttagccccagtcccaactgctgttacctggagacaaactacccagtcatgtctttcctgaattcctgacccaaaaaatcttgagccaaataaactggttgttttaagccattagtatgtggtgtaatttattatgcagcaatagataacaagaagacaaacgaattttcccagcagtgcagaggggatgagtggtggagaactgagtcatggcataaagcacattaaaatgaaccccaagacactacaccccagcagtctacagcatagtcacattgtgttttaatcagcattgcttctttggctattattgtttttgtggtgtttatatttaactcgtaaacttgtcttagttttatagttgtataggaaccataatcattaggagttgttattctatcttattttgtgcatattatttatacatatatatatatatatatatatatatataatgttgggcgactaatgaaaaatggttttcttataaaagagtccctttcttgtttaaatttattcgagtttaagaaatcaatgcatttgaaaagatctaaaagaagtaggcttttccaaagtataaactttggcatgaaacagaagcaatgcatcccttttggtgcagtgatatcagcaggtaacagcatacgtagtgagaggagaatcaaaggaagaattaggagttccgagttctaatcacagctcagccatttattgtctatgtgggctccaggtaaccacttagttttatggtcctcaatgtccccatctgtgaaatgattaatgacattacctgtgcttattacatggggttactctggcaatcaaatatgatagaaagaaaggttcgaaaactgtggacttttactattgttcatagagattcaggctagagtcttaagttttgtgctgacaaatctaaaagtaacctgactaaaaatgtgtagcaactgagtttaaaagaagctcaaataaaattatctttaaaaactcaatccaatgtaagattaaataggaaatacattggatttacattttctttgaagtataaggaaacgtgcagtctgctgggatccatcacactgcttggtctggaaaaagaggagggtgaattcagaactcttgtccctctctaaattcttgtaaccttctaatctctctggagtgtaaacttgtggccaagattttgagctctggataaattctagttttaatctcaggtccaccactcactcacttgccagttacataagtttacgttgttatttaacatctcacaaccacatctatacaatgtgggtaataataatattacttatctgaaaggttgatgtgagcattaaatgaaatgatgctagggtaaacgttcaaaagatgacagccatgaccaataatattttgttctctagcattcgattacatggtgactgatactgatctctgaaacttgcctatgtagtagcatttttgttcactgctgtcctttagtaattctacataccataaaaaaattagttatgcatggtggttttattttcatcttaccaaaatgatagtttacagttttaaaaatcaaatgcaagccttataattaaaaacagaagcattttgctccagctttctcaaatccctcagaggcattatccaccaattctttaagtgtttcttgtgctaattaactccacattttaaaataatatgtgtatgctgaaatgtgtggatttgcttcatttcagatgttgtctatgggctttcttctatggaagatgagatttaacttttaaattcaacacacacacacacacacacacacacacacacacataccatgtttatattttttctggcttttgaatatagatgtatcacaagatggggctaggttaatattcagtgttcatattattgtgagtccttaagtactatttacagctgagccatttataccaataacatcccttcctctctcaaacagctttttgtttccctgtagttaataatggccctgtgatgccctctctcaccactcctattcaacatagtgttggaagttctggccagggcaatcaggcaggagaaggaaataaagggcattcaatcaggaaaagaggaagtcaaattgtccctgtttgcagatgacatgattgtatacctagaaaaccccatcgtctcagcccaaaatctccttaagctgataagcaacttcagcaaagtctcaggatacaaaatcaatgtgcaaaaatcacaagcgttcttatacaccaacaacagacaaacagagagccaaatcatgagtgaactcccattcacaattgcttcaaacagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagtttatatagaaccaaaaaagagcctgcattgccaagtcaatcctaagccaaaagaacaaagctggaggcatcacgctacctgacttcaaactatactacaaggctacagtaaccaaaacagcatggtactggtaccaaaacagatatatagaccaatggaacagaacagagccctcagaaataatgccgcatgtctacaactatctgatctttgacaaacctgacaaaaacaagcaatggggaaaggattcccgatttaataaatggtgctgggaaaactggctagccatatgtagaaacctgaaactggatcccctccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaattaccatcagagtgaacaggcaacctacagaatgggagaaaatttttgcaacctactcatctgacaaagggctaatatccagaatctacaatgaactccaacaaatttacaagaaaaaaacaaacaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacacagttcatgggactgtaaactagttcaaccattgtggaagtcagtgtggcaattcctcagggatctagaactagaagtaccatttgacccagccatcccattactgggtatataaccaaaggactataaatcatactgctgtaaagacacatgcacacgtatgtttattatggcactattcacaatagcaaagacttggaatgaacccaaatgtccaacaatgataggctggattaagaaaatgtggcatatatacactatggaatactatgcagccataaaaaatgatgagttcatgtcctttgtggggacatggatgaagctggaaaccatcattctcagcaaactattgcaaggactaaaaaccaaacaccgcatgttctcactcacaggtgggaattgaacaatgagaacacatggacacaggaaggggaacatcacacaccagggactgttgtggggtgggaggagaggggagggatagcattaggagatatacctaatgctaaatgacgagttaatgggtgcagcacaccaacatggcacatgtatacatatgtaacaaagctgcacgctatgcacatgtaccctaaaacttaaagtataataatgatataaataaatagataaataataatggccctgtaaccccaacactttgggaggccaaggtgtgtggattgcttgagcccaggagttcaagaccagcctgggcaacagagcaagacctctgttgcctttttttttttaacttgctcactttcctatctccttatgtctaatttttcccctacattgtctaatagtttcctaaattttttcagtatggtcaaacgcatcccctaaacgatccattgctttatttggttgtcatccaccctagagataccatcctttgacttcacgatgtagtggttgctttctggaccagctcacacctcttaccctagcacttccttcactattatcccaggaattccctgttggctggatagtgttggattcctctttcctggaaccccttcatttccctttctcagattatttccgcattccgatgcagaatgtccttcatgagaggcgactttttaggacttttaatctgcgttcaaatcaattaatagtttgacggttatcaactattaggttgggaataaacatctctcagaaatttgcaagtgtttctctgttatctttgcctacaatggtgccattgggaggtcaagatcattctaattcctgtttcctggtattcctctttctctctagaatttgctcttagttctctgcattttgtagtgaaactcgtttctcttatttgatttttttgtttaagttcatttttttccatgaaagctatgtttctattgacatgacatttgagtattcattgcaaagctttaaaatgtgtgtggcccagtggtggctcacgcctgtaatcccagcactttgggaggccgaggcgggtggatcacctgaggtccagagttcgagaccagcctgaccaacatggagaaaccctgtctctactgggcatagtggtgcatgcctgtaatcccagctactccagaggctgaggcaggagaatggcctgaacccgggaggcagtggttgctgtgagccgagatcgcgccactgcactcctgcctgggcaacaggagcgaaactccgtctcaaaaaaaaaaaaaaaaaaagtgtgtggcccatccacatgcaaatatccttgtttctctgataaaattgctgattgtattcttgaagtgttgattcaataagtgttttcaaaacaacacttttttatttttttattttatttttaattacaaaagtaatgcatatatgcatttttatgctaaacatccaaacaaatgtagaagacaaaaaaaaaaaacacacttgttccaaatcaagcttatatcctccgcagaagaaaacactattatcaatttaatgtgtagctttcagacattttattatatgtcaacatggttatacatgcacatatggaaatagagagtttaatttttgtggtaagagttttttaaccaaaattgaattgtatagtatatactattttgcaaattcctttcttccatttagtagtatatcttagagaatttgacttataagtacacacatattgaatttttcttattaatgactgcataagattccaaaatgtagatatactatggtggaaatttctttcaaacttttcactacataaacaacattgcatgcttctttgtgcacaaatataattgtttctttaggatagctgtcagaagtgaaattgatgggtcaaatttgtgttttggtcttgtaattatgccttatcccagaatgatgccatgtggaagttagacacaggcccttgtgttttagaaagtgtggcagagccttctcaacttcagagtcacccagaggaagttataaaagtcagaagggacctatggctacatatagtgggccatgtctaataagaaggtagttttgttccagaattctttaggtagggaaatgctctaacatctgttagctctacctaagacaaatagaagattctccattaattccccaagtcaggaagtgataatgaggtacacctagtgcctgggtgtttaagatcaaaatgatagctgagtaattaattggcactttccatgtgccttttgtctttctagctggccaaataagcatatctgacagtgtgtggcaaatgataaactcccacaccaaccatgtggaggcccgtatctgctgcaaaaatcagttgttccgatttgcttttcagcaacctcagtggattgttcctttctatccactgcattttcacttgtctggaaggtctttcaagcaatatgactataatttgcaaccaaatctgatctcccgccatatttgccttctccttctttttcctggagacttctttcttctccctttaaaagcaaatatttttacttgaaagtatagtaacccaggtgaggttcaccttcaagactctccatctgaggtcaaactgggcatgtgacatttctcagttgatttaccatccacgttgactacccatctattaggcagattttggagacaacctctttgtcctcctaactgtgcaatggaattaggcttctcccttatcgacaatgaccccatacctaacttcagccttcctggaactccctttttatctaaacacttctcctggccctgatgaagaatgcagtccagaaggaaagccagtgaactttaaggtcaggtgctcctgtcccttgggagcaaacctcggtaaagactagatcccaaatgtgggtgctatatacaactagttccaccccttactatgttaccagtgttcccatggtgatgctgagaatgttacaaggacctttcactcagctattgtatcagttcaggctgcttggtctgggcatgccaataaccatatataaatgttttgtttctctttattctaattaatctgcccacttaacttggctggtatggcttctcatccctggcccaccttttatcatactctcacctttatgtttgctgccccctgttggttgctgtgaatcccagtgaatgctgtatgttagccaagcaattgcaggccatggccagcctatgcagcaagccaggtgttctgataccttttcttgcaggaatgggaatgtttctgaaccctctggaaagtgccctgccactctcacctgattctcatgcttactggtcccacctatggataaagattctctctgggaattgcagggaagctgccattcctacctagtatgatgtcccagtaagccacttgactgttgcccttaggtacctccccttccccatattattcttaatctttgaccttcccagtgccattcacacaatccataacagttctctcctaccctggaatattctctattagtctgactccacctttcaggagtttctcatggtgtatgctccactgggggcacccattttgctttctaatgcagttaaggatgtctatataggcatgtatatatttacatatatatatatggatttatgtttatatagctgtgtatctgcacaaatggcagacagacaatccctacctctctctccatacacacacacataaacacacacacacacatatgtatatatatgtatattctgcatatcatattataggatgatacatatgtatgttaatatcaaagggttcaaagaagggagaagacatgggaagtggctcttagtctgccatttgcactgagtcctctgtagctttaagaagaaatatcgatttatttcattggttgtgcttgtttttgacccaaatgttcactttagcccatggtctgatcttttcaaagacaagcttactcaagcaaagaaagaggaaagctccccattgtcacgtcaattatagataagttcatgccaacataatacctcctcctcatcttatttctgtagctcaggataaaaagataatctccaaaggaggcctaaaaaacagccacattaattaaaggaaagagattttttttttctaggaagtgcctaataactaacggacaagcaaaggagactcattagtggaagtatttcctttgaaagggcacacacgctgtgaaaaaaaaaaaagaaagggttatgccaggcttttctctttgtaaataaagtgacaccttttatctttttttctgttaataacacaggctggggagaatgagtctgagggaggcttgtagataagctggcaggatttgaagattattcagatctttagtttcttatttctctatgttctagggtaagacttttcttcattgttcatggccttgtataaagaatggttaggattggggatcttagggagttaggcttaagagtggtggcttagactccattatcccagttaactgatgaaccatttgccatgaacacctttggtaggtcatgctccatttagcaactgggcagggaatccgatcacctcaaacactacattcaaacagaaaggcaaaagatgctataaaagctagatggagagataggtggatacacagataaataaacctgatagaaagatgatagatagagatataaataagtaggtagataaatgaatagataggtaaagagactacagaataattagctaaattctgtagaaagacctaaaagggaaaagatattcacaagcgggggcattcagggtgagtttgaatctttaaggagatttcaaaaaggcacagagtgatgtctaggatttgcatgataaactggaatcttacttggagcacattttaccaacaccccataatgaaggttacacacagaaacagcctcagactctccagaaggaactgtcgaatttgatgagcacacatagagctagactaaatggatggggtgctgaggctgggcttccataccttaagtacctacgaatcatgtgagtgattaaaagatttcttaggtcaggcctaatttctaatcatctctcactcaagccagcatatggccactgtatgagttcaagagtgagcatttttttgaaacgcagttaagacttcagtttcctgcaccgaagaactaagtcactggcaacttgtcatgctagagaaaaaggcaggggacaattccatctcaggtatcatcacttcacgttgcttaccctacctacctaaatccagctagcatgtttgctcagccccacgtcagctagagtagaaattacttatccacttctcctctacacaaacctctctttatgagtacaaataaggaaaacaagcctgccaaatgacagtttgtcattgcaggagccatggccagaatccacatttcccatatctaatgagtgtgactccagccatgttcttcatttacatttatatcgttcacaggaatccatgtagccctgacttttgtgggcattgttatatcaactccacccccaccattgccatctcatctggtttgggagttaacaaagctctgtcatcttctgagtactgtgtgagatggcccagaaaggtatcattgttctcacttgggaacattgttcccactaaatggagagatggaggtttatggagctaacagtcaaagagtagcagtcacatccaggtcttcagcagcaccaggcttggccccgtatacatgaactctgactgctccatcactaacaaggcacatctaatctggaactgtgccttatgctttgctaactgtgacatacagcacactattggcaatggctttcgtccactccatccaccatcaccactggctctactttgcaggagttatctgatccattttctctgttgtttccttgtgagggagagcagacatgcacaagctattgtcaaaggacaaattacaacaaatttagtttaaagatctcgctgggctttatagcaattttagaattggtcaacacttaattccataaaatagaataagtgttccaatgagcctagcagaagaggttggctttctagacagagaatgtaattgtactaggtttgttgcccgatgtgcatggcaaatcaatatgccaagacactggattgtgacagagaagagatttaaccatagggccaccaaatgaggaagagggagggaaaatcaaatctgtctccccaaggagtttggggatagagtttttaagggttatggagtgggctgaagcatggagattgttgacggggtgaagagtacagagtgaagtcatgggacagggagataaagaaactatattctcactctgatttcattactctgtggggggtttcaaactggttggcaacaactgttttgctggaattcaggatctggaaaacaccttaagcaattcttaaacaaaagtcttgtgattttaatgtcagagatcttatctataggaacaatggggatgccagtggtcaggatcagtgctctgtgactatcaggttcaaggaagtgggtaaaagtgaaggctgattatttactcttatttataactatatttctgtccagaattcttcttaaccctgtgaggatggcttcaagaagggttgaagaaagcagaaacaaagaacaaaggatgtattcattatttttcaaagttactttttcttgtcgggtgggaacagggaaatagaacaatagaaaaataactgattagttaacatcaagtcatgtcaggctacttattttgtgtaaggaatacagcagaaggaactttattaccatgtcgattgataattaaaactgacctgcttggaaaatggctgttatttctgtctcccgatttctcagaaggctggataatgtcatagtttaggtttggtgatgtagaactttagcatgggtgactctattttgatctttagtctggtctgttgaagtctagtgcaaaagtttagtccaaaacaacaacctcctataatttttaacactgtaaatctctcactagccctgaattcttcagtagactgtattttgagctcctgctgcaggcaactgcagacagattggccacataagagcagtagccttcagaccaaagctcagaggaagtgccaaaacatgtacaaaccctggatgggttctggccttggcaatcatgagccaccattactgttaaggaattaggagtggaatagtggaattttccttgctccagattttaaggacacactcaacttcatccaggccccagcacatcacagacccacctatgagtcagtactaatggcagtactagtggcctcaaaggacatttgaagaaaaattgttacttaccagaccccaccagagctgctgagatgatcccatgtaaccctaactacagagttacctttagcttttttcagttaaattgtattttatgtgagttttaattgacacaaaatataattttgaaagcctgcaaaaaaatgcataaatgtaaggcagaaatggccaggacattcctccaaataactctgcctggaaaacaaaatcttgctgtcattactggattgttcttgttttctccacatgaacaaggtttggataatgaagtaacagctcttcctggagccccattgccaaaaactagcaataaaggaagaccttactacctaacacatgtggctacttgaaaattatctgaaataaaaacaagccagaatcaacataatagtgtataacaaaacccagatgtctcttgaataaaaggttaatcaaatgctaatgttaaacgaaagagtttcaaaggcaggaggaagaatgttagagataaatgaagaaattaggtgcagcctctgtatgacttggaagagcaagctctctgcacaggatcgtttttttgttttttttaggaaattaagcttttctttcacacctagaatgtgtcagatgctttataagaaaggcactaaatacttttccaggagcttaatcttcaaagtacaatctactaagatgtacctggaggaagaaaaatgtagcaattcttgcaaagcaatgctttggatattacctttctgccatattttggtagacgtttatatataaatcctggtttggtcaggaatccagtaagaatttgcaatgtttgtaaaagcccacctgctttgctcatgaattgcagaacagctcatgcctccctccacagcaccctctgccctggtctccatcccagtgaagggggttgtgctcacagtctgtatcagaatcagtcagggttctccagaaaaacagaagcaatagggtgtatacatacaggttgtatatgtaaagagagatatttattttaaggaattggcttatgcaattgtgaaggctggcaagtccaaaatctgcagggcaggccagcaggctggaaatgccaacaagaatttatgctgcagctcgagtccatggcagtctggaggcagaattccctcttccttaagcggaccatagtcttttctcctaaaaccataagataagacccacccatattttgagggcaatctgctttactcagctctgctcacttaaatgttaatcacatctaaaaaaaaaaaataccttcacagcaacatctaaactagtgtttgaccaaacatctgagcctcgtggcctagcccagttgacacataaaattagccacacatccagtgggcaagacagacaaagtcacaatagacatcgaaggctactggcggggactgagagaaagtggggagtctacaagggtgaaggagaggaaagcaccgtgaaaaatacttgcaaatatttattcatgaggtcgggaggcatttcagggatcttgcaccagcatgtgcgtgtctgtgtgtgtgtgtgtgtgtgtgtgtgtgtgtgttaaaatggggaggaaataagagaatgatacaaatgaagctgaggaagtaaacaggtcaaggaggggagggtggattctttcttgtctgctcaagcataggagcaagtggggtcatgcaattttattttataactagtggctaagcatccacttatcttatggaagaaggtcctcaattctccaagaaccctggtgcttcagagtcagcagtgccattagcaaccacaggtggcgctgtcctttctcaggagagcaccaatcctacaactcctttggttaagattataaccctggccagccagtattcccccaagccaccctagtgggaggcctggggagccttcctaagcccctgggctttgtgtcatacctggccataaggcttgcctgccttcatgctccagatagctttactctggtggcctcgttgcccttgcctaacacctgaccttgatgtaccctcccccagctcaccctgaaagagcagcctgactgggaatctggggatggggtgtttttcctttctgtcccagaacgccctgtcttcctcatgcaaggtgatgagctctcacccaagggctggctctgcaggctggatcacacagctgtacatgcccttccccacttcccattctaaatccacctgatcaagctggactccttcaccaggcccttccaggaacggacaactctgctctgaggagatcccttctcatggaggatgactcagcatgtcctttcatgcagcttccatctaacctctacctcagcaggtgtctgctaccctagggcacatgaggatgctcccaaagccagcagaaatccaggacagcatttcaagaaggggagaggccagggattctgcaacatggtctgtcacagaggagggtggcttcgatggacagcaatagcaagaccagagcaggtgcaattccaagggtgcaaagacagctctggatgctggagaaagtcaatgacagtgagtccctactcacctgctccaccactaatggctgcagcaatgccacggctcatgttctgggctgaattgtttccccccagattcatatgttgaagtcctaacccccagtacctcagaattagactgtaattggagattgggcctttaaaaggataactcaaatgaagtcactagggtgagtcttaatccaatataatgggtaaacacccatgagaagggcaaatttggacacagacacacagaagaaagaccacaagaagacgtaggagaggaaggccatctgcaacccacagacagcagtgtgagaagaaaccaacccagatgacaccttgatcttgaacttctagtctccagaatcgtgagaaaataaatttctgttgtttaagccccccagtctatggtactttgttacagcagccctagcgaacaaatatactggcttcaatctaaatcaacttgcagttagcaatttcaaaagactgcgtgaagctatcccaaaaggctatccgcaaaggaaagctgcgttcttgtgcagtactattaatagattatagaaggaaataaggatgacagatgttactggaaaccaccttgtgcctagaaagaagcatttcctttctctcaaccgaaggacagcagcaaggtcccagatggtgctgaataagcaagtgatcaaatatcttatcattttggatataaatcaatgcagtgatattacctctcaaactttgctcaatcacttagccttgttagattagtcaatatctaggttgaagagcaaaatgagaattggaattggccttttcaaagtcagatttgtgtacctaaaacaagccaaattagttttgcattaaaaaaaataacacagcaagtcacatatgcatatttgagggtcactatgaagctccttgtttaacaactaacactgattgtaataattgtgccactgtggttctgaatgtcaataatgggagaggttctgtggagatggggtatatgggaaccctctgtactttccactcatttttgctgtaaacctaaaactattctaaaaaatatagtttattaatttttaaaaactgaaaatagtaactatttaaaaatactttgactattcaaaaaaccaacacatcaattagtctgtatctatcaatatatatattttagagagtatcactttaaaaataaaaattacccatacccaaagctaaacatcacttaactttttttgtttatatcttttcagtgttttgtctctattttttttattttacaaagctgactttctattgtaaaatcaatgtttgttttactttcctttataatatagcttttgaaagctgcaatgtttttcattgtatggttatagcatcatttatttaacaattcctctatttaggaaaaatggccatttctaattttttgtagtaaatgagattcaaaaaacagtgtcaaaataaattctcttttgtactctttaatgtacatctgattatttgcagaagataaatttctagaagtagaattggtgcattcatcagtttgctcattgtttaggttttttaatacatctctgtcaagagggtattattagcatttttcctctgtcatcaatttggcaggtcagagatggcatcttattttattttaatttgcatgtacttgatttttagtgaaagcaatttttttccacatatttctcaatcatttatagttttctttggtgagaagacaggtaccttgagtgtgtggcttacagcatctatcacagatcactgcctggcacacagtaggtcttcagttagtgactgaattaatgatttaccctgtgttcttgtcatcttttgggaagtgctccacttttccctaaggatctgtatgatcccattttgtcataagaatatcagcccattttctaccattcatatggaaaatggtttgttctcttttctcatttaaatttctaataatcatatttgtccctgctaattatcaccatgtgcccagcctggaatgtgtactttacatattttatcttgcttaattcttaccaccaccctaggaggtggatgttatcatcctgtttactaatggaaatattaagactactcctagacgttaaataactggccctggtcatactctcaagagacagtagcacctagttctgtctgatattccataagccttcacctacagtgctatatcgcttccttttaaattatatttatgtgggatttttgaaggaggtaattgtctttgtctattttctgctgctgtggcagaataccaaagactatgtaataaagaaaacaaagaaaagaagtttatttggcctacagctctggaggcttggaagtccgagagcatggtgctggcatctggtgaggaccttcttgtgttaacccatggtggaagggcaagcaagcatgtgagatagcgagaggaaacggggaccaaactatactttcctgaggagcccacccccacggtacctaaaccatgccctcaataatggcatttatctattcatgaaggctccaccctcatgacccaatcacctcttaaagttcccacctcttaatattgttacagtggcaattaaatttcaacctgagtttaggaggggacactcaaaccatagcaataatatattcacctgcatcaaaaataatatatataggtgtgaagtttaaaaaaaaaaactccttccctcatttgctcatttttacccctacttactttaaataaccactattactaatgttgcacatacaaccttcttgagcctcttttatgtatatacaaaatatgcatatatattcttctcccatctttttacacagatggcagcacactataaacaccattgtgtacctgctgtttagacctttcttattagtacatgagcagcttccttgtttttgttgtgttttgttttgttttgtttttgtttacagacaaatgatattccattgtatgaattgattacattttagctaaccagttcaaatgttacttaacatttgggttctatcaatcttttgctataacacagtgttacatttattgttgaccacatatgcaggtatatctgtaagataaattcccagaaatagaatggttacagcaaagggtatatatatttgtaattttgatggatgctaccaattgtcctccacagcaattgcagtacttatatttatggtacttctgaggtatagaaggtttttattttatcagttagaaattgtgtttggctgctaggaacagagacctaaccacagcagcataaacagataagggttttcttttctcacagaaatggaatctggaggcaggcagtatagagctgatatgagagctccacaaagtcataaggaacctaggctcctttatttttttggctctgtcattctgaacatataacttccaatctcgagatcacaaaatgactgctgaaactctactgtcacatccctgttccagacaagaaaatcaagaaaaatctaggggtaaaaagtgtctttcataggagtccaaaaatatcattgcccacaccttttggcaagaaatattgggaagtataattttgtgactgagcacattgcagtcctcagtaatataagggttctattaggaaggtcgaatacagcgcatggatattgagtagataagcagcaacctctaaatgtgtcccatatcttgatctttttattcatagagtcctcactccaaaatcaaatacatattacctgcatttctttttatttctttcatggcctcaattttaactctaattcattttgcatttattttagtatgtagtattttaaagcattttttcttgttttagaaagaaaagaaaggccttaaagatctgcccccattccatctttccaaaagaaagaaaaaatatttctatatttataagataaaattacaaaagtattaggcaaattaattaacaatatgcatctacatggttaatctatttggaatttatttttgtgtatggtgtgatacaggaatttcttttgtagttagctaattgactcaatatcacttactgattaatttatctagacctgattgtttgaatttattatatacaaatggtttaaaatcaaatatttggattcaatttccattaagcttattgattattaggaagaggagaaattgatacctttacaatgttgggtcatacccttcaagaatatggcatatctcaatttattcacatctggtgggttcttcagcagaatatcatcattttctttatttaggtcttacatatgtcctgtaggtctagtctcaaggctcttatagctgggttattattgtgaatactttttcttattaagttttctggggtgtttttttttatttttgtttgagagtgtctagctttggggcccaggctggagtgcagtggtgctatctcagctcactgcagcccctgcctcctgggttcacacgattctcctgcctcagcctcccgagtagctgggactacaggcacgcagcattatgcctggctaatttttgtatttttagtagagacaaggtttcaccatgttggccaggctggtcttgaactcctggctttaaaggatccacctgcctcggcctctcaaagtgctgaaattacaggcatgagccaccacactcggcccttattacattttctaaaactttattgctaatacatagaaaagctatgaagtttttacatgttgattttctccagcttgctgaactcttattaattaaggcacctataaaatgattctctcaaattttctaagaagaaactctcataaagaataaataatggttatttaacttgtgttttataatatatttatatctcacacatttttcttgctgttgttttggctacaacctccagactaatgaataatagctgtcagtgtggacatccttgtcttgtttaagattttaataagaatgcctctattttgtttttatgtcctttggcttctaacaaattcccattatcatgtttcagaacattttttatgtttctaatttatacagagattaatcagacatggaaattttatcaactatatcaagtatacttgaaacatgtatccacataatcacgttgcattttcttttaacgaattaatttaataaagtgtattatatgaatagatttcttaatataaaatcattttgaaatgactagattagattttactttgtcatgagattatgttttattattctttggattcgatttgtcaatattttatttagaattttaaaaatctatattcctaagatatatttgtctatagtttcctcttctggcagccttcttctcaggaattgttcagcccaacaaatgaactggaaccttcgtgtttttctgtgcttctttacagtttaaatggcaaagaaaacatgcctcttgatggtcaatgtaactcatttttaaaatgggctggtccagtccctttttgaaagtgtatctttggggtttcaatttcttttaagcttactgtctatttaggtttctaccatttcgttagtcatttttggtaatttacatgttccttgaacgtacttattcacctcaattatgaaatttgttgttgtaaacttgtataaagtattttcttttttttttttttttttttttttgagacggagtcccgctgtttagcccaggccggattgcagtggcgcgatctcggctcactgcaagctccgcctcccgggttcacgccattctcctgcctcagcctcccgagtagctgggactacaggcgcccgccaccgcgcccggctaattttttttgtatttttagtagagacggggtttcaccgtgttagccaggatggtctcgatctcctgacctcgtgatccacccgcctcggcctcccaaagtgctgggattacaggcgtgagccgccgcgcccggcctgcagtcctcattttaaggcctgcgtattttatgcttctccagtgttttcctttttccctttctagtcttctgctggaataaccaactttactttatttctcctgccctcacacatgaaggttagacagtttcatactgaattcagaagccacaatccattttcctctgagctctgtaaaatatatcacatgttctcttagcatttggtatttccactggaaagtctagtacctgggaagctccatttgatcctccttcctttataatgtttttcccccttgtctaaaagtttataggacttttcctttatcctataaattcagaaatttcactagatgtgatttattttcagtaatcttgtctgtcattcagtgagagttaacaatctgaacactaaaacttttctgcaaatcaaaaatatgtttgcctgttttcctccatctcctctgttctcttcttctcaaactcttattacataggtataagacactctaggtctctcaacacttcttaccctcccttcctttacttctttctctttgctctgggataattccttgaattcattttcttatttattagtttggtgtttagcaatgtccattttattgctaaattaaatctggaattttaatagtttttaattgcttggagagctctctttttcctatctcttgtttttctcatagcaaattgttcatatcatagtgatagaagcatccctcacatttcactgacattcaaaattgtaataatcttccctgcattttcagttgtttcagtgaggtctgcatttatacgcagttaacacacacacacacacacacacacacacacacctctctcaagagtttaatgcatgccagatattgttttaaatgccattattaccacttcccaagcaaggagactgggcagagcctggaagccaacccagacagtctgattcagagccaggaacactctaccaccgtgcaataccagcatttgttctttacgctcagctgggtctcctatttcaagttgctacttctacagatttgtccctaatttttctatctgcctcatttttatttacttatttatttattatttatttattgtatatttatttttatatatatttatttatttatattatatatatttatttatttatttattatttattttagagacagagtcttgctctgttactgaggctggagtgcagtggctcactgcagcccaactcctgggctcaagccaccctcctgcctcagccttccaagttgctgggactacaggtgtgtgccaccatgcccagttaatgttttaaattttatttttgtagagacgggggtcttactatgttgcccaggctgttctggaactcttggcctcaagtgatcctcctgccccagtctttcaaagtggtgggattacatgtgtgagccaccgtgtctggcctctcacttttacaaataaagataatgtatccatattgataaccactgtggcctgcacccagcccctcctcaagcaagctgatagcagggcatccacaaatgtgcttgtgtgaggggtggcacagacctggggttcaagccatgccagcttctaagggtacacaaagttatagttccataacctcagagggtgcaggactctgatgtgtttcaaagccccagaatctggtgtctgtccgattttactgctccagcctctgatggccaatgagcagaaatgtgactgccagtgtaaagcagcaagacagcctaagcaaagcaggctcccttgggccacagacgtggcttggcaatggtgagtgccaagggcctctgagcaggacacagggtccgctacacagctcagcgtctcaaaaactcccaacatcccagaacaagacagagttaatcagctacataaattgagttaattagctacataaatcatgaaatataagttgttcttatctaaaattataaagaattaccaacttttaaagataaacattaaataagatgaccttttgtagacatccctactgctgacactgccaaaccactcgcgcccctctcagcacttcacctgtgctcacctggacgccatctgtttcctgtcttccagaaattcttccaacctggcctgtcaaactcagccttctgggttttccagctctgttgcatattttatcctaaatgaacatcccttcagttatttcagcagaattttgatagggaaggaaagagagcacgtgagctcaaatcaccttaaaaatgagtcttgtatttctggcagattttatgctgcatatttttaaattaattatcataattttttatcagaagaaagtgtgagaaggatttttcttggtgaagtcacttcaaccctaaaagtttgggtgaattcacggctactgtaaaggtaagccacaagcccacttacgacagctcttcacagtaagataatgtatgtctaaagatcctccattcgttggactcaaagatatttatttttgttaaatatcatatttccttgcagaccagagagcagcatatctagagagtaagctaagcttaaatgagcttcagagtggcccctttatatatttatttttaagggcatttaaaaagattaatgtatccatgacataagaatacaattataatcgtataaccttcattaattaaaagagctgacgtttaagcagagaagttagtaaacagggtattgtatgcagtggggacagccaagttcaaagtcaaaaaaggagctgtttacattagagaaatagcaaagagtccgaggtagcaagaggagaaggaagcagagagcgatacagaacagtgccagacagagacgtggagtccagatcctgttgggtcttgtaaaccatggcagtaagcttgcatttcctttgaagagggaagtgagaagatctgggatttgggagagtagtttggtaactccattgaggtggtgttggtgagtgtcaggtgctatggtggagttgcctgggcagagagagctatgcatcctcgagcatcatctggggaactaggaatggacttatcatgaatggatccagattcaacactaccgtctgaagcagcactagctcaggttgactggactgtgcacttcaggctgcaggaggggctcagggggttgccatgggtctctttccaggactagcccctccctggagcttgctcattacatggcaatggcaagagcggtttatatactttgacaggatattatttggttcagagtcatcagggttatcctcttcgtgaatgtccttccttatcaatataaaatcatatcatgtaatggtttttgcctttgagtctacttcttccaggataaacactgccacctttactgtcttattattacatcagcctgatacacctttgctcattccttcattttttgccttcctatgtcagttatttttaagctaattttttaaaataacatacaattggattttgcattttgatttaagctaaaagtatttttattttagtaaagcactttaagatattttctatgtattatcaaaacaaatacatttgctcttataacttctagactagctcctttttccgccctttattttatgcattatatttttattgctcttttccttcctcttacgctttgaaaacttaatccatctttttattcttctcatggttgtcataaaatataaacatattttaacccattttctctaattataaaatgtcaactatcaaacaatatttattatatcaatcctgagtaagatactaaattttagcacactgttacttcctctgtacttgactacttttcaattttaattgatagaggtggggtttttatgctttgctttcagccaccctcctccacagtctacattttatgactcagcttaaaaggaatggttctcaccacatagaaatggggtgattttggccccaggggacacttggcaatgttgggagacagtcatgattgtcactggtgggaaggtgggtgtttgctactggcatctagtgggaaaagaccaggaatgctgttcaacattctacaatgcacaggacagagtccacaacaaagaattgtccagcccaaaatgccaatagtgttgaggcaggaaaattccattttagaggttttgtggctcttatgataattgtaagttaatattactcattgtatttaaattatttttaccaccagtactttcatatcctcactcttaaatttttaaattcctgtttatccctcgacgggctagaaaatatttttaagtaatttttttttcaagtagactctatagaaaggaggaattatacttccctaagctgccagtatttgagcaaatctttctaacactctcagacacactcactggaagcagatgaagctattagtcagtcattccccagcctctgagaaggaatatttttcttgtagatgttttccctcatatatttgcacatgttacacttccatttgttaatcgcctgtccttatcttacccgtttacctattcctatagtctatgatgcaatacttttatgcattttagctcttgcataatgtatgtgttacaaatatttaacctataatatttaagatatcactgatacttaatatttctaatttttaatgtacagaaagtttaaaagtttatttttttaaaatttacctcactgtctcttccttcacttttttgctagaaaggtcttgtctattctgagatcaacattttcctaagtgcctcatctatttgttttcacatgcgatcattttaagccatgaggatttattttggtgtttgaaaataccctcaaattgttaagcaattctcataatttggtttattaaataattcatcctttcctctctaatatgaaatgctacttttatggtgtaccaaacacaagggcctgtttctgcagtttatgtcttgtttcatcaaatctatcttttcttaccctaaattttatttcaattattttggctgtataatgtttttatatttgccagttttccttcattacaattacttttaacaaccatatttttaattttccttgcccatttattctttcagaagaattctggagcaatttaatccagtttcaaaaaaatagcccttgggacttttggttagaattgtattacatttccaaataccggaagaattattgcaatactagatatcctcagcccatcttccatttctcttttcttctacaatttttatttctttattgtttcctctgagttctggaaatttttcttaagtttaccttttccttcgctaatccaatttttcacataatctgccattcttctggtgcaggggttttgaatgtagtaatcctatttctgttctttatgtgatccttactgatatcaaatcatttcattttggggactctcaggtctattttcataactttgggaagtagaaaaacactctttcccctatcccttgctatatgtctattttggtgaaaagcattgactaactctttggaatgaacaaagctagtcttcttagagtctagggatgtctctgtttttcctcgcagagacaggtctgtatttagcccccttgctcacagttgagagattgctgtccacatacttcaggcccagaaaaggaaggagtgaaatgctgagatttgctctggttttatttcacctgttcagagacccaggggacagtgtcagagttcaagggatggtcacaacatccagcctgactcccaccccttctgctgaggcagccatgagttagccccagcagtctccacagttcactggctacacctgccctcattagaagtccacagccctgtcctcccaacagagccatctgtgtctattgaacccagtgtgtgcactgctgtgggcgcctgttacccagtggcattgatggaattaaaatgcatctccccaaggcctggccggctgagtgacagggcatagatgggttccccagaggtccttgcccattccccagaggtccttgcccagcctatctgcatgaaatatggaagaaatgctagctaacttaaattatgcatgttgtctgatttacagcccaagtataggtttcagtttttgcatcccttttagttccttctgcagtttaggaggatgacattgacatctgtgtccaactcgctgtctctctggatatttaagaagtagaaaggtggtcaagggaaagttgaactttatttatgtctcagtttttatagtgagaatatttttatttttctcatttctcattttcatattttttagttaataaaaatagaaaggttttaaacaataaagtccaagataattcctaaaacactgaatttttcctaatgtgagttgagactttaccaaaattaccctcaaaaggagcaagttgccttcaggcgaagtcctcacaaagcctcttataatagtgtgtaatagtaagtgctctcaaaattatattactcataaaataaatttgtatttaggagaggcataatttcccttaaccttaatcaatgctaattgagctcttagggaaatgacccaatgaaataagtataaaaaggatgaaaagaaacttaatgaagatgtagtcactattgcttgggaaggggcctgcacttcaagagtggggtgtcgttgttaaaaagccttctaaaatcaatttagaaagcaagacactaggattgcagaccatcatctacaggataagcaaagagagcaaatgtatttgacgttagaaatttgggaatgtgaacttaggtcttaggataaaatttccagcactggctggatgtggatgccaagagttctgtatctcatcattttggtggaggagacattgctagcagctctgctctgacaactctgtgtgagactcaaaaagcagctggaggaggaggagggctctgatatcaaaggccccttggaggagttaggataaaatagtgtcaagaactgtgagagtaaaaaagcagtggtttgaaatcaatattccatatacataattttaaatgtgtgtgagtaaacaaataaattaatttccataaggagacatttgactgattcatctacagtccaaagagctttgatatttaagttgcctataaaacattttttggatagtcttcttggagaaaatgggatatcaccttatattagagattggagatcaccttttatttggatttttatttatataaaaatacatatattatgaccaggcacggtggctcacgcctgtaatcccaacactttgggagtccaaggcaggcagatcatgaggccaggagttcgagaccagcctggccaacatggtgaaacccagtgtctactaaaaattcaaaaattaaccaggcgtggtggtgcacacctgtaatcccagcttctcaggaggctgaggcgggagaattgcttgaactggggaggcagaggttgaagtgagctgagatcatgccattgcacttcagcctggtgacagagcaagactccatctcaaatatatatatatattattatatttttttctcctcttcaatttacatacttggtacagcagccttgaccttcacaccaagtcaaagtgtgtgaacccagaaataccaatgtttaggatgtaggcaagtaaaaaaatcacacgttttgtctaacatctctccataggctgtccctgcttaacccagaacttcaggcaaccccaggccttgagaaaacaagaatattcttattgggttacagtaggagttttgtgctcaagtcaaaacaggtgatactaaatttttcttaatcttcgaattccatgaccctatatccactcaacaactccctccaccaacccatgtcagtttctatcaattattctttgtcatttgccctgagcatgtttaaatttaccaatttaaacatgctggtaaatggtctgaaccatttgaaaacaatctgaaaaacaattttttcagattgttttgttgctgttgtttactattgcttcttatgtcccattccttgcctccaggcctcatttttcttcttactgaagcacaccccttggtagctctttcagtaagggtctgtaccgaaaacacttttggagccctttatgtccgaaaatgttcttcacatcatgttcactcttgattaatgtattagttggtaataaaattctaagttcacttcctttacctcaagaaacagtggagctattctctttatcttcatgggtagacagccctgtttcaactcctgaattcacacagagaaccaggatccaggccgtgctgtgaatgagatttgtttgaccccagtcatcagaaaagctttgaggaacgcactgtgatgttgttattcagtactggttacgaatagcatggaaagcttcagatctcacccttttcccaatatgttgttggtgttgttattcttgtctcctgtttctggttgaagaagagctcccttccttgtttttgaacatggagatatatttaatattacccttttgtatttgatctatgtttggaatgagaagaaggctcaatgtgagctcactctgacatcttgaaccagagaacttgaaaaaatttaataaatctataatccatttttctcctaaacttttttctataaattctcatcttttctcatttgaatttccccacatctctaatgtcaagttgctttttcctatattgttcaatctcttgccaggcaaagggatgggtatagctcagtgatttaaaaatatatacatatataatatatatatttatattattataatataaccatacatatctatttcatatattatagataattatatataatatatattagtataaccatatatgtctattacatgtatattatatattactatattataaccatatatatctattacatataatatataatataaacatacaatatatgatatataattatatattaatataatatataatatatgtaatatatatgtatggttatatatttttaatatataatataatatatattatattaaatataatatatattatatataatatatattatatttaatataatatatattatatataatataatatatattatattatatataatatgatataatatatattatataatatattaaaaatatatactttttttttgagatggagtctcactctgtcacccaagctggagtgcagtagtgccatctcagctcactgcaacctctgcctcccgagttcaagagattctcttgcctcagcttcctgaatagctgggactacaggcacgtgccaccccacccatctaatttttgtatttttagttgaggggagttttcgccatgttgtccaggttggtcttgaactcctgacctcaggtgatccaccccccaccccgccctcccaaagtgctgggattacaggtgtgaacgaccgtgcctggcctatatatatatttttaagtgagacctctcaatttatgactatatgtattggaggtctctttccagaaccatatatatatacataatatataaatatatattataaccatatatagctattacatagctatatatggttctggaatgagacctctcaattcatgattatccaactgggagtcttttgggaaagttacttcacctctgtaagcctcaggtttttcatctacaaaatggagataataagcataacaatttcttaaggtggttttggagaattaatgatacttggtaaggaaagtgcttagcacaaagtgagcactaaataaacattagttattttattatgacctattgtaagtttttgtgtttttattcacattatgcaggatcctaatgtctagatatatttctgccacataatagccattcaataaatacttatgaaggaattaatagcagtaacagctcaaaagcctaaaagagagaaagtaacagtatattttgagttggggagatggaatttcagcataacattctttaatcagcttttcaatccatgatttcttatctttttaagagccaattactggttaatagatagaattttctgaaacggagcacaggaagctattgtagggacactggactggcaatctgggtagaagattcttttcctcactttttcttgtttacctattttctctacttagaaacttttctgtgttgtgtaatttccataaggcaacttacacatttttttaaaatctgtgagcctgatgggataattgattttgaagtcactccttctgagttttaattgcagctcaattcttaattgtgtgaccatgtacaattgagcttatgattcagtctccccatatgtaaaatgcagataataatagatagcaaaagtttttgcttattgttttcaaaaagaagccatagtagggagagaatttttcagtacccagaagctgcgacaagaatatagttaaaagcaattccacctggcctcctattgtgttttattttgttttgtttctgactgaatcatctgctacggttaagcccacctcagcaggctgcagctcctcccagctctctctcctttcaatctcatttcacaagcctagtaatgcttccattgcctcctcctgttaccatttttttgtttcctacaggttgagattcagtacgttctaagagggagttcagtttctgctccattgaaaaataattatgacaaagcagcattttccaaaatatgtttactaataaatgttaggcaagaaaatgtttctatggcccaggaatttagggaaacactcgtataaataatattaaacagatgtctttatcttaagactatttgacattttaaatatcagaagattctgtcgcttttctgaaaaaggggacaggataagtcacttgcaaaatgaaaatgtttttttttgaggcatctggagaactacttttatgaaaggcacatgttgggaaatgttctgatggagctaaatccaaagaggatagtaagacaagagggatgattggagggaagaagggaaggaatcgtgtgtaatctggtgacaagagcagcaccatcaaaaccccaggcttggctgcaaatctcggctctctgccacttcccagccatgtgattgaaactggtcactttaattcttttacaagctgttttctcatctttaaaatgggtataatactacatctctcaaaaggtcattatgagaatttaattagaaaaatcaagcacatagcctaataagtatgctttcaagacaataaaaaacataaacacagaaaaatgtcttattttccttatgtattttttgcattcctagcatttgcaatggcatcaatcatagtaggcactcattaaacttttgctgaataaataaatgaacaaaaaagctttatcaattcactgaataggtaattaatcaaacctttgcaggtttagcactatgccatatacacaaaaactaaacaaaatattatcattgtaattaagttgaacaggatgcattttgctactgttaggcattcgcattgtgagtgctacagtcttttcttagcctgacatttttctgcaaatgtgttacttccaaaatgagggcagaatttgcatgaataacgttttggtactaaacactgtatttattaggatgaaccatttttatagggctttctaaaacacaattatatggacataaagatggacaatacaatcttatctccctttagccaaagagtattgacaatgcaatttgtgcaaagtttatgtgaattcctgtagttcctcagtcgtttcttggtttgtagataaattatcatgttgagtagattctttgttttcaacttggcattttgatttgttttcttacttgtttacttgacaccaaacaattaaattatgcccccccaaaaaaacgcataaaaataagcccttcggtgactgaacctgcatacagactgatgcagaaaaggctgaagcttcccaaagaggattgtttgaattctcaaacagaagatggtcccaggcaggcaataactgcttctgtctagtgggcattagatttataaagtgaaactgcttttctccaagtttaaaagtataacatgtaaaagtttgaccaggcctcattgcacaagtggagtgctaatgagaaatgggaggactcactgaagggaggacactgttcgcataggaacagtgactcagtgcctcgcagtacccttccctgatttctcattattgctccatctatgcaagactgggttaaaccactgggttcactaacagaagcatttccagtgactccagaatctttttaacgtcctatgtaaagagttcagagcaatacatgatgaactgcacacaaactctttcggccttggtaactttcctgaggaaatagatgtcagacctaatcacaactcttttgccattaagtcttaggggaaagtttctcttgaaactatattggtatttagaaaaagctttgaatctaaatgtcatgcatctctcatttagatagataatttgtgagggaaaatagtctggatgctattggctcattcattcgttctactaaaggtggaatgatatgttaatgtcttatcagccaagtcaacctagaaataagaatgtcaaccatgttaaattgtaagattattcaatcttatagattataattccctatagcatgcagagttatttcacaggctttatcttcttaatttgacaaattttttagagaccctacttgccaagcactgagaatatgaagttgaataaggaatagtctctaatctcaatcaattttcagactaatggaaaagtctatcatagaaacagttgttatgagctctaaaatcatagatgaagaataattaattctcattgctgaccagaggtaaatagaaagaagagtcaaatttgagctgagagccctagagggatgaaagagagtttgtcaaagcccattctgaagtgaataacacggtcataagaatgagccatggggaatatgacaaacagcctggtgtggccaaagggtggtggtggcagtggcagaagagaagcagcctgagagatggctagggccagaacaagagccataggatctctcctagtacaggtgggcttcaactatccgcgtttttacatgttgctttggcaaacttgagagaattgatgaatgccttctatcccttcaccaagattgtattgaatcctcttccatatacctaccagcagtgttctaggctctggggatacaacatactccctgatttcatagagtttacattctctatgaaacagataattaatttaaaaagcaataaataaaaatctatatatcaagaaataaatactctgcagagtattaaagcatggaatattagtcttttctcactttgctataaaaaaacacctcagactgggtaaattataaagaaacgaggtttaattggctcatggttctgcaggctgtacaggaagcatagtggcttctgcttctggggagatttctggaagcttccaatcatggcagaaggtaaaaggagagcaggcatcttccatggcaggagcaggagcaaaagaaagagtgaggggaaggtgctacacacttttaaacaaccagatctcacaagaactcattcacggggagcaggcatcttccatggcaggagcaggagcaaaagaaagagtgaggggaaggtgctacacacttttaaacaacgagatctcacaagaactcattcactgtcatgataatggcaccaaggagatggtgctaaactgtccatgggaaacccactcccctgacccaaccacctcccaccaggccccacctccaacactggggattacaattccacatgagattttggtggcgaaacagatccaaatcatattacatgataatgtgatagaagataaataggtagtacaattagaaaagatggtcagaaaaggcctctccaaagagcctacatttgggctaagacttgaatccccccaaaaaagaactaaacatgcaaagatctgagggaagagcattccaggcggaagtgcaaaggtcccgaggacagaacaaattctctgtgttttaggactagaaataaagctgggtggctgtagtgaagggagttctgtacatgtatcaagtagctattgttgcataataagccatcccacaatttaatggcttaaaacaacaatggtttatttagctaagtattcttgcatgtcattaatttaaaccgagttcagctaggtgggtgtctcatacatctatggacagctgtgggtcatggaggcaactttgctgatcttagccaggacctctagcatttctggggttttcgtgggagcatttgaactgactcaactctgccccatgtggtctcccatcttccaggaggctagcccggcttggtgactatgtaggatcccaaggagagcagaggctcccaggcttcttgaggcctaacctgagaactcacacaccaccacttctgccaaactctatcacagagtaaatatcaaaggaaatcaaaggccagcccagatttaaagggaggggaaacagactctgactcttgatggaagaatctgaaaagtcacatggcagagggagtgaatgaagtagacggagcagtggagtattgtggccattttcgcacagtccaccataaaattgaaaagattgaccagagacagatcatggagggcttggcaatctgtactgatgaagccatggaccagaagagaagtgagtcaatgaagagagtttctcttttcacatggccataaaataatagtgagggctatgacagcaaagaggaaacaaaagctgtagtgatgagtgttagacaattgatgagctgggagagaatttgttgatccaaatgcaatcttctcatccttactgtgttccagaaagttaataggaaagctgaagttcaaaaacagtctccaaaatttatttaaaaagcaatgaataaaaatatatatgtcaagaaataataaatactctgcagagtactaaaccatagtgtattagtatgttctcacattgctataaggaaatacctgagactgggtaaattataaagaaaagagatgctgggcatggcggctcatgcctgtaatcccagcactttgggaggccaaagtgggcagatcacttgaggttaggagttcaagaccagcctggccaacatggtgaaaccccgtctctactaaaaatacaaaaattagccaggcctggtggcaggtgcctgtaatccctgctactcgggaggatgaggcaggagcatcacttgaacttggaaggaggaggttgcagtgagccaatatcatgccactatactccagcctgggtgacagagcgagactccatcaaaaggagagaagaagaagaagaagaggaagaggaagaagaagaaggggaaggggaaggggaagagaaagaggaggaagaggaagaagaagaagaaagggaaggggaaggggaagggggaggaggagagaggtttaataggctcatagttttgcaggctgtacaggaagcatagtggtttctgcttccggggaggcctctggaagcttccaatcatggcggaaggcaaagggggagcaggcatcttccaaatcaggagcaggagcaagagaaagagcaaggggggaggtgctaaaacacacttttaaacaaccatatcacatgagaactcactcgctatcatgacaatggcaccaaggagtgccatttccatacacgagtcattccaaccaccacactgtccccctgataagacttgctgagacatttgctgatacctaattggcttagaaatgcaaaagtacacctctaaagatgaaatttgaccctttcccccaggctctgtctggaggttgggttgctatcacgaggttaaaaaacattgatgataataaacaatcatgataatattttcttatgtggaaattttattacctgatatttgcaacatttaaaagagctaatgaaaataataatatattaatagccaacactggttgagaacttgccttgttcctcttatcttgacctctgagatgccaaaaataaatgttgccaatccatgcatgtgcagttattcaagctatattttcttgaattgaaatataagtcttaaaaccagtctgttccctcacagcagattgatttccttgagattagagagtaggtttcatttatctttatgtatctagtaggtcatatagcatcctgcaccaagtaggccatcaaaaaatattcatggaggcagtggctgacacctgtaatcccagcactttgggaggccgaggcaggtggatcacgaggtcgggagttcaagaccagtctggccaagatggtgaaaccccgtctctactaaaaatacaaaaatttttatttttgtattacgggcgtggtggcacacacctgtaattccagctactctggatgctgaggcagagaattgcttaaacctggaggggcagaggttgtcgtgagccaagatcgcaccactgcactccagcctgggctacagagcaagactccgtctcaaaaaaaaaaaaaaaaatcatggaaaaagtgaataaatggtcttcctcagggatagaaagggtaaaaaatgttttttaattagaaagatcaacaactagagtagtttgagcccattaaacatagagcaaacctccttggacaccctccattttcatgtctgtgtataaattgaacaagataatgaaaccttctgcttataagaaaaaatgttagtttctattctgcattgtagtagattttaaaaagatttccattgaaaacatctactttttaacatttggtgctaaatttgtaagttcctgtttccgaaaaaaattcacttaagttgactaatttatttcctgataaatattacatgaatatctcatatgaatatatttctttaaaaatttaggcacctataacctgattcttatcccaatagaagcaattaaggggcaggtggtggtatcacctttaactgaagtagtaagctgttggtcttccaaggtgacccagcaagcagatgactgaatccaaaagtgggtgatttatcatgtcattctgggagaacatgaagaagttctcagcttttagaatgtaccttaggccaattacgtgcacgttgacaaagatggatgtgtcttcattatgtagtttattatggatagatcagggctgggacaagaacctacatcttgtgatcctagtacagtacatttttaggaagcacaacccccatagatgaccctacaaggagcctatactggagtgaaataggaggctgtgagttttacaagacatcaaacaatggctgcaaacttgattttataggtttagtaatatctccagggaataattctctttccctttccctacttctgtaattggtatatactctaaatgccattagacccagcttgctctaaagatctgtagggatagtatttctctctctccctcattcagtatgtgcccatgtcaggcctaactgaacacagggaccaaataaatagaagatattccattcagattttatagcctgactgctttactctgcaacctctattattgagaattatctattttgactgcaaacacgtcatttcatcaaaggttctttacaaagcagatgacattgaaaagcagcctcacatttttcaggtttagagactagatttttatggacttggaaacttggaagtcagctcaccattctggcatagtcttcctgccaagcccaaattctgaaatcagtgtgggagcaatcagtgggtgacatccatctcagagtcaaagaaacaggggacttctgattccttgtaatttctctagaagtaaatcctcttttccttgactggcactcttctcttttgagggccaataacaacctactcattaagaaccatttaacattttccaaaaatacttccaaaaccattaactcatttgatccatgtatcaattctatgaagtcagtaggccaaatattaatatttgtagtgaacaagaaagccaagcacgaagtgttcaaaaaactaacccgacaacaaactgaaaccctggatattatcaggataacaaaaaaatcacctgacctgacccccagttaggaaatttcccactgtcctatgcactgttctgcacacagtaggaaatttcccaattaggggccaggtcagatgattttttttgttattctgataacattcttctcttctagactatgagaagagaggtgctgtagtggtggagaagcgagtgtgtgtgtccccaagaatattttaggtatggccaccaagttagccctaaagaaactacaattaaactaggaaatagagcagataaactctgtgtctagaattctaaacttcttagatttatatgtcctaaacccaagtctttcccgtctcttttcaggctgttcccacaagtactgacattacttccaaagaggagaatttgggtcactaatctagcgaaagcatcttcccctctgaattcaccatcaagatgaatgctatccactagaaatataaaggaagccacataggtgatcttaaattttctagtgggcacattttaaaaaggaagacaaggcaattaaaatataattttaataatatatttcacttaacccaacatatccaaaatattaccatttcaacacatgatcaatattctaaactacattagtgagatagttacactcttattttcattcttagtcttcaaaatccagtgtgtattgtccactcacagcacacctcaactcagaccagccacgtttccagggcctcaaagtccacacctggccaggagctgacggtctagctcctgtgagtaagctagtcctcagattttataaaactctctcttcagggttgtgctcaccttccccctcccactcctgctgctcctgacctccatcaccagaagagacccccaagagcaaatcatatttttgtttccaagagggcccactgacaacactaaaacccaggaggaagcagttgacttaagaccttcgagtgactcactttgtaggaaaagcagagaaaggctggcaaacaagaaaaacataagctcatttttctccccctcatcaacctcattccccaacctgtttgcatcctgaagagggcagaggcctccaaagttgctttagagggcagaggcctccaaagttgctttctgggtcactgcggggtgattcacccaacaataggctataatttacaaggtttttctctgcaagtcaactcttgctaatggaaggacgacatgaatgttgaggctgacaggctggaagataagagtagttgtttgttccctcagcccattgaaaaatccagccccaaacccatttgaagaacagttcctaatagataatgagacacaaatcgtgtgtacctgattgtaaatgaatagctcatatgcacaaagcaaactgtaaaacctccatttctcagccaggatagcactccattaatgatgtgcttttgtttcttccaaagactaagtgctcctttccaggagaaaatagacctcaacctcacctccccacccaccatgtccctacccccaccccaaagagactgcattaccctgagtattaatatacattgcctaacaaataggcaggcaaccaaaaactgagcaattttagccatttaaaccctgtcttgaaatagcaactcactggataaatggacctaccatttagcaattttcaagatttccaacctgctttgatttcctctctaggtagttttttattttgtgtttcagcgggcatcaactttgcaatatcaggaaaaaccagagccaggcttgaaaataatgctgagacatctagactcaaacccgggacacaagtgggaatgaatcaagccgggaggatttttccaaatctacaggaagtgaaattcttctgctccaggcaatgtttatcacccatgtagaaacctcattggtttggcaattgtgagctaacagggtatggcctgagttatgctctgaatagcttacagttactgccttggatgtgaacgatttgggagggacaagtctgtgcagtggcctaaagtgaggcgtgagtttgtgcctagcttgtctgtgaaattgggtttgttttttctgcttttactacacattaagccagatgaacacaaggacaccagttgttacttttgaatgatttttaaaattacatctctagtagggaatattgatttactttattgattttttaagatcctttctatttctttagtgtctgctagtcagtggcctcaaaaattgaattttcacgtgttgtctttgccacttaacattatcagaagcttcttgaatgtttactaatagaagtgtgactcctttcatgcttgctgtgtctaatgttatttttgtgttagcaaaattgctcttcaggaatatgctgatggctaacttgcagaaatagagatttaggatagacataatgaaggacttccctacaacactggatattaaatgctgaaaaaggcttttcaattccttcctgaaataagccagggccataagcacttagcccactctatcgaagtctccccgagaaaaccctgcggctttctctgcggattcctccagcccaacaccgaggaaccagggcctgggacttctggagtccctcccaggactaattcccgctctgatgcccagcacaaatttatcataactgcctgactctctcagtgtggtgtggtggtggtgatggtgtgtgtcttcctgagtgtgttggttggggatgtggtgggaggggttggccagagagttgaataaagaggaggaaaaaaaaaaaggaattagatttttcagaactgcacaaccaaagatttgcacacttatttatagaggtgacccgtgagcttggttgaccctggatgcttttctgcgctataagggaacccgtgggtggccgatcactctctggccctccagagggggcctccctcctgcgcggaaagcgtcccggtgcacagcgcccagctcccgggtctctgtcggacctgcgactcccggcgcctttctggtgccctccacgccctccacgggcaggggcggagctgaggggcccacacagctccctctgccccaaacggggcagagaatgagtaggtgcctgcagccaggggcgcgcccatcctttcgcacacaacaggctcctgttctctaggcagtgattaagtgagaaaaagagaagcctggcttgggggtgagtctggcgctgggtgaatgtgaatcgccgacacggtctcctgcagggctgcggcgtcctggcccgtggctgtcattctgtcccggtgcttcacccccggccggtgtgaagccagtgtgaatccatggcccgcgcggacacacccgccaagcaggcacaggagcaaggggctctagctgcgtccactccccagggttaaaaattaactgtccggccttgctggcatctctgttgacaacgcgatcattcctgctgggagcgagtgcgccacagagattaactctgcctctccagtcaggccgcctgggttccactcctaagccttaccctctttaaggctcgttcttcataggtcagatggatctcagtcgtcctgaccgcatagggttgctcaggcatagaaggcactgggcacctggtgtgggcaagttgtgcctgctcagtaaatattaactaccgactcacaggacatgcctctctttttgctaccctcgcacgtttcttttctcgtttccttctccattgtcactgacccagggttggctgatataagtgaaaaacaccaagggtgccgtctgttatctaagtcatgcaaatgctttaaaattatatgtctgtgtatgtatgaatatatgtatcaggctctgggcacatagaggtgaaatatcatgtaagcaagcacttgtataattttcttcagataacaagcttgaaaacacagcctctacttgtttccttcccttccctgtctccctttctctaccagagctttctggaccatctccaaataaactacttgctctcaaatcccagtgtcagagtctgattctaagtgaatctagagtgctggcaacccagaatccttttccaggattcaggatggaatcttacaggagatacacagtcctataaaaagttagaataataacgcagcatcaatttgtgcttgatcattaagctaataatgcctcctttctccaccagccccatgtttctgatactgtgatgtgtgatgttgtagttgtgaaatgtaatattgtgatgtggcagacagattataagagttgaatgcaccaggagatttcctgtggcattataagagttgaatgcaccaggagatttcccgtgacataagtaattctcaggccctatgaagtgcaggctttaaaaaaatctggttcagcagccaaaagtcatcaaaaattaatgctagtattttctctctcagagaatgctaatgggaacatgttctaaagtccacttttctttccttccttgttttctcagctttttgagagtgccacattctctctttttgccctgacatctcccagcttcccaaacattctgactcagtcttttcttctctcccaacagatgctcctgctagctcttagttaggtaaatcaacttagcctctctatatgcattaattctctctcagttcccaaactctccctaataaagaagaacttgagagttgactcagctgtcccccagtataaagtggtgggcatgagggagagaaatgtgaattactgatacataattttccccctattaaactttattccttggaacatctttgtgaattctgcaaattcacaaagatattcatagtcctatattcatttgaattatccaaagctccttccagacccagttgacccatcttttctttccttttctcactggagtgggcataatttcctgccatttcccactgtgctgccgccaattctggctgtgtccattagtgtccctcttgacaaacttggatttgaaaaatgggcaactaaatcttcatttattagacgtgtttttcttttactaacagctgccatctgttcctctccacctcaatacaactcccccaatccctccagcatcctttttggacattttcattccagttcctctttattcatgtgcacattcaattgccagacagtttttgaaagagtagaaataagaagtaacagaaaatagaaataataataaaatactacccccaaaataaaagagacatgggaagagtttcttttttcaaaagggaacacataaacaacacatgaaaggttggaaaataacaaagaaaataattttttaaaaaaagatgtagacgcaggaaggacaattatggaatggctggaaagattaataataaccaaatagcttgagggttgcctgcagcagagatgaagagaataaatcagaatagaaaaaaggtttgcctgattctattttacagacagtctcttaaaatgtatgtgtcattcaaatttgttttgatgtgtcagtcatctccagcattcatcctgggctttggatgctacttagttgcacgactggatgtgttctaagatctgccatgcaggttatattctgatttacttgcttacagtgagctcctatttggaacatagttctgaatgccaaagaaaaccaaagacagaacacttccagctcaatttccatctataaagtggtcaaagaaaactccagtccttgaacttgtgttctagtcttttatgcactgtttagaggttctgcaggggctttatgcctgccctctgtgagagatgaagcatgttaccggctcctgatgaatggacatttaagatccaaaatgtattgaagtcgagttgtcatcacgtttttcatttgcccaagtcctatatccaaaaaaaaatgatgtttttcatcatttcatatagatgaaaaacaacattaccagcccctgtttcaaaggcaaaatgcattctgcattgtatatgagttgggtaatgtcaagtgtctgtgattgcagcgtgggagttgttttggtctgttttattttgacttaagtcaggaaacaataagtatgtttgtcattttccaaacaatatggtccaaaaccacttgtggctggtgttctttcatctccacggggcattccacccaacaatcaccatctgccagggacgcctatgaatgtcaaagttctgctaggtttctctgaagcctgcttctgctttcagcagctttgaataagctacagggccacaatttacttctattgtcatttcttcagggagatagagagaaatacatctgccactttagacaagaagcccatgggaagagtacacacacaatcagaacagccagagcaggattattcaattcagctgcaatcagaaatgggggaataagacagagaagaaaagccccatcttgttatgtgtaatgctcatttctgagccagtgtttgaagacagatcatgctttgtgagaaaaacatattttttcatcagataggatgtaatcaaccaagaattaatcattagtgagccattaaataattaattgtaaattgtaactaatttctgattattaaaatgactttttttttatacctgggctcctataattccccattttaaatagttaccaagctacgccccgataagataaagacaaaaaagttgcaataagttagctttggctatgtaacaaaccattaagacataatagattaccacaaaaagtatttattagttcactataatctgggtcaggcatttaggatgagttccgctaggcggatcttctgcttgtcttgcctggggttcctcacgcagaggcaatcagctgatggtgtcagtaggagccgattggtcttgaacggcctcactcacatttctggttttaatgctggctgctgtctgggaggtgcaagggattgggccctgtatatctccaacagagtagcccaagattgttcacatgctggtggtcaacagtgttccaagatgcagcaagacagaacaagccccagtgcagaaacatttttcaagcatctgcttatagcatgtttactatattccactggcaaaagcaagtcacttggccaggtctagggccagtatgggcaggaaatcacaagggggtgaacactgggaggggggtataaatcaaggacgttactgcaacaacctaccacagacgtatccttgaaaatgcttttatccgtatcaccagaccaaaactctagggactttgaatcatgtaagcatgtgccaaaatggatctcagctatcttcaaatccttctttggacaacttaaattcagaaaggtgacttttttgggcccaaagtcacatgactaactcaatactacattaattatgaaggtattggcaagcatctggaatcactgatatagtagtttcacttaatttttaggataggaaaatttatttataaggggaaaatctatcaggactaaagagtctagaaaatattttcagaaagaaaagacagagctcaggtgggcaggtaaacaagcagatgtaatgagggaaaaccaactgaagctcaaggtgttatgtttttcttatattattttcagattcataaggcagtacttctcaaacttcaatgtgcacatgaactgcctttccagggagaactgtcctactgcaaaaggtgtatgcccaggagacacttagctctcatccatgttgttcccagaaatcatatagaactcataggacatactctgaaacctgaattcctcctcctacagtgcaccttagggagactcgttcccttggtcgcaagacacatcctcctggaatcagtgtcttcttttcataactgcagttatccactgcagcagagaagagctgaattctcatgtctcccctccctagccagcccacttgatctaaaagtgttctgtacccaggtcaagttcctcaggcagcaccaatgtgaaagtgaggaagtgagacaggaaagggaagaaacaccataaagtgtgtgttttcaaggaaattaccagtgtgggcaactgggactcaggcttgctgagcacctctgggaaactgtggagaacatgactcagtcatccacccaatgggaagaaagttgggtgtttatccacaaactccctgtcagagaccgctggagggtgctcggggaggattagttctccagcacatcactcttccttaggcacacagctagtgagtcagagaaaagccttcaggcagagacagtattttggggtttctaaaagcagcttcaagcttgtacaggagaatgcagaaggaatatgggaaaggctagagtccttctgccttaaccatcgccggagtactaactagaaagtcaggactagcttaaatgtataatggttgtgactaaaaccaaggcaagcacatgaaaagcaacacattagtaaaacaagcaaaatgttaggcatcaaacagccctgtcggttatttctgccttttcccccttctgttgactggttgggttatgttgttgttgttatgccaaccaataatgtctcagctgccttaaataaagtatttgttttcaacattattcacccaagttactcaacaggaaagcaaagattttttccttgctttccattaggaagcaatattagttagatctggatttcattctgtccctgtcgtctctcaaaactgtgaccttggccaagttatcctccctcaacttcagtttccttatctgttaaaagacaatagcaattctgaccacataggattgcagtgacagaagtatgtaagcagcccatccatgaaaggcacacaaatgttgtcctccttcttccccactctccaatactctcctcactgctgaggattaaattcaattctacttaatcaatttatgttgaagttttactgtgtgtagactctgtcttggattacatagcaagtatagagctaataatcctttctttctaatagctttccattttggggaaagacaggcatataaagctctaacaaaatcaggtaatgataagtacttctttcaatgtgaagagcatcatgctctgatcctacagggagaaacaaattatcctctattttcttgtaatttacataacagtagttgattccataattcactctcaactgctagagtctgcaagattcccaccaactgccatcttcagcagaattgtattacacatgaaaaaacctttgactaacctctaattgattccgacattccaagaactattaaaaagagttgaaaataatctagaaactgctgacttgtatcaggcatagatttattcagacaaaacagagagacagaaggattttgaagtgagatggttttgtcaattgggcataacaaaggaagaaaaataaaaattatcgttcatgctttgaaaatctctcttgtgatgtacctctctgctacagtacctggcatttagaggtgtttaaccaatgttagggaagaaaactaacactggttaaacacctctaaatgccaagtactataacagagtactcattgatcattttattcaatcttatctactcttcaaagcccacaaaagaaacctgttgatcaagcaaagcttatcacacttcctgcaataagagagaacattgtcttaatggagaatggttttagggcctgagctgggtgatttcgaagttggtcttgcaaggcagggcacttgttgggactggaaaagtttatgaaaagtttctttgggttggtaagcatatggaggtaagggtcttgaaaggagtattgatgagtaagtcatcaatcttgataagtaagctgtttcattggtgttatgggataaactgtgcccctctaaaattcataggttgaaggcccaaccccccttcctcagaatgagactgtatttggagataggccttcaagggggtaattaaggttaaacaatgtcatatggttgagccctaatccaatatgacttatgtcttagttcatttgtgctgctataacaaaatgccattgactgaataatttatgaagaacagaaatttatttctcacagttctggaggctggtaggtctaagatcaaggccaaggccagcagttatggggtctgtcaggagcccagtctctccttccaagatggcaccttgttgctgcatctaccacagggaaggaacactgtgtcctcacatggtagaagtgatggaaggacaagaaaggtgaactctctctgatgcttcttttataagggcattaatttattcatggaagtggcaccttcatgacttaatcactttccaaaaggccccagttcttttttgttttgttttgttttgtttttcttgagatggagttcactctgtcacccaggctggagtccaatggcgtgatctcggcttactacaatctccacctcctgggttcaagtgattctcctgcctcactctcccagagtagctgggattacaggtgcatgccaccacgcctggctaatttttgtattattagtagagatggggtttcactatgttggccaggctggtgtcaaactcctaaccttaggtgatccgcccacctcagccttccaaaatgctgggattacaggcgtgagtcaccgcacccagccaaggccccacttcttaataccaccataatgggaagtaagttacaacacatgaattctgagggacattcagaccatagcaaatagtgtccttataagaagaggagattaggacacagacgcacacagagggatgaccatgtgaggaaacacagggagaagacagccatctgcaagccaaggagaggtgcctcagaggaaacaaaacatgccaacaccttgatctcggacttccagcctccagaactgtgggcaaataaatttctgttatttatagccacctgttctcacagccctagcaaactaatataatcggttcacagtcatctttttggtacttccagaaacaggagattaagtaacatacccaagattacaaagctattaatgtggagccagggttctaacttcagtctactgaactacaaaaccaagttctgcatattttaaactttcctctgaagcagaaacaaattataaatagggactaaatagaaagtaactaaagctttgttatatgtttcttcaattgctcagttttccatgggcagcacagggcactcattgctgtttcttttctacagcctccagcctaggacagcatttttgtttataagatataaaagccagccagtgttttatccaggtgagctgacactcttgtgtcccacccactgtcctcaggcctgaccatttctgggagcagagattctgtgatttccaactgccaatacctgcaactcttcatcttaggcagttcccacttggccctggttcagggcagattggaagttctgagtagtgaatgctccccaccagagaagccctcaaccaatgattgatgggagttggtggacaaataccccagttccctcctccctcacgtgggatgactctgagacatgttttctgtactattcccagaattccccaatgggattgacacctagttgtggacagtagtaacaagcctgataacataccttgtattggctgccttttctccccattgttgctttttgggattgcctcctagataaactatactcaagtctttgtcttggggtcttctggagaagctcaaatgataccaggctataaccactggctccaatctgacagtcacctcccatctccaacacctctgtatggatctctaggtttcttaagcaagaggccactttctttaacatgacctggaagagctggcatgatctggcacctacctacctattcttatcagggttcttaggtttaacaacagaagtagaatctgggtaactaatgcagaaaatgaatttattacaagggcatctctcacagaatcagattagcaagatgggaaccaggctgatttagagacgagtaaccaaggccctaccataagaaccatcgacttaggacactcctgcagaccctagcccaccttggtcctgatcaccctcttcctgctgccagattccacaacccagatactccccctactgctgaatgttcagctatcagtagcccccatggaactctctaaccagtatgtaccctcctggccctcccgaaagacttacagcctgagaaggagctgtgggcttgatatgcttaaaaagcatgctcccacagtgcatggagaaaggtctcttcccctacttcagcatctgcagaaggaaatggggatgtcccaaataatcagggtgctcaaatactgggttgccagaagacagaccccctactgcctcacagccccctcctcatcctgaagtccagccctaccaggctttgtgcagtgtcgcgaggccaccatgcttctccttgccacacagtgtgcatagaaggctcccctcttctgcccagtcaaactcctcttggctgcagaattcaggtcagccttcctcgtggaagatttcctgagaccacaaacatgtcagatcccccacaaatgcatgcacaacagctttcctttgagaaattcatctcccttgtaattgcatgtcatttgcctccctcccaagaagtcagctccctgtgggtccaggctgtctccacttttactcaccctgtgtgctcagcaccaagcagaaggtccagcacatattaggtaccaaataaatagctgttgaagagatgaataagtgaatgaacacatttataagcagctcaattttggtttttcacaaatcactacacagtttgtaaatagcaaaagacattgtccttttggcttagaggtgaggcagctcatattttcaatgagaaagatgttctctcatgacagacactaaaataacccaatggggcgtgtgatcaccttgattacatgttcccaaagaaatacttttttaataccaaatatttttcaaagtttttataaagccttccatctactcaatggtaggtcatatctcaattaactattgctacgtaacaaatgtaacaagtgtctccaaagctcagaggataaaaacaacaatcattggttattgtccattcatctagacgtgggctggggtaaactgttctagatgaggctcagcagaaagcgacaatgctccacgtgcctctcatctttcttaactactaatgggctatcccaggcatgttcttctcaagccaccagtgggctagcccaggcatgttattctcaagccaccagtgggatggcccaggcatgttcttttcaagccattagtggtatagcccaggcatgttcttctcaagccaccagtgggctaacccaggtatattcttctcaagccaccagtgggctagcccaagtatgtttttctcaagccaccaggggcctagcccaggcatattcctctcgctgcaatgacagaagcaaaagaggtcaagtggaatcacaggagtcctcttaaggcctaagcttagtcatggcccactatctcttctgcccccatgccattagccaacacaactcaacatgatcaagtccaaagtcaagagtaggttagtacctccacccacaatgggtacagcaaaggatgaaaattcaaagccaacgagcaatctacctcaatattagaggtcaggtgaatgataagaagcatttagagaagcaaacagccaaatggcaatcaagccctccatcagcgtgtatgttgtatgcctttgaaaagctgtcagagacagtacttgtcaaaactgtcaaagtcatcaaaagcaagaaaagtctgaaaattgtcacagccaagaagaacctaaggaactatgatgaataaaagtaatatggaatcctagatgagattataggtcagaaataagacattagttaaaaactaattaaatctgaataacatatgggctttaataataatatatcaacatcgtgtcattagttgtgagaaatgtaccatactaatggcagatgttaataacaggggaaattgggtaaggagtatatggcgactctgtgctttcaacatttttataaatctgaaactattccaaaataaaaataaaatggttttaacaaacacagcagtcagagatggaatgtggtttatgacagcaagaattattgcttgtctagactcaacaagttcttaaccttattacagtcttacaaatgacggatttgttatctagggaagaaaaagccctcttctgggactctgagacaaaggatttatttgtacccacctgagacgtgctcagagagggactggaggtgcatggagagggctcctgtcagaatcttcaatccgggggaggccagctgcctgggatgtggggctgcctgccctcagtccctatgcagcctccctttgggctccttccagcctcactccactgtgatcttactcttctcagtatatctgtagtcttctcatcctcccccttcttctgtctcctcatctgtgtgaaaagactggatgaattctagacccaactccaagcttctatacgtttgcagtaacacaatgtaaacaggctaacttaaaagtccacagctacaagatcatttatttttcaaaatctaattgaagtcacagctcctttcaaagaaagcactgttcacctcaaagaaggtatcctgagaccacgaacagatcagatccccgacaaatgcatgcacaacagctttcctttgagaaatccatctcccttgtaaatgctgtgtcaatcacattcctcccaagaagtctgctcccggtgggtcggggctatgtcaactttggctcacccctaagtcctcaggacacaggacataagcagatgcattttccgagggcgcccggcctaactgtaagtctcgtgaaggcaggggccaacatgaatacatcctgtatcctccaaagatttagcaaaatgctaggtcctgtgccctaccccgacccccacccgtaaataccaaggaaggaagacgccctctgccccttcccctctcctccctggggcagagcggcgcccggacctgctcgctgccatggcaacgcggcgctccctcccatagacagtgcaccctccacgaagtcaccgagcagctgctaccgctgtgtctccgccagtgccatttctgcttcctcgaattttaaattggccagaataatacaacaaattaaggtatttgctggtttctattaccattttttggtaaatcactttttccctattaatgcatgggaaagagattgccagcaaacacaccattaatttcactgagaaaaagctttaaatgctcagtcatgtttttctaatacaattcagtgcttccaaatttatttactgctgcctcaaaaacaccaagtaaatcatgcttttatacacgcacgcgatgcccatgttgagaagaaatttgctaagcggctgtgtttgttgaatcctgagcctgcctctgcacctagaacaatcccaccatgaaatgaaatgaatgcttgcaaagatttcttacttcctcctttaaagagtggtaggaaaatgaacaaagaggataaaaggaagcaagctcatcatgcattcaccaacgttaaatttccaaacggtagttacaaagcatttttaaatttaagtttcattaaagatttggaaatatattgctttttttctctgacttctcccagaaaagtttttgggatttgggaattttatgtgtaggttttccacaatggagtttccttcccatgtatgtgtgtgtgtattttaatatatatataattatatgttacacataccatatgcaatatataaatattacctaacatatattacataattatatattatgcaattatatatattataaaattatacataattttatatattgtagaattacatataattatagaattatatgcaattttatatatattaaaatacatagacaaacataatttagtacatatttattagcagtggggatatttgtaatgcagataattacctgcagctttaaatgacagttttactgatacactgtatgtttggtgagaaagggtgctatgtatggtaaacggaagaggagaggaggacacaagttcaaagtcgaaaaaggttttggagattatcttccaatctaatgccctattttacttgcctagaagatgaggaccagaggaaaaactgacttggctaacaacacacagtcaacttgtggctgagctgtgagttaaatgatgaaactgaagcaaaatcacttggatttctgcatgggagttgtcgacagtcatgaaattacactcaaagactccagtgcattcaactaaatgtcaattagtatctaaactttgccagaacacagcaaacagcagagctaagacatcctgtgggtgatcttccctccctgcagcctggcttgatgaattagagttctttggttttcagaacgtggttgctattttcttctccagctccattagcaggttgggaatggcacactagctttttaattaaaaataataataattaaaataccaaacacagtgttgactaaaaacaaaccattattcttccttaatcacttaggcttagtaatttctctttgtatttggcaaaacttcaaaaggagtaaatcaatgttaaatccaaaatttaatgactcgagggtttttggagaaaaagaaacctagcagtacatcacaataaggcaggagccagaataagtctgggctgttttacaagatgctgtgttctaccactaaaaagagggttatcataaatattattagttatatatgagctaaccccaaaacatcttgattgccttacaagtcaccttttatttttaaacttatgaaaatgttcccaattattcagaagcaagatcattttatatagagttctactgttaaaaacaaacacattctgttttattactgcaaaccctacatgtttctccacaagctttgtctaatatttaaactgaaagacttattacacgtattgaagtgcatataatgttccaaaatagacggtcaccaagtttaaaaacttcgctctctcagctaacacgtgcatatctttaacaattgacaaattacatatgcaggattgttacacaaaatgaaaattaaaaaagaaaaacaattgacaaagcgaagcatatttgcatgtattaactcatttgttttgatcttgtcctatattcctaaaagtcacagaagataatctgttacgtaaatatatggtcagtgtggaaaattcaagaagtatatgaaggaaaaacagaaatctccctctatatcgagcccctctttcatctccacaccccggaggtaatcattattatcattagtttggtatctatctttttataacagaactggccaatagaaatgtaatgtgagccacaactgtgtacataatatgaagtagccacatttctataataaaagcaaaggaaatgagagaaattaaataataatatatttatgtaacatagtatatccaaaatattatcatttcaacatgttatcagtacaaaattataatgagatattttacattgttttcttgtactaagtcttcaaacaccagtgtgtgtttcacacttagagcacaaatcaattcagactgccaagtttcaagtactcagtagccacacagggcagtgactacctatgggacaatacagctctagaccttcctttctatgtgagagagagactgtgagatagtatatcaactaagaattcttggccgggcacagtggctcacacctgtaatcccagcactttgggaggccgaggcgggagtattaagaggtcaggagttcgagaccagcctgaccaacatggcgaaaccccgtctctactaaaaataaaaaaaaattagttgggcatggtggcgcgtgtctttaatcccagctactcaggaggctgaggcaggagaatcccttgaaccagggaggcagatgttgcagaatcagggaggcagaggttgcagtgagccaagatcgcaccactgcactccagcctgggcgacagagtgagacttcatctcaaataaaaatacataaattaaaataaaataaaataaaataaagaattattttgctgccaagaacagaagtaataatcactgaaataataaaggcttcaatcagccaatgtaacaggaagtctacaggtggccaggtctgaggctggaccagcagctaacaatccaggcctcaggatgctctctgcaattgtctcaaccatcccctgtggttgtaagatggttactgcgggtccagagagcacatcttcctactccagcttccaaaggcaggaagcagaagcatagctgagaaaatgagaaagagctctttcttcactcatgaaggggaaaaaaatctttgtcagatgccccctttatatcttttgctcagaacagatcacatggccttcccaggttacaagggaagctgggtaagcagctgtctggctcttttagtctccacagtgagaatcagtcataggagatggggattgaaaatgtttaaaaggtaagcacccaaagaactgacatggatagatctaaaggtagcgctcctgactcaaacagcgttcctacttcagagctggatggactcttccagcccactccttgtgggctgtgctgatcacacttccttcataaagtatgtaaaagaatgtttcagcacatctgcagcacgttggacattattagattctcaaataaccccgtacagtttacactttcatgagtgtcaccttcattttacccagaagttaaataactttctgaggtcacagccaagaagaacctgagtcatgaaccatctattaaacccaggccttctgtctacaaactcactgctttttccattctcagctgcaatccacctgacaagtaaagaatacttcatgaaaattgaaagtataattaaagaatctcaagttgaattttatgacaagtttgaaaacccaatgtaagacccttcccaggataagctctggcatttataaaaatccaaacagccagtctgtgactgaccaccagaaaaacagatcttggggcacttaaatgatctctctactgtgaaccactcagaattgcttttattattggagagaaggtaaaaataatgacagcaatggtggttcataatcttcaaagtatttttatgcccatcatctcgtgtgattaaaaaaaaaaaaacctctgaggttggcagaagtgtgcaaccttatttgataaatggtaactaagactcagaaaagtaaagtaattgggtcaaaatcaaacctgtaggctaggaccctggtcttggatgctaggaactatgagaaagatggatatcagaagtcattagaagctcttctattatcaaaactttctcagtggtctaggcactggttataataataattatagttcacacttacagagcatttattacatgctaagcactgttctgaaccctttacatttgttaacttatttaatttcacgagaatcctataaaattgtgcatcagtgctatgtcttcataacaaactaacgaaacttgcaggtgttcacagcaatatagacagttacttctcattaacagctactaaatgactggttgaggtttggctgatctagggtggactcagcttgggatggctttgagcccaagggttgcgttaaagtttacttctgattcatacaaataataccttgcttgtaaatttcacactcaatggacctcacacacaaatactattttcttagtcctcctgagtgggagttggagtgtcttggtggaaatgggaggattctgacaagtagagaaatgccctgatagccacctctatcaaaaagccaagtggagttgaaaatagggcactggatttgataagaaagagatcactgatgaagctgtcacctgaaatctgggagggacaccatcaagcacagctttctctagggcaacagttctcaaattgtgtcccctgaaccagcagcaccagtgtcacttgggaattggttaggattttctaagaccctgctccagacttacggaatcacaaactctgagagtggggcccagcaatttttgttttaataagctttcctgaggattctgatgctgcttctaaatgtgagcaccactgctctagaagaacaccaagaaactgagctgtgcacagcattcaccattgctgacctgctagaaggttgatggttttcaccgtagcatttgtaatcttggttgtatgcaccctgcctttattttactatatatgcaatatagtctttgaagtccctgtcctaccaagagaatcctaccttattttgggctttggctgctctaaaaatgaaaagttttgaaaagcacaagtcaccctaaattggatcctgggttgttttttgatgggggcataaagaacatcattgggacaattgatcaaatttgaataaggtatagattagataatagtattgtatcaatgttaatttcccaatgttcacaactgaactgtggctatgtaagagaaagtgactgtttctaggaaacacatactgaagttttttaacttcagagagcatactgtttgcaactttcaaacagttcagaaaaaaatgattttgcatatgtcgtatgtgtagaaaaagaatgataaagcaaatgtggtaaaatgttatatttagaaaatctgaatgaagagtatgtaggaattctaaatactcttttcccaatttttgtattatttccaaattaaaagtttacaaagaaaaagcaagtagatccaccatgacttgtgctccaaatgtatgcaactgattttgcagaatctcatgcttcatgctctatcctgttttggagcataactttcctccctccaaaggaaacaagagacacctatggaaatgctgatggagcgagggtggtcaccaggcatggagcagcacaggaacacaagcttcttgaggcctcccaacttgataatcttcacagctggaaatgtcccccttccttcagaatttctctgacattattgtctgtcctgggatattattgctcatttgttagtactaagaagtagtttaagagagcagtctctggggccacttcatgtatttatggcttcaaacagccagggttcaaattctgcctcatccactttctacctgtgtgacctcaggcaagcccctgtgtcctcatctgtaaaatagggatgataatagtaacaaggattaaataagtgtaaagggctaagaaccgtgctagcacatggaagttattcagtaagtcttcactgtgctattatttccatacatttcttccttctaagtcactgcatatatatatatatatatatatatatggcttcaaatctagatagttgtgtattcatagtatgttcacaacatgttcaattcatctggcccattctctcacttcacacctgaagaagcagagacccagaaaggttaaataacttgcccaagtaacacagcttgtcagtgttacttaccagctcaagtcacttgtgcctggaatcatttctcccagcatactctccagattggggatctgaaagagcagtggagtgggcaatctacttttccagagaaggtctttatatagaaaacagttttgcctggagggagccagaaacctcctgatgtaggaataacgcctctcactagagtcatcagagtcactggaatgagaaattaccgggtaccacaggcacactgaattgtaatttatttttcaaatgtgtggtaagttgaggacactggaaatgagcatggtacaatgagaatcagaaaacagtgggttaaaatttaccaattaacttgggtatgccacataattcccacaagccgcattctctgcatccacaaagtgcagttagtggtgcttctctctcagtgtggtgacagcgatcagagcggattcttacgggggggcaatgagtccagggccacggatggccaaaaaatgttctttgcttcaaaaaaggtgatggctgactttggggcagagaaactggtggtaaagttaaggctggggagggccaataggaaggggccatgaggggtggagaacaacacctggaagaaaatgttcctgctctgagagaagtagaagacctggaaccacaggaccagtacttctcacccacacatctattgtatgggcctgggatggaaatctgcgccaccaactgaatcttcaagcaagcacataaaatagtggtatttcatttctaattacacattctgtcagtcatgttgggtttcccctgcaattaactggctctttacaaacgcattagcatatacagccaaaggcattggtttcagactgaggcaaatctggtgtaaaaccggcaactcagaaattgtgtgactttgggcaagttactcagagtttatgaagttcaatttcttcattcgtagaatggtggacaattattcagttactattgctgtgtagcaaattaccccagagcctagagaagaaaggaaaccacagttttttggctcactattttgtggttcaggaatttgggaagggcttgcggttcccacttgggatgccatatacttgcagtcagacggcagcggagattgggggggttgtctgaagactcaacagggctggatgtccaagatgtcccatcacatggctacaggctgggagcccagctgaggatcaaccataggaccaaagctcagcctctccaggaccatagcctcagggggctcagacttctttacaggctgactggcttgccctaggccaaaacacaagatgtccttttctgacgtattcttgtaagtcagacagcatcacagcatcactttgtgtgtgtgtgtgtgtgtgtgtgtgtgtgtgtgttccttgtctagtttttatttgtttgcttgtgggctcttttatttatttcagtaggttttggggaaacaggtggtgtttgtttacatgaagaagttctttaatggtgatttctgagatttggcacacccatcacccgagcattgtacactgtccccagtgtgtagtcttttatcccttgccccctcccatccttccccctaagtcccccaaagtccattgtatcatttgtatgcctttgtgtcctcatagcttagctcccacttataagtgagaacatacgatgtttgatgttccattcctgagttgctttacttagaataatggtctccagtcccatctggattgctgcaaatgccattatttttttcctttttctggctgagtagtagtccatggtgtgtgtgtgtgtgtgtgtgtgtgtgtgtgtgtgtatcatattttctttatccacacattgattgatgggcatttgggctggttccatatttttgcaattttgaattgtgtggctcatcacagcatcacctatttcatgataaatcagtggttgaatcagtcacatgctcatccaggtcaaagagaggaacacaggttctacctcttgatgagaagaatatcaaagaacttacagatatgttttaacactgtcacaattgtaataccactttataatattgttgaaagaattagatatataatcattgtaaagtattttgcatttggtgctattgttaagatttttatatttgcatatagcagggaaacaggttgctgcctctgagctggaaagatgcaggttttaagagacaaacacaggtatacaccatcctttctttaagccacagctttataaaaacctagtcactcaaacccaggctagcaactagttgaatgccattgatttcttagaggaattaaccaaataccttctctgggtccctaagatgcattgatctcctgctttcctccccagcactgtgcgaatgtcactgaatgatgggaggctgtttaaatgggtagaaatattgattttcttttctacctttttgaaagttctttgcttaccaggtgctgagcaaacatcaggcaaacggcagtccacatagaaatagatgatgtgaggagcaacaatggcagttctggcttctgaatgtgaagctggttaagcagcaggtgcccccactacacactgtggttttagattcaaaaactacacatcattgttcacacttcgtcatttgctaattgataatacagctcgcccctgtggcactaagtagcatagtggaaaatatttccaaccaatccatggaaacagctccatccgtgtctgaagagggtcgactgaaagctgagatgaactgagggccagtgacggggtaatgaggtgcatttcggaggctggggtctgcatcctaggtgtccatgtgcaaaattggttatacccttggaaatgacaacaatgttctgtcttagtctgtgtcagagatgacagataaacacaggttaagaaatttctgggtttctttgatatagaggacatccaagaaaccatgcatcaacattaggttgctattgacacccaaggaaactgatgtgtggttaacttctccgaaagaaaaagccaggggttccctcagggagccaaagggcagcagattggaaatcactcgcaattcacaccattggaaggaaaccaatgatggaggatggagaagagccctgtttccaatatgtgcttcctaaaggatacagtcccagagaacttgcctcaaagaacaacaaaggagaatccccagagagtgacactttttcatgattttgtcagatactctgaatttaagtagattactgctttcaacagaatatgacgaaaaccacagtggggcattcttgggcttgcttttcagtttttgcgatgttcttagggaaaaggtcttactgggtcaggtttgccaggctctgcccttggagcacattttcagcacttggttggaagaagattcatttaaccctcagctgtagatgagaacaggatgcagcaaatttactgcaaaccagaaaataaaattggcttttctatccaagaaggaaataaagaaaactctgccttatcttactttataaagataattcttttgttttccctgaaataaataataatcatttaaaagcattgggagaggtgtgcagtgactcaggcccgtatcacaacattttgggagtccgatgcaggaggatcacttgagctcaggagttggagactagcctgggcagtatagggagacctgactctttaaaaaaaatgtttttttaattagccaggtatggtggtgcatgcctgtagtccctgctactcaggaggctgaggcaggagaatttcttgagcctgggaggttgaagctgcagtgagctgtgatcatgccactgtattccagcctgggtgacaaagcaaaaacccatctcaaaaaaaaaaaaaagcattaggagaagagaaagagggaaataaggtctaaatgtcccctttctgcatacaatgtgcctgggttcaggtcagatcaggcaggtactggaacttgggttcaggtcaggcaggccctggaacttgggccagttgctcttacctgtccctgaactcaagcacttccacacctgcattccctccagactcaggttctttcttctgagaagaaaccttacattttttttgggggggggggttgtgtttttgttttttgttttttgtttttttgagacggagtctcactctgtctcccaggctggagtgcagtggttccatgtcagatcactgcaacctccgcctcccaggttcaagcagttctcctgcctcagtctcctgagtagctgggattacaggtgggcaccaccaagcctgtctactttttgtatttttagtagagatggggtttcatcatgttagtcagactggtcttgaactcctgaccttttgatccacccatgtgggcctcccaaagtgctgagattaccagtgtgagccaccgtgcccagctaaccttatgtttttaaaattgttgttgttggttttgttttcaagtgaactttttgcctgttctgtcaggatcatttcaggagagtagcaaccctaaagaaaactctctttttctttgacataaaacttatttttaaaaaattaaataaatacttagtgagttcctactttgcatctggcacttccgggaactcagaaacagagtgagagaggggtcattcccagggagagggatggtactaggagatgagacaggactgggaccttcctagagctctgggtgctattgggagggcaaacaaatacatgtcattcctggaatgattaggagacactggcaattcaaagggaagacaatctcaacacactagtgcgatgggtgagtccaaattgatagcagaacttccagcaaatcgaccctccttaaaattcaagatagaactcttagaaaggatataggaatgttcacatagcatcttgtttttgaagtgattttgtggcctcatcaaggaatcccgtctagttttcattaagaacagcacacatttttagggagatttattcaacaattactataacaagaccctcccctagaaagcttcttagggatacacagcacttttcagaccccatacaacagttccataaaagtgatcaaatttcacattgtgaaacgagacacgatgcagctttttaaaatgctgacgaggcatgaacaacctggtggctttcatttgctttttgacctgagcatgttttgaagtggaggagacaagtgaacaaagtgaacagaaatcagtgaactccatcagagaaccacggtaggcttgttcacaagctgctgtgagccaccacgtcctgggtttctttgttttgcagcaacagtagctggaacacaaacattgagctcatgatccgtcgacatttcctcattggctttggccatttagcattgcaggcccagcccatgttgatttttttattcctttacaattaaaatgttttggttgtttttgttgttgttgtttctgcttgaaggcttctggaattttgtctctatcactgcaatttaaatattccctggaatatggctaaatacagatctcatgttattaatcttgcctagagtgaagtgagcctttcattctctacactgaagtgttttgcttcgtggcttttccaacggttctgtttatttgtttgtttgttttccaggaatattgttaggaatattcccaagctgaggagctggtacacactgataaatctggaactgcccagctcccctgtcattgctgccctcggtctaaggaccagcaatggaaaagagtagagtggcctcctaactatgcatagactatgggctcagtttactgtagattacagtgaacactagcaatggacatgtcataagttaatgctttgaccttcggattttaggacctaagactcaacatttgccttttataacatccatgcaacccacccctgcctgttatgtgacgcattccccctctcaggcctaagtttatagctctctggctataaattcctaagcatggggtctaccccaaatgctggcatcactaagaacaaatgggacaagaaaacccaccctttacttctacctcctgaggctcctcagtaaggagatattgaagcttttagagtaaacacacaggcggcatggaggaagagtcatgcaggtccccatgaaaagatatctgacttgagatcactcccatttgatagcagtagcatttgctgttgagaaggcattcagaagtattcccatcccccaaactaactagctttattgttgaatctgtttctctgctctgtgtcctacacgcctataattttccccttttgacattttaatctctttctggtaaaactgctaaaattcacctgtcattaccagtccatttctgcattgtgaattctgctctttgctgctttcaaaccagatttaatttgggttttgtgctgggcatcctcttcttgtctctatgattcttcaatttaccttttgttcctttttaccttttgtatcttttgtttaaaaaggtaaaattcttcaattttactgcttatcttgtgtttttttcctctccgtcttacggatttgggctcctattttgttacaatcttgatgtacatcctaattaatacaccaaggaatttcttctggttcttacgcttagttattttgcagtgcagtgtttttccctgaatcttcagcagaatgttcccctcccctgttccttgcatttttcattccagctctcctatgtgggcttcttttttctggcttacttatttttaaatgagataagctttacccaaacccagaattcaccaccagactcactgctgggttgtccctgatctgtccattaactaagtcacctcctgagagatagcactggaagagcatagttctttgccaaattcccaatgtttaaaggattggccgggcgcagtggctcatacctgtaatcccagcactttgggagactgaggcaggtggatcactttgaggtcaggagttcgagagcagcctggccaaaatgtctctactaaaaatacaaaaatgagctgggcatggtggtgcatgcctgtaatcccagcaacttgggaggctgaagcagcagaatcacttgaacccaggagacagaggttgcagtgagccaagaccgcaccaccgtactccagcctggaaggcagagcgggactgtctcaaaaataaataaataaaataaaagattgcagggtttaaattgaatctcttcctacccttactgcatatttctctgacattctgaacaaataagtgattaaaaaatgacaatccaccagggttcttatgtttccactcacacacttgaaagttgtgatttatagctcccgaagtgaagcgggccgcccccagtatctacctcctttccataagctgtgtattttggaaatgtatatgtctacgtattattttatgtttaccctttcaaagaaggggtcttgctgaaaaattcccttgttttcaggaaccctgcagagatggaccgtcaaatgtgtttatctattcagccgcactgaatagctacactacttagcagcaattcttttgaattctagcagcagatggactatgagttctgcttttcatggcgtgtcttgagtacttcagtgagaaactcaagagcactaggcaaggagttagtatccagaagcctctttcagaaaaatgattctggcagaaaactgtttttaagagggacagacacaagagtagaataaccacatgtgctctcaaaagtcagacttgtttacagaaaaatctatctccacaactttttttttccacagtgttccatgaacatgctccagggccacctctcaatactcacatgtgcaatatgcatttttgcatctttccaatcctgtccagcctgcttcagctgctgttcagtgagaaccatgtgttcccaaaactgtaagtttagcctggccacaggggtaattgattttctttgatttgtttgtatgaagcactatccagtcccattttacaagaaggagaattggagtagacagtttaaggagtggactacatactgtaaatgttcttgagtgataaggtgtgtgtcacacccagcaccagcaaattacacatacacacacacatacagcaaaattagcatcattcagaagttcttcccacacattccaagaaacattgttgagatggtgttattattccatgcttacttatttagaatgcatttagtgttaagcaatctataacgctcttgtttgtttctttgcttgtttgtttgtttgtgacagagtccttctctgtcacccagactggagtgcagtggcgtaatctccgtgcactgcaccctccaccccactgaggtcaaccaatcctcctacctcagcctccctggtagctgggactacaggcatgtatcaacatgcctggctaatttgtgtattttttgcagagatggggtttcaccatgttgtccaggctggtctcaactcctggactcaagcgctccacctgcctcagccttccaaagtgctgggattacaggcatgagccaccaggcctcgcctataaagctctttaataaacttttttttttttttgagacagggtcgtgctctgttgctcagactggagtacagtggcacgatcatggctcactgcaaccttgacctcctgggctctagtgatccccacctcagcctctcaagcacctgggactataggtgcgcaccaccacacctggctaattgttttctttttcttttcctttttttctttttttttggtagagatagggtcttgctatattgcccaggcttgtcttgaactcctggcttcaaggaatccttccaccttaacctcccaaggtgctgggactacaggcataagccatgcacctagccaacaattattttttatcacaacacagcgaggttcctgctataattatcctgactttacagatgagaaaacaaatgtacagaaagcttaaaaaacttgactaaggccaaacaactagcaagtggtagattcagtatgtgggcctagacagtccttctccagagactgactctcactatccctttattcagcactctctgtattgcatgagaaaaaatacatgttgcatctgtagctgaacttcatacaacgcacaccaactacatttgggagacagattcatttatttacaaattcccagtggccaccaaaacatctgatagttaaaaagcccatcttaaatgtttgtggaaatgaatggaattggatggttttagtagcttcaatttgactcatctaagaaaacagtataacccacatgtagctgtcctcctgagggtggcctctgttttcactatctgccagccatgaaacagggctgcttcatccctgcacagatatcttcagtagaacttgtcagcaaccaacctcacttctccagcatgaatattagctctctctctgcatgcgggaggcagaataatgaccttctcaaagatgcccacattctaagccctagaacttgtgaatatgttatgccacatggcaaggtggggttaaggttttagacgaaatgaaagttgttaataagctggctttgagacagggagattatcctgaattatctgaatggccccaatgtaatcacgagtatccttacaagaggaaggcagaagagaaagtcaaggtgatatcatacaagaaatatttcatccactgttgcgccgttaatgatggagaaatgggatcataagccaaggaatgaggaagcctccagaagctggaaaaggcaaaaaaagaatccctgccccctacaagagcctctagaaggagcacagccctgctgacaccctgcttttagacctctgattcctagaactgtaagagaatgaatttgtgttgttttaagccactaagtcggtggccatctgttacagcagccacagaaaactgcccactgcaggatgaaaagccactttctcctggtatttctcaaaggctaatctaagagcatggattgttctgtatcttccaggagcactattgcaaagtcgattcattacttttttcatttgttccgcatcaccgtgctggggctcattaacgccctgtcatcgggtgctctgtgcgtaagtagaagtgtgttaagaatcaatcgctctgacctttattccctgttggtgttttgtcattcgtgggctgcttggcttgacatatgaattactctccagctgcctggtgctggggaggcacagtcaccagcccccaaatatttcagacatatgccaattgcaatttcaacacacattttttttctaccgtcaccctggaactgttccattggcaatgcatgaaatatgaacaagaggaaataattgacaaggcaccactgttgactaaggggctaacctttgaggaagattaaaaacagatgtccttgaagaagaaagaactgaggaagtgaatcttctctcctcttaactctttagttcattgtcctcatccaaaaattaaactaacacactctgaagaaggtttaaggagatcaggaattttcaagaattcatttgtattctgtagcagacagcttgtttgttccccattgaaaacctacaagaaacaatactgcaacctttgttatagcaaataactggtgggtgtatccctccatgccaaacacatgccaagcataaaaaatgtgcctagaaaaacaaataactttggaaggctcttttcccagtgccttcttacttcctttgtcttagtcctcctttctgtgatggtgcccaacctaagccctggatcctttgctgttgatttcagtagcatttctccctgacttgcaggaaactgcccaaggctttcaaaattaccttttccataaactcctgttccttcctcgaacaatctcaaccagcatctttgcaaaaagctgcctaattaatgacttcatgcacaagtgtgggtaagtgataacacctggatgtgttgcccttcccagaggacttgttttccaaatcttttcaaatagagacataatcagcctggataatgagtgctcaaaactaaagcttaacccttcatggcaggagtgtggtcagtgtgcgtgtgctcaggggaggtgatatgggtcattggaggctttctttgtgcccctcaaatcacatgatttgtactacccaaatgctgcccctgcttccactctgacgatgaaatgatttcatgaatatattgaccattataattatagccagtgacatttatagtatgcttcattattctcaacaagaaaagtttatttcatgtcatcctcaccaataagcctgtgaggtcaagaattccatcatgtccgtgctatacaccagaaatcaacaaactttctgtaaagggccagagagcaaatatttcaggctttgaggccatatggtctctgttgcaattactcaactctacggctgcagtgtgaaagcagccataggcagtgtataaacaaatgggcatagctatgttccaaaaaatttatttacaaaagcagtcagcagactagacttgccaaacccatggtctggatgaagaaagcacaacctggagaatttgaggccctacctcagaacatgcacaaatcagaagcaaaccacctcagaacccaaacccagttctttcttacttgaaattcggtgctctttcactgaaccacacggtttggggcatagtctttagcattcaggagagtcatgactttggatcaaatcaagaatactctccacccacccatctcccccgttttcatcacacacacctgtaaaggagcagctggggctggggtaccatcattagcctgtggccatggaaacagagtcaaggtaactgacccacaggaccaagacacatgaccttgatgctattagctctttccattgaagcttgctggccatatacagcataattgaatgaaactgcagaacttcttcagtcagatccacctgtgccttccagaagcacattaatgaggcccccctccggcacagaatgggaactaggcaatccagacacatccccacccagcatcctccttctggttcactagcagaactggatcatgaatcaacaaaatgaaggaggctttgcaagaacaaagcttttggaacctgtattcctgggtggtgctggagccattcattcctagccaggtgccatgagcactttctctgtgggcgctgttggctcccctttacctctcacccccaaacgcctttccagggaggtgtagtgctgagtgcactggtcagatgtggggacactgactgttcacagctggagtgaagagggacagagacttctcctcgtctccccaccatccttctgttcctcctcccatttgtcctcccaggagctctccttattagactgaggccctttagcctgcctgcaatggaaaacagagccattcacctggcccaggcaggctctttggggtgctacaatgtgcatggccaaagctattcatgtattaaagaggcttagctagctttgcttctttactgcacttacatctcaggagacactcattgagaggaacatgtcattttggccaagaacagcatttagggactttctagcttctctggaaaattgtcctgtcaagtacaccccagtctaaccattcctgccgtaatatctggcatagagcctccatcttttaatatccttttccttaatataatttcctaaatccatctcctaacattgccccaccaccctggaaacaagcatagccctggctgcaatgcacatgttccaaccaatatagaagctgagatttcactttctcggggttctcgttggctgccttggcacctcgctccacaagaaacatctttgatccctccctaattacattgatttatctcacggtataccttgtatccagagctttagatgatagatagcaatttgttaatacttgtcactaagactcaatgactggaactgtggtcagaggcatgcagccatatcctccctcctcaattgatcatctttattcttgcaagatggtccaacctctctaaatgagggcaatcaatactgtgcattcagccataatcgtggcttaacttggtattctttgaaaacttaagctgtgtaatttgcctgtaattgggctttccaaaaagtcatatctcctgctcaaggaagcaattaagccggcacactccctgtctgctgcctgctccctccctcctggcatctgactgccatgggccaagtcttccctccgcagacctctctcctctccagatccctgtttggatctcgacaaccaaagccagcagttggcggcaaagcagatgaactagaatatctgagccccttggagaggcctttttcttccataatctcccacatcacttccatcaatcgcttttgggggtttctcgcttgatgagctgtgtccagctcatcaattcaaacactgagataacacaccgcattgcaaaggcaaaggcagaaaagctagagccccaacagtgaaccctcatgtaaaccatggaccgtgggtgatgacgatgtgtcagtgtcggttcagcacgcgtaacaaatgcacgctgtgctccagcagggatgttgataataatgggaaggcagtgcatgtgaggagacagaggatatgtggaactctctgtgccttcttctcaatttgctgtgaacctaaaactgctgaaagacacatagacgaaagaaagaaagaaagaaagaaagaaagaaagaaagaaagaaagaaagaaagaaagaaagaaagaaagaaagaggagagagaaaaaagaaagaaagaaagaaagaaagaaagaaagaaagaaagaaagaaaggagagagaaaaaagagaaagaaagaaagaaagaaagaaagagaaagaaagaaagaaagaaagaggagagagaaaaaagagaaagaaagaaagagagaaaagagaaagaaagaagaaagaaagaaagaaaggaaagaaagaaagaaagaaagaaagaaagaaagaaagaaagaaagaaagaaagaaaagaaaagaaagagagagagaaaagaaagaaagaaagtctaacaaaaagatgtggagacatgcccctcatgcagatggggacttgtgttgcatttaggacacacttaggaatggactccagctggcttctcttctcacatttgatttgctttgtcttcagttagctaagagcaagaagattaaagtccaggcatctgggcagctttggagtgagatgagcctagcttgaggtgttttggaacaagggaagtcactaccccactgcctttctacattacaaaaacattagcaaaattatagaagtaactgctggcatttcttgagttcacacagtgggccaggtgcttatatgcaccatcacttttgatcctcaccacaaccaaagtacacatgggagtggaggagcagcacagtacgctagagaagtacctagctagactgctggagtgtcgtgtcagtttgcgaaggctctcatatggggggccacagccagggtggcttaaagaacagaaatgtatggaggtaaaagtctcagatgaaggtgtcatcagggttggtttcatcagggccatgagggaaggacctgttccaggctctttccttggcctgtagatggccgtcttttccctgtgtcctcacaccattccctctgttggtaacagtgcctgaatatgatgacaccagttatattggatgagaccccaccctaatggctttaattaatgacctctttaaagacactatcttcaaatgcaacctcattctgaggtactgggggtaaggacttcaacatttgaacttagagggaagagagtccagcccacaacaggcatgacccgtggctctgcccttggctaaccataggaccgttaaccagccacttggtgtcttcatgccttcactcctaacctctcatgtggttgtcggggaaaataactgagataatgtacatgagtactcagggcactgcccagcgcaacagtcagccctcagtaagtgtcagccatcactagggtttatccttattttacaggtgagcaaactgagtcttaaatgggctccacagcttgctggagaccccacagccagagaacaacaggtatagcagggcctgtaactcatgtctgcctgtccccaagaccaagctctcatccacaatcctatgctgcctccttcacaatattacacagaaggcagctgtgtgcctacaaagaagtcaagctatattcccctttctgtgagatgaaggatacacaacccaatccatctcaattcttaccagcttcccaaagcgtgaaacgaaacttcccagccctgcctctaacaccttgtgagaggaagaacttactctgtcactatctggtgcccagctctgtgagcacaccccagaaatgcctcagatcctctaccctccccaggaagataacagtgacaaggatgaccaggccagggcccagaggtaacttctatcttcagccctaatcctgtgtcccatatggatgcgtcctcaagcccatccatgggtgttagagctaaagtgttttaacctaccaagaaaaaaaaaatcctcagactataataaaggcaaggtatcttaccatgcaaattaagaggtttttcataaataaaagattcatgctctttgggtacttttgctacatttttaatacttcctccagcacactggctcactacgctggctggtcatttgaattacctggaaagttttaaacaccgctgaggccagggcccatccctagcaactctcagttccctgctctggtggttggcctgagcacagggcttttgccaccttcccaggtgattgcactgtgcagtcaaggctggggacctctgcttcgcgaggacaccttgttttcttgtagtgatgttaactccagtctctgcctcctccatctccacatgcctttcactctgtgtgtctgtatgtcttcacatggcattctccttgtttctaggccctcttagtataatgacaccagctgtattggattgagaacccatcctaatctagtatgacctcatcttaactaattacacctgtagtgaccctatttccaaataaggtcacattctgaggtactggaggttagcgccttaatatatctttcaggacagcacaatccaacccatcatagtggtaaataaaataattctcagtggcacaagaaataattttacacaatcaaggacatcatagattaataaaccagtatttttagcaacatgttagttttgtgttttatgctccttttcttgctctcacttcaagcaaagacgtccctcaccatctttggagcaggtttcccctttgctcccctttctcctggcccctcccaccccagcacagtcaatgctaattaacagctgtttaattatcagcccagcagggaagtgatcatggcccaggtcctcagagagttatatgcacagttaagttgtcccagatactggaagattgactgtgttatgtgcccatagggagaggcaatgcggcttagtcgaaagttcatagcattgagaatccatcaacctgatgactctgccatgttttaactgttagacaatggcttccaaacctttttttcctcaaccgtaacaataccaaccccacagttttgttgggaagattaaggccaggcgtggtggcttatgcctgtaatcccagcactttgggaggccgaggcgggtggatcacctgaggtcaggaattcgagaccagcttggccaacatggtgaaaccccatctctattaaaacaaaaattagccaggcatggtggcgaatggctgtagtcccagctactcgggaggctgaggcaagagaatcgcttgaacctgggagtcggaggttgcagtaagccaagatggtgccactgcactacagcctgggtgacagagcaagacttcatctaaaaaaaaaaaaaaaaaattaatgtagtaaaagtaccttgttaagtatacaatcatatgcaaatgcacagggatgttttctgcttcatcttagcatggtcataactggcacatcatagagagactagaggtgggtaagggatgggtagagttgcttgagcaacatttgtgcacaaatgtcaaattaaggttcaaaagttgaactggaattgtgaaatagccatctgttcattttaaagaaaatattaactagtaccaattctatgaatctattccaaaaaatcaaggagactcctctctaacttattctacaaagccagcatcaccatgataccaaaatctggtgaagacacagtgaaaaatgaaaactacaggccaatatccctgatgaacatagatgtaaaaattctcaacaaaatactagcaaaccaaatccagcagcacatcaaaaagtcaattcaccacaattaaaaaggctttattcctaggatgcagttagttcaacatatgcaaatcaatatatgtgatcatcacataaagagaatgaaaaacaaaaaccatattatcctctcaataaatgcagaaaaaacttttaataaaatccatcatgccttcaagaaaaaaaccctcaacaaactaggcattgaagaaacatacctcaaaataataataacagccagctatgacaaacccatagtcagcatcatactgaatgggcaaaactggaaggattccccttgaggacagaaacaagacaaagatgcctactctcaccacccctattcaacatagtactggaagtcccagccacaggaatcaggcaagagaatgaaataaaaggcatccaggaaggaaaagaggaagtcaacttatatctcttcatttatgatatgattctatacctagaaaaccctaaagactcaaccaaaaggctcctagaactaataaaaaaagcttcagtaacatttgggttacaaaatcaacgtgcaaaaatcagtagcatttctacacgccaataacgttcaagctgagagccaaatcaagaacacaatcccacgtataatagctataagaagaataaaatacctaagaatacatttaacgaaagaggtaaaagatctctacaaggagaactacaaaacactgctgaaaaaagtcatagatgacacaaacaagtgggaaagcagtctatgctcatggattggaagaatcagtatcattaaaatggtcatactgcccaaagcaatctacagattcaacgcttttcctaccaaactaccaatgttatttttcatagaattagaagaaacaattctaaaattctataaaaccaaaaagagcccgaatagccaaagcaatcctaagcaaaaagaacaaagctggaggcattgcattacccaatgtcatattatattgtaagcctacagtaatcaaagcagcatggtagtggtacaaaaacagacacatagaacaatggaacagaaaagagaactcagaaataaagccacacacctacaaccatctgatcttcaagaaagtctacaaaagtaagcaatgggaaaagggctttttattcaataaatgatgctaggataactgtctagccgtatgcagaagaataaaactgcacccctttctttcaccatatgcaagaatgaactcaatatagattgaagatttgaaagtaagacatcaaacaataaaaactctagaagaaaacctaggaaatgccattccagacataggtcttggtaaagatttcatgatgaagactccaaaagcaatcacaacagaacaagaattgacaggcggacctaattaaggtgcttctgcacagcaaaagaaactatcaacagagtaaacaggcaacctagagaatgggagaaaatatttgcaaactatgcatctgacaaaaatctaatacctagaatctataagaaacttaaacaaatcaacaaaaaaaaaatccctattttaaaatgggcaaaggacatcaacagatacttctcaaaaaacacacaggtggccaacaaacatatgaaaaatactcaatatcactaatcattgcagaaaagcaaatcaaaaaccacagtgagataccatctcacaacagtcagaattgctgattaaaagtcaaaaaataggctggatgcggtggctcatgcctgtaatcccagcactttgggaggccaaggcgggcggatcacgaggtcaggagattgagaccatcctggccaacactgtgaaaccctgtctccaaaaaaaatacaaaaaaaaattagctgggcgtggtggcacacgcctatagtcccagctactcgggtggctgaggcaggagaatcgcttgaacccgggaggtggaggttgcagtgagccaagatcatgccactgcattccagcctggtgacagagcaagactccatcacacaaaaaaaaaaaaaaagtcaaaaaatagtaaatgttggcgaggctgtggagaaaagagaacacttatacgctgttgatgagaaagtaaatcaattcagccactgtgaaaagcattttggagatttctcaaagaacctaaaacaaaattatcattcaatccagcaatactattactagctatatactcaaagaaaaataaatcattctaccaaaaagacacatgcacttttctgttcagtgctacactattcacagttgcaaagacatgaaatcaacctaggtacccatcaaaggtggactggataaagaaaatgtggtacacctcatatacaccatggaatactatgcagccataaagaagaccaaaatcatgtcctttccagcaacttggatgcagatggagttcattatcctaagcaaattaacacctgaacagaaagacaaataccaggagtcctcacttataagtgggaactaaacattaggtacacatgggcataaagatgggaagagtagacaatggggactactagaaaagaggaagagcagggaaaacaaggactgaaaaactgcctattgggtactatgcttactacctggctgatgggatcattcataccctaaacttgagcatcatgccatatatccatgtgccccctgaatctaaaataaagttgaaattacaacaaaatttttttaaatgtttaaaagatattctcatagaaataatagtgatacccagtaacaaagacttctactttcttatgttttttatttgtacaaacgtgtaagccaacggtcctatttgaggaagcgttctaaaactaaatacagaagtgaactatacgttattttctgagaaggggaataattaagttgtatgcatgttattcgtatcacatctaaatggtaataaaaggtatagtgtatggaaggctaaaattcagagaaggaggaagagagaataagtcagtgaccttttagtaataatgtgaaaatatagtttagacactcggaaatatttctctgacattaagggctttatcatacatggaattgtaacactgcagtctttcccagaggtcttctaaaatagtttataacccaatctgtccggtcatggtaattttatttataatggaaaacaatctaaatgactaataagagggaaatggataaattgtggtatatgactctggaacatttaggtagccattagtatttaattttacttaaattttaattttaattaaagtatgatagctaagtagcagcatattacaattcttatggtaggatactcagtgaaaaaagaattcacaactttatagtatgattactactctttaaaaattaggtatgaatatgaattaagattgaatgagaacccagaacaataaacatgattaatggggttacatggtatcattgtggggaaaaaaaaaagttttccagttatttgtgtgtaacaagtgaaagcatatattgttaaaggtgttcgtctctttcaaagtgtaactgtggacaagaagataaactgacagactcagaaagcccccttcagtctcaagactcctaaattgctgagttgcaaggaggcagtgcccagagaatgcagcattcctaagcatcactagtttccattaaaacctaatttatggaattaaaaattaatttcatggaaatgaatttgagcagtcttttcattagagcacacttggtctaaatgagtttggagtggttgtaatagccattcctgcactgttatttataaaggtgaaatctgatgtgagtatttttgttcttacgctactgagaaacaacatattgcttagagttttcaaacttccatgtgatagttgctcttgctccccgaagatcctctcagggaagttatttacgacaaggagtcccatagaatgggaatccctcagtgaaagtcaaccaaggcctccgattagtgagtagagcagataaaggcctctcgttgtggaaccaaaatgggaagaggcaatggccaaagtgagacaccttctttcccaagtgcaagaggcactcttgcttccatagtgaaagaagtttgcgagatgggtgtatctgatggctatgtttccaggtggagaactatacatttacttcaacattttaaacattctgttaatgaatatgcacatgtgtgcacgcaaacacacacacacacacacacacacagagagagagctatgggaatatgctgcaaaaatctctgacttcagggaaaataattgaccaaggcccccagctgctgcactctgaaatctgtcactgtgccaacaaggccacactccccccagtgactgcgagcagcaggggaactcaggcaggcccatttctgggagacacagggctcctcaaatttaatccccaacagttttaccaaaccatccttagagtacaggggaatcaaggatgaatttgcccaactttgttcactgttctttacttggggtcagacttacatcacagtttcttgtatttttctctcataaaatacttgcacatttaatcccatcttggcaatggcttcctagaggatatacatgtgtgtgtgcatatatatgtacatatgtgacagtatgacacacacatatatacacacatacacatatatatttatatatatacacacatacatgtgcataagtatatatatatatgtatatgtacctttgaatcataatttatctccatttgatgggcactagttaggtccaaatttttgccgttataaaaatacccatctatcccatttttctaattatttcacatttctttggggagatttttttttaagcttgccacagtgactgtgactgtcctttgttggaatacctccaaagaactcccagagccaatgccacacttaacacttgttttccacatgtatagattttctggtgtggcttcaatttctctggtaaatgagcttcaggccttctcatgtcagtgtgcagagtaaagaagtgaggatctagcctttcacaggatcctctgcaaggcagtgcagtaaggaggggaagggttttctgccacgtctgtggtctcttcattcttctcttcctgctgtcattctcgacctgggccctgctgtccttctctcatctggtatccattagagttcttgattacaagcaacagaaatggattctgcttcacttcaaccagagagaagttgtcaggaagatatcgggggctcacaatcaatgggcagctggaggatcagtcttgaaagctccggggctgggttgcaggaacatagtgaggatcttttactagaagagcctggtgagggaacctccaggataaatgggctccaggggatcttggtccttgcttcaccttcccaagattcaaatcctgggaaagagacacccacagaggcacccctaaggcagagggagactctaatgcctgcagcaggcgggcacctagaacttcactccaccaacacagaacctgatggattggaagtaattcccccaaatacactggggagatttgggaagaggaaaaaaaatgttgggctacaaaatataatagtaatatctagcagcacccttttatatatgtgcataatccttgagtttgtacatgttcggagactggccacaactgttgcatgataaattagtctttgtccaagtgaaaacaagtttcctgattaaaacaaagcctagccattgccagaagctgcttgaactaactcagctcctaaattgcatttacatccaagagcttggggttctttctggctgtccaaaattgaaatgttgtcagtgcaaggacacaccatccatcaatttcttctcagaggttcctctctaccttctaggactttgctatggcatttgttggctctccatgctggcctcattgtttgtctgtttgttcttgtcttggggaagttttctttttcagcagattctcaaacgtgatagcactgtcaacaaattaaagactgggaagccatccagaaaaattatacatgctgttttcactctctctcttcctgaatccacatcagtcctctctccttaatagaaatgttccattgttttatttcacttaatgacccctaccacattatcttctttaagaatactttactcagccaggtgcggtggctcatgcctgtaatcccagcactttgggaagccaaggctggtggatcacctgagattgggagttcaagaccagactgaccaacatggagaagccctgtctctactaaaaatacaaaattagctgggtgtggtggcacatgcctgtaatcccagctactcaggagcctgaggaaggagaatcgcttgaacctgggaggccaaggttgcagtgagccaagatcatgccattgccctccggcctgggcaacaagagcgaaactctgtctcaaaaaaaaaaaaaaaagaatacttttctctatctaattcttactttagggaaactcactttgagtcatcaccaaagcctgtctgttcagtgcaaccataagtaaatgctctcataaaataatggtaacgggtcaggcacagtggctcacgcctgtaatcccagctcttttggaggctgaggcaggcagatcacttgagctcgggagttcgagaccagcctgggaaacatagcgagaccccccctaatctctacaaaaaaatacaaaataataataataatggtaaggtgagcatgtatatgagatgaacttgcttttgccaaagaaaaaaatacacctgatatacaaatgaaatttggattcatggaaacaaattccagaagacagaatgttcagattatattcaggtaatatgtcagcattgtcattccaggtaaagatggctttgcagcaggaaggatttgaccgaaaaaagcgaggttacagagacatcaatgagatcgacatcaacatgaacgatcctctttttacaaagcagtggtatctggtgagtgtctttatgtccttttggacatttcccatcttgagactctggataaaagatgaattcctgtatcctcattattcactaggatgttagccagtatccaacccagtgaccctctctgtccccttacatatgtattgattttctgtcaccacctgtgcatctagttctctaatctgctttcttctggaactgctaagtagcccttgtctcctagggtggaggctatgaccaacaactagtggaattctcttcagttctgaaaaagtgcaccagtgtatgactgaagattagcaaaactatataaaagtcaaatcagaggtctgggaagagtaatgcaggggtttcaacagacagagtaacaggggacataatgaagtcacaggcctaaaagaaaggatccaatgactttgcaaggggctagcaagaaagcttggagactaaagtagcaaaaagagcatctattaatgcttcctaaaacaatggcaggaaatcaattccatggggcttaactgatgcaggcctggaggcactaaaacccattttgcctggtgaagtgagcattttgtgggtcaccaacagttcatcatgatccatttggattggccaagctatgtttaaaaagggatcagtgactccaaaccaacctgaactgcagggcatattgacagaaagggagtgactaatttgtaaatgtgaatgaagctgtattttatttaagattaaaaagtgatgaacaagagagagaactaaattacagccttgtggacggctacattacaggaattcatcacaatttcccttctggggcttcagagcttgactctgacttatgctttttggcatggaagtccgaaaatccaatatgggtaattgaatgagtgtacttgtattagttaggataggctaggtttgttgcaataatgaacaaccctcggatcacagtagcttatcaaaagcaaggcttgtttctcacttttgctacacgactaatgcttcataattgctcagaaacgcaggctgaccaacctccatctgagctccattcccacactgctttcataagcccttcagcaaggaaaaggggcaaattgtagaatttttaaaagaaactcttaaagcttctgcctggatgtgaaaaaatggcacatgagatcacatgtcattggccaaaatcagtcatccgccattctaacttcagagtgggtggagaggtgtgtagtcttaacatgtctttagaagaaagagcacagtaaattttttaaagagccccaatgacaatcatacaatgttttagcaatatcataacagccactgatcactgtgggcttttgccagtacaagctctgacttcattattttttttacaatccatcctggagaaaacctacacagtacaaagacacatgaagattgggagtggacatattactgtggaattgctctttgttttcctttctttcttttctgaaatatttttgggggccaggatgaggggccttaggatttatttttctgcattagaacatgcactaaaggtgagccagttttctttaattcagttcaacaaatacttttgaacaagacttagtgtggtggcactgaaattacaaagattaactaggacatgtcatctcctgcaaaagatattgttatttagtaagaagttatattcaaataagaataatccaaaacaatatgctgtaaattcaaaacatgaggtagaaacaaagagctatgaaagtgagcatttaattctaaatcagggagggtttcctgcaatagcagctctcttatggaaaaagtttaaagatagtgatctagttataagatattaggggattgaaactatgtttgcatatttacagaaaacagaaaacacaaagtgtttataccaaaaaaaaaaaaatggagaggaaacactataggtaggttgggagggacacccaaaagtactgtttcatggaagatgtggcctttgagctggtcctgaaatattagatggctatagagtatgtcaagtaaatatgtacatgggtgctttacaacaccaaactaataccattctctgctttgaaattcctgtaccagatcaatactgggcaagctgatggcactcctggccttgatttgaatgtggctgaagcctgggagctgggatacacagggaaaggtgttaccattggaattatggatgatggtgagtattttgaagcctgtgcctcatttggaaataagcgtgcctttgcttgccttttgataaaagttgtattgttttggagatgctaaccagagatggaacagcaagatactgggcatgatggccacactgcactgtgcccagatcttcacctttcttccaatcagtggtcctcaaacttgaggttgcacttaacaaatattttttgaattaataaataataagctaaacaaatgaataaatgaaagctgcctatcactcaaccataatttcttactgcttacactttaccttaaaatgtcctctaaactctttatattcaccatcaatttctctagactcacactatccaatgtagtcaccactagccatatgtgcctatttaactttacattttaattaattaaagttaaataaaatgtaaaattttatttcaattcctcaatcacactagcctcaagttcttgatatccacatggggctagcagctgctgaaattcaattccattttcatcatcacagatagttacattagcgtgactctacatccataaaacagcttttcagtaacaggattggagcttggggaaatttgactttattgctgctttcagaatgaacccttgtaaagtagcctttgataactttttattacagacatcccttacatgttattcaacctgcgtgcctaccaaagacttagcagagcttcattttctatagtttgtgatatgaaaaccaatgggcttgatgaattggcatttttccaactacacacgtccttggccctgccaagattgtggagaattgccgcctgtggtcgtttcactggggatgtgttgttgccctccatcacccatctgggtctgccagcaaaaagctctactgtgcattattgacccaattatatacaaaggctacacagagatgaaacagttgagcctttcccatccgaagatcctcaaagaacagaacactatgttccttaaagtgaggctttgaagcagaaatgacagaggaaaccaagaggagccagcctgcttaaaacctgcgttgtcttgtgtgggctcattaaatatcaacataaaaacaatgcctcaatgttttttgatgtgtgagacatttttaagtggatgtaaaaccttcctccagaggccaagggctctcacaagaagaaaggagccctgcatgagagtgtgtgtgctcagatgtcaggagtttataaatgtttcttcttttctcacacttgttcttgaaaactgttccaaaggggttcaggccagctcacccaggaaaacaatgcatcaggatttggggaaaacctacctaggagatattgtcatgaccatttctaacagcatatcctactgggtatccccagccggggatcagagaagccaccctaaaagtggcactaaagtgccaacagatgtgcattgctctgctcttaggaaacctccaagagtactgtagatgcccatttcagaatactttaactgaaagctctttgactgactcctaaagtcattggctcctgactcatttccacatgcaaaggcaagccctttagaaagtctcagcagaatttctcatttgatgttctttcttcagctgattaatggcctttgggttcccacaaaagtaaactctgccccccaattacaattcctggtttcttcttcattttagtcaattactgctgcagaacaaagaatcccaacattgagtggtttaaaaaacaaccatattattatctctcacggttctgtgggttgctggagttcatctgggcagttctgcaagttccactggagtctatcatgcaggtggagtcagaaggaagttgaccctggagtcaactagaggctccaatgggaggctgaaaaggctcagcctccctccctttccatggagtctgaggacctctcctctcacatgaggcctccagcaaggtagatggatttcttataggtggctcaggactcccaagagtaggccttccaaaagagaagaagcagaagctgccagtcctcttaaaggctagacctggaatgggcaccggtaactctgccacttatgttggatgaatggtcccagggccaatccagattcaagtggaaaggaaataaactctgaatttgtggccatttttaatgcatcacatgctattccatatgataactgaagaaaagtatccaagttcactgttgaatagcaaaatgagcacatttgggacaagggcagctccccacatggtgaggacaaggacagatgctcttgccatgtaattggccatctctgtcctcacagctagaaccgggaaggctggcaacatcagtactgcattctctctcttaacgacctgcacgcatgaatggtatggtgccatgtcccagacattttcttggcaagatattccaaaataaggttaaagacagacacagatgccaaccctgatacctaagggcaaaactaatgtcatattctatcaacattgtctctccacatgttggcctgtgtggcaaatgttcaatcatctgcgtgcagaagtttaaatttgtggacagccagttttaatcactgccctcccatctctggttgcccaactccaaactcagccatcatcccctctgctggatccagtgactcaatggatgctcaataaatatctgctgccttcacgtaggtacaaagcaatgtcatttccacatgctacatatcactaggagaggacctccatggttagctgctgtctaaaggggcagaaattatttcttaagggtctactaggacatttcacctatgtagatattagcaaggaccccatttaatgatgacaacttccgcccttttactgtaatggaattgtttagagttgggaacttgacctggaaaatggaatgtgatcatgacaagatacagggatggacaagagtcatccagcccaagagtaattcagggcagatggctggttctcaagatcacacaagatcagagaaggcatgggtcaaggcccttagccattatcagatggagccaaggaagtgagatggaaggccagcgagctaaggtcagagggagcttcaagctgaagtaagaataaacaactaacagtaaaaacgacgaacatttattgagtaatcactatgtgctagacactgcttagcattttggaaatacaaccacagttattccctaaggttggtattattataatcgccattttacagatgaagaaactgaggtttagggaggcaagaaactgcccaaagtctcacaactaattctaaccaccattcttggtacttgaaacctaatcctttgctctgccttcctggtgagactttatgaatgggagcctcattcaaaatagcattaggagatatacctaatgttaaatgacgagttaatgggtgcagcacaccaacatggcacatgtatacacatgtaattaacctgcacgttgtgcacatgtaccctaaaacttaaagtataaaaaaaaaaaaatgacaccaccaggatgtggaaattctccaggacaaaagacagttttttcaataaattcaaataaataaataaataaaagattcaaacctgaggaccacatagtcacccacacccttctgagagatttagaactctgcatcacatagaaaacagtaggaaggtccagcagggtgactgctccagttacttttgctgcataacagataatcctgtattagtccatcttcacattgctgataaagacatacccagactgggtaatttataaagaaaaagaggtttaatagactcacagttccatgtggctggggaggcctcacgatcatggcgggagatgaaaccgtgtcttacatggcagcaggcaagagagagagtgagagccaggtgaaaggagtttccccttataaaaccatcagatcttgcgagacttattcactaccacgaaaacagtatgggggaacccacccccatgatttaattatcccccaccgggtccccccaacaagatgagatctgggggaggacacagccaaaccatatccaaccccaacacttagcagcttgaagttgctatttatctttaatcatgattttgtggcacaagaatctgggaagagcctggctgggcactgctcactcagtgttgctcatgcagttatgatgttagctgggctgcagtcttctgaaggccccgctgggctgcacatccatgatggtgcactcctatcgctggtggttgttgctggttgccactggagctcagctgggaccgtcaaaaagagtgcccacatattgtgctttactatagtttggtcttgatgtcttactcaccagagtggctataaactctatcctgccccaacaggactccaggggattggctgtagatgtttacaatgtgccttagtccgttcctgatgctgtaacaaaataccttagactaggtcatttataaataacagagatgtatttctcacacttctggaggctgggaaatcacaaattcagtatctgataaaggcttgctctctgcttccaagatggccccttgttgctccatcctgtggaggggacaaacactgcgtcctcccctggcagaaggggtaacaaagggatgaactctctccctcaagcccttttataaaagtacgaaccccattcatgaaggcacagccctcaaaacctaatcacctcctaaaggccccacttcaaaatactattgcaactagggattaagtttcaacatatattttagagggacacaaacactcaaatctcagcatttcaccctgcccgcaagcaccacccccccgaaaatttgtgtccttcacatacaaatacactttttctagcccagtagccccaaaagtcttgatttgttccagcaccaacatcaaagtctaaagcccagagtctcatctaaatatcatctaaatcagagatgggtgaaactcaaggtacgattcatcctgaggcaaattgctctccagctgtgaacttgtaaaatcaaacaagttacgtgtttccaaaatacaatggtgagacaggcataaaacatacattcccattcccaaagggagaaataggaaagaagaaaggagtaacaggtctcaagtaagtccaaaatccaaaaaggcaaacaaattctgaggcttgagagtaaccttttctgactctatgtcccaccttctggacacactggggtgggagctgggcctccaaggctcctaatgaccgctcccccatggcttcactgggcacagctcatgcagcagctctcatggggtggagtctcatgcctgccattctcccacactggaatcacatgttagtgggtctgtagttctggggtctcagggcagtcccacccccacagctccactgggctttgtcttagtgggggttttctatggtagccccaccccatggcagttctctgcctgggccccgaggctctagggttagggttagggttaaagaactggagctcagagccagggttctgacatgctacgcatctcaagtgaactattaacattctacctaggaatgtgcacatggaactccttcctagttcctcgaggtctccaggactgtcaccgcttcctgagaattgggactattgtggattagactttccaagaagcttcaaattgatgataggatactaatgatttatgaaccaaattataaccaagtctttgtcatttctgtgccacatttattatgattggctggtgatcagtcggtacccccataggctgtgagccatagatagttgtacagctcaggttctacgtctaaatcacctgcggttttccaggaccgacactgtgcctggcattcactgctgagaaataaacaaaagcatgaagtataagaatgaatatgagaatattgtaagaattaaacataagccgattaggaagatgtgttcagtacctcccaccttaaaagataatcaaatatacaaaaatataaaagtactatctagttaccaaattactattttccattcttcagtccattattactttttccgaatcatgtttgttgtccttcacagtcgtatcaatcattctctttctcagaccaaagtcggtatctgttctaacttaacacttagtattcctcttaacctaatttaagatcgtttattttaattaggctaaatttatcttgttttaattctaatttccttctggtctcaaattatcttcttgctccagtattttcccttgacagagaagacactactatttattggaacatttttctccttaacagcttccattctcagaacatgaagccatgtttcaaaaattgacttcctgttggaaaatatattctctgggtgtgtctttttttacacttatttagataagttcgtttgatctagctaagtgtgaaaaaagacacacacagagaatatattttaaaatataaatatttaaaatataaattatatttttgatcatttatatttaggtataaattatcaaaatttttcacccaatgagttcacaaaatttaagctatcttaacaaatagaagcaatttaatttcaacacaatatgctgaaaccaagtggatattttttaatgtttcttttcttctgcatatgcacactactccagagatgtggtagatgttaggactaatgatgataagaaatagaatgtattaagtgtttactataagctgaagactttcaatgaattgtctctaatcttgaaaaccgctttgcaaagtaaataatagtcccatttcaaatacatggaaaccaaagctcagacagattatgtcacttggctaaagccacacaagtgttagtgtctgagcccagagtggaactggatccactgatttcaaagcctatgctcatccccaacttcaccccacagcctaaactgaccattttgctggggggatgtttcttggtttgcttttggggatttgtttgttgtttccttttagagacagggtcttgctgtgtctcccaggttagtgtgcagtgatgtccttatttttgtagagacagggtctcactatgttgcccaggctggtcttgaactcttggcctcaagcaatcctcctgcctcagcctcccaaagcaccgggattacaggcgtgagccaccatgcctgaccaaaattgacggtctttgaattaggatccagaacaagggttaacaacatttaaaaatatttgtctttaaatattctgatgcctttccctctgaagacttcgggaggcaagtgggagaagaaggcataatgatttagggaggggactatagtctcccaaactatagaaagcagccatagtgacagcaattgcttcactcatcaaaatcaacagtgaaacctaacacacgtaccgtagattagtgactctcagtccagttactcattgtataaccggaaaaaaaaagaaaaatttcttttcagaaatatgcatcctaatacaagctcttttggggaaggcaaatctctaatggtggcctagccttagtaagcatgcagtgaagatagcagccttgggacagatttaatgatacttctggcttttagatattgcatccccatatagttattaaatgcaccagctgctgggccaagcataccacatgcattcatttctttagtccttacattgttctcacccccagttgatcaaaaaggaaaattatcacagagtccaagcaacttgcctgaagtcttgcaggcagttatcagggtggttgggactcaaatgcctgtctttgactccacagacctacgtttgtaaccattatgctagatggtgtcaagaacctgccctgtttcttggagggttagatgctcaggtgtaactgctgcaaagcttatgtggttttgcaaacccaaatgagagcttttcaattgcccttggagtttcttgatgctttctgaggtccaagggtctgatggaactcagcagtgctcatagtccctgattttacccttggaacgactactgggcaacaagacaggccaccattcaggagaaagcagggctcctgctgagacattcaagcctcaggcttcctggaaagccacattctgaggagacaagcctcagctcccaaccagcaacacctcactggaaaccatttgccctttacctaatggcttttcttgcccagccatgttctcttattatttccatgccagagtacattctcctaatccattgctgtccatgccctgttaaataataatcacttttcctccccagggccggtttcatttcagagaaatgccagttgatgctttaaaaatgtcaagatttctacaaatctcttttagatcagtgctctgatgagccatccatctcactgtcacaaagctgtcttgggcagctgtctctccgctctggcagtgcagcccaccttcacacctccacacagaagggaggtgcaagactgggagctgtgtgatggggcactcacccccatggcaagccttctggcaccagccccataaagagggcactttcttgggcagctttcctgaggacacagtggcaggtattaacctttggttcctgtgttattgttgtcttttcacagggattgactatctccacccggacctggcctccaactatgtaagtacaagccaactttggtggggaaacagatgcatcttaaatgtcctggtgtccctggctattaggaacatgcacatgtctacatgtctatacacatgcatgcaagtacaggagcatgcacacacacacacacacaggagtacagctgctggaacatatgcacgcacacatggaggaacacacacaaacaggaacatacacacacatgcataagcacaaaagatgcacacgtactcataggcacacatgcatgcacacacagacagccacatgggcagccacactggaactgtccatcccattggagccacagctcaggccacaagcaaatggacaaggcatgtggcctggcagcaggcaaaggcagtggctttgagagaagaaagaaacctgacatctgaaagagcagagtgccaagaaagtaggtacagggagggggaagaagagagagacttggcaaggtttaaatcaactctacctgatgatattgaattgaagggtggaaatgagccatttgggttcttgttggacaaaaccaaaggcaaaaagccaaaaactgcagtgactcacattgcagccccagctttatgaaagtaagagcgttatcttttttgattatttgtgtcacttatgaccactccactgactttcccccataacattgagaattactatcccttgacaaacaagcaatgttagcagagaatcaccaaaagccctgctgggctagaaccacacactctaacttttgactcagcagttcacacgctgctttcctgatgaagcccacaagccctttaaacagaatcgatcacttattttaaccccagggagtacaagattcaagcattggtgcgttcacttaaaattatccaaactatttctaagctatacttctgagacctccagatctaggtgtaaaaaatgttgtcttagtcattgaagagactcatatttagagaacaagggcttgcataaaagaaaggatggttacccagcaaaaagtgtttggaggtcaccagtctgggtcatttgtcctggaaggcgagtgtctctacgttgcacaaagaaagggggaatattccatgtgtttcatgcactgggcaacaagaaacaaggcattcaagggatcttataaatctagaagagcataaattgagaggagcatcttttttaatattaggaaaaactattaaatgaatcattggcagaatccagccaatgtggccccagaaagaaatgacagaaattaaaccaaagctatattcccagcaatgataataatccatgtctatggagaagaccattgtaaactgcctgtgccagcggtcctgtgtgtggagtctgaggaaacagcccttctccctgtctcctcatggtgccttccctactgaacatgagtggagctgtctgctggtcttctcatgcacttccttaaagggactgccctggacacagtccttgctgcctctccctgactatggctgactccgctagtgccttcacctttccctgcctcctccataactgcagggccctggagatgtgtcaggcaggggattgagaagtgctgcattgcattttctccaaggctctgatgtatctggggctgttcctcacagagagcaagtgtggcagggatcatggcctccagggtcggtggtcctccctccgagggctgtccccactccaccctctgcagacagaggcattgatattctccacagttccctccatctccaggacccagtgcctcacagggcagccacgtggagttctgctcactttcccaaaccatacttggggaaacaatcatcttgtcacttggaggacttcaaggtggggtggtacccattgggctggagagctgagggcacatggcctgtctcctgtgcatagcataaccccacaaaggcctaagacatggagaccgacctctgcatccttcccttctccctgcctagcccaggcagttcctgtcaggctgctcccaactccagctgccagattcgaaaaagatagtcattcattgggggcaagaatcctctggggttccagtgagctgcaggtacaatgttagtggatggtgtgatccatctgccaaaaccttcatctgaaattggaatgtgaaacctccatattgagccgtgccagctcctctgagatctgcaataccagaatacacctgaagaactcttatcggttctgtgagtctcaagttcttttttcttcttttctttcttaagaacatttttctgattaaaaaataaatgcatgttatctgtcaaaaaatatgaaaaagcataaaacagattcaaaactagccataataccaccattcttattattttgacatatttggggcctttaatttctatgtgtctatttttaatgaaattgagctcttattgcatattcttcccttctgcttgatgtgccataaacatttttatgttattaaatattctccaaaacataattttaagggctacatggcattagctcatgctataatttatttaaacattctgatctccaattgttgaacaattaggttgtttccaatcagtgtttcactgtaagagggagatgagatggcagacagtaacatgggtggactccaagccataccatgctaaggagaactgaaagaactggaaaagcttttcctggaaaaaagaaaacaggcacattgagtatgttttcaaatatttcaaattctcctggtacaatgaggcattccacttgttcagtaatttctcccaagaaaattctcaccaatgggtggtaaccacagaagcaaaattttaactcagtcaaaggaagaactgtctagtgattaagatagtaaattattgggaggccaaggcaggtggatcacgaggtcaggagattgagaccatactggctaacacggtgaaaccccgtctctactaaaaatacaagaaattagccgggcgtggtggcatgtgcctgtagtcccagatactcaggaggctgaggcaggagaatcgcttgaacccaggaggcggaggttgcagtgagctgagattgcaccactgcactccagcctgggcgacagagggagactctgtcttgaaaaataataaataaataaataaataaataaataaataaataaataaataaaaataaaagattagtaaattaatgaaagtaacaaattcttcatacctgaaaatattcaagaggaagtttgatggccactggtgggatgttattgaagagatgacaatgtctatgctgaacttaaactagatgagacctaagaattgaacagaaaatgtgatttctgtgcaaaactgcgcatcttgataactttcattcagagcaaagtctgagtcttcaacttgtatcaaacacttggaagctgacaatgaaattatatatatttacatatggctgtgaaaatgttctgcctctggtatagatgagaaaactgaacacctaactacctcgtgcttgattcctcagcagagggcccaaactggctggtttttaatggcacagtgtctctctcaccctgtgtagagttcagagtggcaacttcggagctactaaccacactaatcttctttatttttaattaaaaattttacactatcattaacacaatgaggacagcaaatagagtagaccagcccaggagagcaatgaaaccagtagacagtgataggctcgaaaattgtttgagcagagaattagcaggcagcttcacacctcgttaagtgacctaatggcttggagggatgagccagcctggtgccccttgagagagaggtacttggtggagtctttgcttgggtttccctagaagcagactctgaagcaagggtttgagtacaagtaggttatttggaagaggattctaggaagcaggggtagaggacagggaatgagtccgggaaggaaaggtagcttgtaaacggggcagttatcaaacaagacagcactgtgggcactgaggcttaatctcactgggcagctctgggagacagcatagaatatgtgagccagagtgatcccccttgggatgtgatgcctcaagaagctggggtatttatgtgacaacttcgtcagtcattggttgagggcttgtcccaaaagatgttcctacctccccacagcctggggaaaagccctgggcagaggtgtgggtacagacagctgcagcttaccagggacatgagggtttcaggctgaagggggatgtagcaacgtctgccccagagatgccttggaaattcattaaaggttaaaataaatagacatgttctatgttgaaaaaactccttgtggttactgatttattttcagtgaggattgaaaactctacccaaggctcctcaaaaaaattactttataatcaaaccaaccaaaatgtttctgaaagcagaattattttcaaagcttggttattctgtatattaagagaggaaacagcatatgctggtagtccagtttattcccattaaactaagaataaaatacttggaaaattgcaaatcaatatataaatgtaagttgttagtgttaatctaattcaaaaaatccacactgagcctgctgagtgttgggagtaaaggataataacggccacttggattattactctattgttctatgattgaatttcatcggagggatccagtcccactggtaaaagttcactattccaaataattaaaatttttctttttctatcccaatagtcatgacacgaaatgagtattagccaagaggctattttagaccaggttaaaattataacctcctttacccatcttcgctataataactgggtattttctctaagtcaatacaatggctgtggattgaacctgctatgtgcaagccccagaggaagagagataaataagacacaggcactctctagagaagtcggcaggtcagtaaagatgcaagcatgtgagacatgactgtcaggtgaggggtaggcagacagggaggttcgttgtctctttactctgagctcccaatccagtgaggattgcaggctgggttcacagtacgggcccaagctcaggggttctgttaggtctatggaacaaagggagacttcttcaagaacatgtggagtgtgacttaggtggcagctttcagggcatggaggtgggtggggtagaacgtctcctgctttgtagctttgctgaagctacaaaggtgaagaaaaggctggtgggtctgtagaatccaaggagagccttcttgctgtgtgctgggttttctcagaagcagaccctgagacaaggatttgaaagcaagtcattcatttgagaggagatcccaggaagcaccagctgggaaggaggaaattgatgccagaaagggagagtggcccagagagcaaattaccccctagggcaatgggagctcaatctccctggggaactctgggaaacagtgtggaccgagtgggcctcagagttacccacaaactcctgtcaaccactgggtgaaggccactacccaggagtagagatgaggtggggagatagaaggattcattctagacaagaaaaatagggccctgcagacagagtcttcagcagagttgcatgtgctgacagttggaaaacagccagcttgcaagggtagggttctgacagttggcagtagtggaaactgagtcaaagctgagatgactcctggctccctacctcatgatgcagccttagaggagcatatcaaacatctttgaaccttaattttttcatccgtgaaatgggcaaaatggatgtcttgtcaggtttgttgcaaggtatccttgagataatatgcgtatcaggcctggcacataatagatgctcaataagcattcatttccttctgtctcagaagagttgaggttacaacgttgcacaatttcgggttgtcctgatggagaagcaggggtgtgcctcaagaaaccagtgcagttgttcattggacctcccagtgagcttagggtcattaaaagaagaaagggcaactgatccaggctaagtataagattgtgagggttgcaaagttaagggcaaaaatcagaggataccaacataaatctcaaaggctttgaaaaacaacatccaagaaaagagaaggtaaaggcagggagaagacccattgctcgtggccagggatgtaatgaaggatgcccccgaggaagcggcatttctgacctgcatcttcttccctgtcacataccttagaactagatgaatattcaaggatagtcataagggagggttaatccctaaggtgggcaaagggattataaggtagcaactaccccaagtgaggttttctccgagccagggaaatctcctggtatttaagccattgcagggtgggacatcaactcctgttctgatggctgggaggatgggccacttcttgcactccgtcttctagcttggaaactgtgagtgatgctctgagcagctccaagatcctgtgctgagaatctgtctagattcatgacacttcatgagcttttccaagaattcttgagtgcagcaaatacagaagtttgcattgactcaactccacatccttccctagaccacagcttctgccatgggactctgtagaatctccctttaaagaggtgaagtgtgtttcctaccccttgactttggattgggccttgtgacatgttttaagcaatagaataatctagaactgacagtgccagtttggagcctaggccttaagaggccttgtgtgctcccaactgcctacccacgcctctgccatcgccattagaagggcattcccaggctctcctgctgtaccctagaggagggtgagagacatggagaagagcttccctgctgccacggcctgaagcaccaccacccacactggcctacagagctgcagtaagaagcagagctgcctagctgagccccaccaaaatcaccaaacctcagccaacccacagaaacaagcaagccagccaagctcagcagagctgcctagctgagcccagcccagagcacctagctgccagctgaactgtggactcgtaagctatctaaacacctgctgttatatgctgctgacatattatggccgtttttgtgtagtaactgttacagctgcccatgctagacccccttctccatcctcctacagtacttgaggtgtaccccagtctggagagaatattggcttctaggcctatcctagacctactgaatcaaaatctttagggacaagcctcatagtgtgtatttcttttagaatattggcttctaggcctatcctagacctactgaatcaaaatctttagggataagcctcatagtgtgtatttcttttgaagcactccaagattctgatggttaacctactcattcattttggcacttcattcatgcattcaatcattcattcattcaacagtgcagtttacctataatgtttgactacatcacagttagatcataagctctttgtaaggaagtgtgtactttgtaagtgttttgtgtccctcttaacacttatcacagtgttaagcaagcacttaatacatatttgttaaattgcattaaatgttaactcaccaatattattgcaagtaataccaggaactaaattatatgatgaccctctatcgacgatgatcagaaactgcagcatgcacaaccctctgtgtaattcctagttctcaaccacctcataggtggatgccaccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggccccagggggcatgtggcctccatgataaaagggcgacagcaagaaaccggcacagtactcagccccgaatgactcagatgttatgaagtattgatcacatacattgcttctggcttttaggcctatgaatatttaaataagcacattaatattgcatatgaaactgaggcttaaataacctttgtttcttattgaaaggaagggctggcattttcaatgtgctcttgaatgctggctggatcatgatgagcactttagcaccagatcagactgaatactgagaatggggactttttaaaaatcactttgatagaccgtcagtcaaatgactatcacttaatgcaactcatgtactagaggaaactatttatttttacagaaacatactttgctttaaaaatagggcagaaatgaaaccttgcttaacaaaatgaaactacttgtatggacctaaacttacagctatagctgaaagcaaagaaaatatctggtcattctattatttttaattattcaattgactagtatttgtttcattgaacttagtcagcattcaagaaagccgtattgttcccactgtgcaaaatgctatactaggggcctgaattatgaagtgtgaaaaatccagtccctgaccttggggggttcacatgtaagtatataattacattataatatgcttagtgctaacctggaaataaaacaccacccatataggaatgcaatagctagaaaaagcaagtcagccctaaaaaattagagaaagaaagatacttaaatgcatttaaagaatgcagctcaccacatgggggatgaacttgttttcttgggtcgatacagcatatgaattcatctagaagcttcatcaatacgatactagacaaatgggtaattggatttcatctggagatttgcttccacctagaagcctagacttaaaaagtagcccacatcatttccttaccccaaattccctaaagcccttcgacagattctcatctctttgactaaatttaactggcttaaagaccagggtaatgtcttccaactcttttactcatgagagaatgaaccagcggcctcattccccacagagatcattaagagagacttcataaataaaagactgaattatggatggatggacggatggatggatggatggatggatggatggatggatggatggatggatggatgaatggatggatggatgattggatggatggatggttagatggatggatagatggatggatagttggatggaacggatggatgaaaagatgggaggatgctaatgagactattgggattttattccatttatcactaaacacacctgttcagaaaaagtgtagcaatgtttactgataagccacaagaaagtcatttatgcaaatataagaaaattgaaagattactattctcaactgcctttgttcctttctttgtcttcattatcggtatatacgcactgaattcccaaaatgtgaaatattttactggcttttttatttgggtttctatctcatagaaccaaaaacctttaggtgaccaagccttacaaataattaacttggcaataacccctggctacagctgtggttcaaaatgctgcttctgctgagctgacatccattttcactttgtccctctcctcatgtgcctgtttcccaatcatactgtcttaaagccacagttctgggtgtctaaggcaggcctgaccagatttctgaacccatgtcccccacccaggaggggagtagtgggttgatgccacagcaaaatgggcagtcatccacactgcttgcccatgtcttgttgccaagcaacagagcccaagtgggtgtgtccactagagccacacctacatgggatcattgcctgggcaaatgtggatctgatggagaccaaacgtctgatccatcatccaattacagttttctgaagcagcaacaaagaccaagaaacaatgcccaggcctcaattaagaaggatcagactctgaagccatggagtcttctaaaatatgatagaagataaattttgtggttgtgtcaaagaatcatgagtactataactgtcattttggctagagccccattcttacctttaaaagctcttaatcatttttccttgaagacaaagacttgatggtaggcagaattgtaaaatgcccccctaagatttccaccctctgctgtaagcactctgtatagtccctctcttgagtatggcaggacctgtgaatatgatgagatatcactcttacaattaggttattagattgcattatatggcagagttagagatttttttcagatgtcatcaaggcgcctaatcagttgactttaagctaatcaaaggaaagactatcctgggtgggcctgaactaatcaggtgagccctttaaaaggtaatctacaagtcagagaaggaaggagtcagagagattctaagcagtggaggctttcacctgttggccttgaagatgccactgccataatgtgaacagggccacatggcaaggaatggcggactccctgggagctgaggcctcactcctacaaccacaaacaactgaatgaacttgaaagaggaccccaagccctagatgagacagctccagtgacaccttgatttcagccaggtgagaccttgagcaaaagccccagttaacccacgtccagaaactctgagataaatttgtgttgttttaagccactatgtttgtaataatttgctatacagcaataaaaaaactaatacaaccttcttgattatagtggatatttgagcacaaactgaatgacttgctgtctctctgaattaataaaaatagaccactcctcagtttttactttttcttaatatgtttgcttttatctcaaaaataagtatactctgcctattgccacatggggccctttcataaataataattctgctgcaatgagaggctcagagaaatttagtgaggaagttaagaagagctcttgggccagcctcgctgaattcaaatctcacgtccaactgcttcttaactatgtgccctaggcaagttaatctctctgtgtctcaatttcctcatctgtaaaatgggttaataataatactgatcttaccggtgattgtgataattcaattcagtagtgcacacaaggcccttagaactgcctctggctcataagacaccctcaataagcattcgatgttgttaagtcccctgcccaagattgcacagctagaattcagcagggaagaacacaagcctaaggtggtcagacctcaaagtctgttctcttagcctccccctcccttcctgccttaaggacacatatgaatttgcagaaagcattttttaaatgaaattaaaaggggcaattagtgcgttattctaagttttctttccactttcctgctaacaactagtgtgttattctaagttttctttccactttcttgcttccccagccctccctgtcctgcctcccagaatactttactggtttcccctgggagcacatccttaataaatcacttgcctacaagctttcatcacagggttggctcccaggaatcctgatcttacattagagcggtctggagctttaggcaaagcagaattttccatcctacatggccaaggcggagagaatctctgacatagaaataagattagcttctccaccatggtaaccctgctgctgactcccaacctacgggaaattatttttcacaaagaaagaatctttaattactaaccaataattaaaacctgaagccaagaacaggaagccagactttggctcttagcaatgttccttaacatcaccgggagtattatggtgaggtctgcactttccatgtggcatgcacacaacctctccacaatgagtgctctgctaggcagaagaataagatgtattacagtgtgtaggagatgttttcattaagctatggaaagagatggattatgttttataactcaagcattgccaattttttaaataaggagttcagtgtaagtctaagctattcaaagagcactagttcacagactcccattgaggtactgcaagccaaaaaaaaaatgcgttgtttgatctttatggccctcagtttccccatctataattgtcatccccaacaagattctcattgtctccagaatcaaaagagtataatgattattcatatggctgatatgaacactgggtctttgttgatcaatcaaaaaatagaaattaaatggaacttctgagaatgttcaaggcgttgaagctattctggtatgggtattggaccaccctccctttttttctccacaacaccccacaagcatacacacacatattctttctctatcatgtaaagaatgttccagaacactaggtggaaaggagccagtccctgtgtagaggcctgtgtggtgacagatgggcactgagtcatttgatacagtcagcaccttgcaggaattcttaccaggcactttaccaacaaaaaatatattatctgtgaataaaaccatggccaaggctattaaccacttcgattaatcactcacaagcggtcacaatgatcctatactacatggcagctttattggggagttttgacttgttgcttgcttgattattaataactcgcaaatccatctctcctcccgtggagagttggtagttggctaacgaagtatgagaaccatgtgttgtctcccacctcttctccctgccgtggttctgatatttctccattgatttctgtggaatagcaggagtgttagttcccagaatttgttgagtatttactgtgtgtttggccttgtgttttatatgcatgatcacatttaatgagcgtgttaagccagtgaagtgggtactttcttacccacctgtcatagacgggaaactgaagatcagagaggctagtgatttgccttagctcacacagacagtgagtagcaaaatgtgaagttcaccatctgtcatgctgccttcatttaacctggccccctccagtctcccacatcttaccaaatggcatcgccatggtcacaatgactaaggtgctaaacgttaccatccttgactgctgctcccttctttttcccctcagccaccctatctgccagttctgctaggcaatacacctgcctctctgttcccaccactggcatcctggaccaagccagcatcacttccctcctggaccccacaaaagtttcctgcttccactcttaccctctgcaatgcattctccccaaaacaagcagaaaggtcgttacaaagaacaaagtagtggaagccatatcacttccatgcttaaaaccaacaggtggctctcccccttccctgtgagacttagcctgtttgcctttgtcctgcttactcacgatgaaccagactctacaatccaggattctccctaattaaaggcttggaagactgtcacactagctcttcccacagttgagtccatctcaacttatattgcacaccctgtgtagccacttcctagttcttaagatagtctgtggttctgtatttttgttttgttgcatgtgttcccccattagaatgtcagccccaggaggatgaggccacggggatctgacctgtcttgttcacctctttatccgcagcacagcaccatggctggaaccaagtgagtggtcagtaggtatctgtgagatgactgactggctgaggattgaacacttggctttcctctttttcttttgccttcaccttttaatttcttctggccatgctttctcctcacatagctcctatctctgtctttttgctatgcttctccttatttatacctcagtcaacaccagcattttgttatgaaagaaaagctgcaggtcagtgccacaaagaagacaatttccccaggaaatgaacacttcagtacttctttagtaacttctggggagaaatactatatttcttcatagctacaaccaaaaaacagaaagcctctctatccaagactgccttgtccatcccaagaaaacagagaactacagaaagcagcaggaatgattcccttgatgcttttaattcattcatttgtgttatatgcaattaacaataggccaactgatttctcaaagcatgcaatttcaagctgaaaaattaacctaggttattttccactcagttaagtatcaaaaagattttgaaaaataaaaaaaagaaaaagaaagaggaaaaaaaccaacatgagcatgttcttaactaatgagctatgcttatccactgttccactagaagagaattttccaaatatggacactctattcacaagtctctcttgagaaacgtggtgttacagtgtcaccattattaatattaaacttgatgcaccatatttacaaatccttccaaagggaaacaaacctgccctggaaacaatgcttataattataatcgtggattctatctgttcctcacagggaatgcttaaaatatcaatttaaatgcaaatgaatcttatcattccaaattagactcatcccattgtgttgaaattaatatagaaaataacaccgaacaccaaattacaagtaattaatattgacactgtgaaaagtatacactctcattttgatatttggggaagaaagtcttgtctgtgcgtgtgccattgtgtcctataagcaacaactagaacacaataccctcagtgctagtaatcatgcaggattaacacagcaaaaatctgagagggaggacaaatggcaatgatacatcttagaatccagtaatctattctttgggtctgaggaaaagcacttaaatctgtatttaagtgactacatactatttaaaaataaactatttgaggccaggcctggtggctcacacctgtaatcccagcactttgggaggccgaggtgggtggatcacctgaggtcaggagtttgagaccagcctgaccaacacagcgaagctccatatctaccaaaaaaaaaaaaaaaaaaaatacaaaattagccgggcatggtgtcacatacctgtaatcccagctacttgggaggctgaggcaggagaattgcttgaacccaggaggtggaggttgcagtgagccaagatagtgccattgcactccagcctccccaacaagagtgaaactctgtctcaatcaatcaatcaacaatttgagtcttaaaaattaaaatatttttcataggctgaacacagcggcccatccctataatcccagcactttgggagactagggtgggagtattgcttgagccaggggtttgagaccagcctgagtaacatggcaacaccctgtcgctacaaaaaaattaaaaatttgctgggaatggtggtgcatctgtagtcccacctactcaggaggttgagacgggaggatctattgagcctaagtcgaagctacggtgagccacaatcacaccactgcactccagcctgggtgacagaacgcaaccctgactcaaaaaaataagaaaaagtatttctcttaaatgcaaaggcaaagaggacctttctttgtctcttctgtacctaacgtaagggttggctaactacacagattctggccacctgtttttgtaaataaagttttatcggaacgcagccatgctcacttttttacttgatatctatggttgcctgcatgctctaagggaagggtggagtagttgtgacaaagtccatatggcctgcaaagcctaaaatttttactatttgatcctttaagaataggtctgctgaaatcccctggtctaatcagttgtgtgtcaagatgtaggaaaatggttttgttagaaacttaagtccagagagcttcaaaacaggctccagtgacagctgtagcaccttctagcagtgtgacatctggaaaactgctgaatatcttgggggcatagcaccctcatttgagagctgagaaaattgaactcttgtctgttgtaactctaaaatcttatgaaactctcctcccttccaataaaatccctgattaagaaacaaaagctgaattagttttgttaaggaaatggaatcgtcaagtagtttgaatctagttaatttgcttttgagaatgacagacattaagtcaaagtgatgctccttttccatgcatgatgctgtatacactaatcactggggctgagtgatttcaaagagttttgcattcatttactgtcttagctgggattcctccaaaagctgactgtgagacatggatccacaaaccagcattttatttggaatttggtgccaggaagcacaggtaggggagcaggggagtgaaaaagtgaaggaagtcaatacagggtgtgcacaagtgtgtcctactgtgggcaacaggagctcagttctgctaagcacccctagaacatgagttagaacacatgaaggagaaagagtacaagtatgaacacaccaactcttatccatcattggttgatgattaatatcaggatggagagaggaacaatttcctatacttctaagctgccatatcattggtgaatttgactccagagataaagagataaaatgctgacagatggaagttgtgtcaatgtgcactgatatgctcaaagcaaggagttattatggatggggcatctaatagcatctaggacacttacaaaatcagaggtctccaatcacacatccctatttgtaaaacaattttaactaggctctcctaatacatgtatagctatttattcagacagtatatgtatgtactactatcaatgggctatgtacattataaagcatatccaagaaagaaaattttaaaggataaaatataaataaatattaaaagttaaaatgcacactcatgttcatggtaacattattcacaatagccaagaagtataagcaacccaaatatcaatcaatcaatcgatgaatggagaagcaaaatgtattacatacatataatggaatattattcagcctttttatcaccttaagatcctaaggtcctaagattatttattcagaatttcaggaaggaaattctgttacttgcagcaacagggatgaactttgaggacattacactaaatgaaataagctagtcataaaaagacaaatattctgatcccacttatatgaggtatctagagtaatcaaactcatagagacaaaaggtggaaaggtagttgccagggtctgggttgagggggaaaatagggagttattgtttaatgggtatagagttttagttttgcaagatgaaaaagttatgaagattgtttgcataggtacttaacattactgaactgtacacttaaaaatggctaagatgatgaattttatgttacatattttttaccactattacaatgaatacatcgttttttaaatcaaggtaaaacaaggcttaaaagatttcctcccaacactccaatggatcatccagcacatcctcccaagtgagcacaatccacttttgagacctttgcactaaatacctagtctgtagccctgccctcagtgtaatcagcaaaagattctgtattaaaacataaaatcctctgtccagctagatgttaagatctctgtctttaagggagataaaacagaataataggaatggcaccaataaggatcatgcagacaggtagatctgggtccaatcctgcctctatatttagttactgtgatttgaaacaagttaattaacctctctgttgtacacgttgtacattcctgagatataaaagaaggatagcaatatgccttcatgttttcattcaacacctagttattgagagctatgctacaccagaaactgtagtatattagttacctattgctgcatctcagattacccccaaaacatggcagcataaaacaaaatacatatatatattttgtttcacaccgtttttatgagtcagaaatttaagagcagtttggctgggtggctccgtgtttctcgtgaggttgcagtcagcatgttggccatgactgcagtcaactgaagactcaaccagggctggaggatcgacttccaagatggttcacatggtggctgttggcaggaggcctcagttcctccttgcacgtagctctccacaaactgcttgagcatcctcatgacatgatagctgacttcacccagagcaagcaatctcagagagggaccaaaatggaagctacaatatcttttacgatctagcctcagaagtcacacaccacaattttgaaatgtcctattggttatatgggtcagccttgttcattgtaggggactgtatacaaggtcatgaatatcaggaagcaagaatccctaggatcccaactgggaggcggggacaagtggctgaatagagcagacatagtttctaccctcaaggaccttagcaactagagggtaaaatagactccaaagaaataactacagaaataattatgatctaggtgctttgctacagcggaagagtactcggtgatataaatgtgtttaatatggagaaccagatctgggctgccagttaagggaagatttccctagagtagctatccctatgctgataccttaagaatgaggaggagttagccaggaatctggaagcagaaggaacagcttgtgcaaagaccctgaggcaggaacatgctcagccctttcaaggatctgaagaaggccagtgtgtgtgtgctgggggaaagaagtatatcagtacgggaaggaaaaatatggcatgagatgacattggagaagtagaaagagaaccgactgtataaactttctgagccatgaggattcataacttcatcctaggagcaaagggaagcttcagggtggcagggagggggaataacatgcctagatttggcatttttcaaagatttgcctgctaaagagacagattgggagtgaacaagaaaggaggcagggagagcagatgggggcttttctaggagaaagattatttgccaaagagctgttatggttaaaaggaagatagagagagagaaagaatgtagttaaagcaccctgaacttcagaggtgctccctaaatagtctttctctcttcctcttaaaacagaaaccttcagggacacctaacataagatgatatctgcaaaacatatatctctaaaaaaagcagacaaaaacacaatcacttagcgcgggcctcattaggcacctcataagttcaggcactagggtcctgaaggagtcttgtgcacaggaaattcaggaggggagtcagcagtgagcttaaagcctcgctccaccaccagcaggaacccggactgacccacagagagcgctgaatagcatttatgatgcttaatcagaaagcatgcagcgttgatctggaaattaattggatgctcggatttttcgcacatcatggagagttagatgttacaaagattttgacgggaatatatttagtaacagtatcactgatgttcagtctcaagcaggggcctgtatctactctggggctcattatattctgagtgacaacgggtgcttagtaaatctcctttgattatgatgatcaaccaagtcactcagagtgtctttaatagataatgagaaattgtaccagagttggggttttctaaatatgaaatcaaactgcaattctcatgacccactgtgcttttatttatttaatcatttttacttaactgattcactattttaataggtagttttaaaagttaactctacattaccgccataaatggaaaatctcacttgccatataaataagacaatcataaaaatagataccgtctacccctaaaatctgccatgtacagctcaggttgggcacagcacaccctgagaactgctggacctggatgtgcttgtagtcaagggtcttggaaggaacagccgtggtcatcagttcacacagccaggatacaggggatatgcccttatgtgacatagggcatatatgatatagagtatatgtccacacattccaatatcaatatagggagagaatggtggagagagaaagggagatctctcaaattaacaacaatgaatatcgactgaacctgaagaaacagatgctctttggttcatggaaagggtgtgaacagatgctcaggcctgaacactgctcagactttgcagcttcagggaccatcggctaagagacttgtcttctggacttactgcctggggtaaggaccagggctcatttatcttatctctctaatctggggagctgtgaggactagaatgggtaagggttcagtgcagggtttacagctgctgaaaggtccctgtagcatttcctttatggaaaatcctatggatatacttaaagataggtatttgtgagggtgaaacctacctacaacctcttacactgctagtgcaaatgtcaaatggtgcaatccctttggaaaaagtttggcagtttcttgtaatgttaaacacacacttagcatacaaccagcaatcccactcctaagtatgtactcaagagaaacaaaaaggtatgtttataaaatggcatatacatagcagctttatatttgcaaaacttggaaataattccaatgcccgtcaacaagtgaatggataaataaaactgtgatgtgtttatacagtggaatactatcccacaacaaaacaaacaaactgctgctgcatacagtacaataggcaaatctccaaatgttgttagctaccaacaaagacaaatgcaagagtacatatactctctggttccatttacatgaagctctaaagccggcagaattcagatacagcgatagagatcagaacagtggttgcctaaggtaggtgaagattaactgagaagggcatcatatggtgagacaactcctcaaggtgatgacagtgtccactatcttgattggcatgatggtgactcagatttacatactgctaagatgcagcatgcatgcttaagatcacatatgctactgtaaattatacctcaattaaaaaacatgatttaaagcacaacctataagcaaaagagccagtttagaaatcagttaccaccaaaaatgccctgtgaatgtgggaagaatgagtggagaagcctgcccatgtcttgcctcagaattttcactgcccacctgctcacctccctaggttgtctcaggcataaacgaagatgatagatgtcagggcacttggaaactctccaatcgctgtacactctaaaaggggtctagtttaatcatttgtactaatttcttagaaatgcatcactcttttttccttatttgcctttttaatatagaatcaaggcttgctcatcatcaaaaagattcaaacattacagaagtgtagataaaataaaaactgcaatttcccttctctctcctctccttttcctcctctatacaacccactcactttccaattttggtgacgtggcagttctgcatggatctttccagattttttttctcccccaactgcaatcatacagtacaccgtatcatgcaacctgctcttttatttaacaacatattctctccaacagtgtggatattccgtcatttgtttaaccaagcccctaatgattgacattttgggtttcccctaaagttttgctgttataaactacgagacgaatgtgtttccttgatcttcttcaaatccttgtgtgaatatccctttagaataagttcttagaagtgaaatttctgagtcaagtagtacatgcaatattaattttaataaaccttatcaaattattctctgaaaagattgaatcaatgcatagtcctcccaggagaatcccttctcattttgatctcaaagacaggaaaaataaagttgagagaatgctgaaatattcaaagattctccgatgcccttgaaaagcagaagtggagctgacatcaacatggccttattttcgctgctgacttgaaacttccataatgaggaaataaaacacatgatttaaaaaaaataaaaaaactcatcaatgagattaatgagagttgagagcctatgacttgaacatttgctggttaatagatgtagggatggaaacagtgttgtgccaattactgtaattaaccagaaatgaagacaaatggaagggagcctcttctgcccaccaagcttcaacttaaatgctgagtcatgagctactagtggaggctggaaggccaagacctgggctagtgctgggaaaaggaagtagctcttattctcccaaatgtgtgctgggtgctcagaaacagagacagtgggaccccatctctacaaaaataaaaatttaaacattagctatgtatggtgacatatgggtgcctgtagtcccagctactcaggagactgaggtaagaggattagttgagtccaggagatcaaggctgcagtgagctatgattacaccactgcactccagcctgagtgacagagtgataccatgtgaaagaaagaaaaaaagaaagagagagagaaagagagagaggaaggaaggaaggaaggaaggaaggaaggaaggaaggaaggggaagggaaagaaggaaaggaaggaagggaagggaaggaaggaaaggaaggaaaggaaggaaaggaaagagaagccatcctgtcaaggagtcccaaatatcccctgtctcatgtagctcatccttcaggaaataggacactttccaactaacacagttaggctatatcccccaaggtattatgtttttccttgaatggagtcaaacactttctaaactcgagagaatatggccctgaaggaaactacgcctgttcctgtgatgaaatgacctgacaggaaagaactcagcatcttgctgacaagtcaggaagaactcacaacctgcccagtggtcattttagtcaattttggggggaaacagttcttttgaataggtcccctaaaaaaggcttgaaagaagaattagtacattccaaagcagtgattagaaatcatcataattttctaccaggagaagagcactttattattacttaaaattactctagtccaatagccaattgctatattttatgttaacttttatttacaggaagtacaatgtattccttttggtgcactgttccatgagttttgacaaaagttcatacagtcaagaggcagaacatccccatcacccaaaaaactttcctcctgctgccccttttcccactcgcagtcctggcaaccacagatctgctttttattcctacagttttgtctcttctagaatgttatacaaatggaatcatacagtatacagcctttgagtctggctttttcaagcatttattctttatcaatgtggttgcatatatcaataacatgttcttttttattgttgcgtagcattcccttgtgtgatgtaccacaatgtgtttatctgttttccagtctgggaacatttggataactttcagtttggacgattataaataaaatcgttatatacatctacacacagatttttgtatagaatttagatgtcctctgtcttgggattgaggggctgtatggtaaaccaactgctctttaatgtctagaaaatgtgacagtcctcagagtcatggagcctagaaaacagtgcggttgtccctggagttcagaatgctttactctgtaaatatcattcttacttggatagccttggtctgtgagtaaatgtgctatgataggcgttgtgtagccgttcatcccagctctgtccccagaatcagataaggactcatgctgtgaactctgatgccttcagtccaatgagaccagaacatcacttgcccgtttttattttaggtctcgtgtcaagctaagctaagatacttcattcctttttcttttcccatcaaattttgtatcttaaaagtttcaaaaaaatttataagcaagtatatctcaagatttttaactgaatgaaataaatttaaataaaattctgagtatttttccatttgattttttggaaaatatatgcagttcccaaatttgaacaataaatgtgcatttataatgtaagattatgctcccagaaagctaaaaaaaagttagaattatcataattacataatccctattatacttcaactcttagacataatttttaatcatttatcttcaaaaagatgaatatttttaaattttttttcttttttttcaatcactattaagcacagttgagttaaatccagtaagcattctgttgggactaaagattttctgttcaaagcacacctaatgatttctctcttgtttcaattgtattaaatttatgagacctctattttatctctagtgtcagtttatttcatttccattttccacttgttttcctaaaataacaacaaaatgcaattaaaatgtgtaaataatgctgcttacaacacctccatagctaagtgtggtataaataaaagtggtatggcactagcacattaaaaaaggaggcttgaaatatcaacatttaatgtaaaaaaagtacaagtacagtaatggaaagctgaatgtttaaagatttggaaactcttggaagcatgcttgtgttgctctaccgaattccaaaggcaaacagttttattttaataatttcgttagctgggcatggtgacatgtgtctgtagtcccaacaacttgggaggtggagacaggaggatcgcttgagcccaggaatttgaatccagcctgggcaacatagcaagaccctggatctgttttctgtacctatagttttctctatgataataacaaaataataataattttgttaatgttcagagcatgagtgagctccacctgacaactcttataatgtcaaatgatactgacgtcaacaaaacaacttagacaattcttgaaatttgcttatttatctgatacatttgttgagagtctattatgtgcaagtggtatcaagtaaaaaacccagtgcatatccttgaaccacttggagagaactggaggggatggaaaagcgagggatatctgttcacagcagagtgtcatgtgggaagaggacatgtccttgaaccacttggagcgaaccgtaggggatggaaaagtgagggacatctattcactgcagagtgtcatgtgaggagaggacaaggaacagggaggcacgggggttggatgagctctcttcctggttcttgaaaatgccacgaatgttggtggtagcaggaatggcaaagagcaccatgagtcagggacgtgtcatctccaaaaggtctagggcagagtatttccttcccaagaaaccagtgtcccataattcacctgctggaacccctgtgcacaaagggattgtgtgattaatgtagattttggtgtttcatattgtagcaacttaataaggtatgtgcccagcttctaaatgaaggctataatcacttttccatagtttatgaattatgaagttggattcccatcccaaatgctgtccaagttttttggcttcaaaaccaattaaaatgatgaatagctgtgaaaagaaccagaagtgcatttaatctttcttcagaacagttggggatcagttcttttttgtcacatttcacattagctgggaacataaacttggtcttgttcaaaggttcaaactacttcttcctgaaagagaaccgatctacttaactttttttttccccagctattataaacactgagatatttacaaagtgccttgtacttctttctgtttatctcccaaggtcacgacactctatttgcatcttctcttagcaatgttatcctaaaaagaatcatcaaagcaaagattaactgttacaagaaaaaacaaataagcgagaagattacttacaaatttcgggggttggtttattatggatgcaaaaatgagtagaaactcaagtccctgagtccacctttcatgacggtagtcctgattttgctatcatttaatacaacttaggtcttaatgttctcactcagtgctgagtgtgctgggataagcaaggtgttcacagtcttgtacatttttttctttactttttatcataaaaatgagctgcagatgtcatgcagtgcagagagaagagaatgctttctgagtcagaaggtcacattttttgtactcaaccacttctagctggaaaaccttgagcaaattacataatctcatggagactcagttttcttacctgtagaatgggggttataatatttaattctcaaaactgctgtggggctcacacaaaattaatttgtgctgaattacacatatttgtaatttatacataaaacttatatgtatatgtataatagcaacagacccctgatacagtatttattattcatatacctgtccttttgacagaaggaaaaaacatcatctaagatgtgttttagacaaagtttccaatcaatgatatttggacacaacagccccttcgatgaggtgactcagctatcagtgaactcatctttgctatttttagagctgaaaaaggagaagcaggtgatactgaagttgtgtaatcagtctcagggggagggctataaactagtgtctctgtctctctcaggacatctggactcaaaggtagtggcctcaacctcgccagccattcaaaggcaagcagaactctcacagaggaggcaagggcggagaagctttgagcatctctacaacatcagagaacacccagtcaaaagagagggaaacacaaattgacttgtacctcatcaccttgacaacacaaatttagactctggctgctacattatcttctggttccttttccggagctgctctccttgagctgatttacacggttgctattgtagacccttgactgtacacccagtctttgtggaactccaagaatcaggcttcaattgtactttgagccagctacactgggccccttcaaccctcagccttctctccaggcaagtccataactgcagctgtggtaagcccatctgcaggctgccctcttcctgtcctgagtcccggagggcatccctgtgtgatcactggccttaacctctcattaagctatcaaagctaccttccactgcttttcttaaacccacgtcttttctatttccttcaacttcaaattagccattgtttccacatcatcctctcatgacatgatagggaatgaagtgatgatggctcacagcactgctggggctgcttttacaagaagctcactcaaagtcaacttattttttttttttttgaaacagggtctcactgtgttgcccaagctaggatgatacagttgcacaatcatagcttgctgcagcctcaactcccaggttcaagagatcctcccgcctcagcctcctgagtagctgggactacaggtgcgtaccaccatgcctggttaatattttttatactttttgtagacatggagtcttgccatgttgcccaggctgagtcaaggtcagttttgtcaccatggggggcatagagagacctcagcagtgaaggcctctaggaaatgggagaaatccaaccaggctggaacaaggctgggagaatcggccagttctagggcagttgcctaagtagaatgggtcatgaattcgaatctgcttcaagcgatactcaggtcaaatttggacaatgaggccaagcaaagacttgagcacagaatcaaagcacacctagagttacctatgtgcatctccgtttttgctaaatccaaattacaccttactatactgttaacttttatttgtctatatcatttgttggaatccagaaaacatacattgtttctttccaggaaaaagtcaggtataaaaataagtgtgtgttgaaatataagcacattttaaaaagaaattagctcctattctcattcctgcagcttggcattgagtttgtctgtaattgggtgtgttttaaaattaaaaatttgaaataaacgttaagcagcaggagtcaaaaataattcagaccgtaatattcatcaaaacttgtttaatagcaggaaaccctccactctgaacttttactcttctttcttgcagaatcaatccctccagcagccctcaactaccagaagcacaaaaattcaatatatttttttttttgagatggagtctcactctgtcgcccaggctggagtgcagtggcatgatctcggctcactgcaacctccacctcctaggttcaagcaattctctgcttcagcctcccaagtagctgagattacaggtgcccgccaccatgcccagctgatttttgtatttttagtagagatggggtttcaccatcttggccaggctggtcttgaactcctgacctcatgatccacctgcctcggcctcccaaagtgctgggattacaagtgtgagccgccgcccccggccaaattcaataatattatgcttagtagtcacacactttctcttgttttcttttgttttctttggctcattagacctctccttcagaaccaaagaaatccattgtgacaactctgttctcagagctgactttttccatagagagaacttcagtctgagacatgccaaggagttcttgacgctcccaaaattaacacctttcaatctttactattagagattaacttgtttcaatgcccattctcttctgttaaagcagataatattgggaaaggcaatgtctgaatgtatttctgccaagatgtcgatggtttatcaaaatcaatttcttcctgtggaagagtttaggtgcaaggggaggagagaaagtgagagaagattataacagggaggctatggatgcagaaaggaaaagcggggaatcaaaggcaaacctgccacccatttcacaaataaaagaatcagtgtgggctggatgcagtgtctcatgcctgcaatcccaatactttaggaggccaaggtgggagggtcgcttgaggccaggaatttgagaccagcctgggcaacacagtgaaactctgtctttacaatttttttttaattagccaggcatgatggcacacgcctgtagtttcagctactctggagactgaggtgggaagatcacttgagcccaggagttggaggctgcagtgagggatgattgtgccactgcattctagcctgggttacagagtgagatcctgtctcaaaaaaaaaaaaaaaaaaaaaaatgcagattcagtcagtctgggctggggcctgagattctggatttctgacaagttctcaggtaatgtcagtgctgctagtacacagatcacattttaagccacaagaaggctaggatatgaggtatgaacaaaggtgttagctcagtggttctcaacctggactatacatcagaaccaccaaaagaggttctgttgggtttgttggaggtttgtttttttttttaagctcctgatgctcaagccccaccccagattaattaaatcagaatctaggaattgctcaagtatttgtatttctaaaagctctccaggtgattctcttgtgcagcttgagttaggaaccactgttagttgataactgaaggtgctattaaaaattccataatatatgagctcatgaaggctaatgagacaccccagctaagggcatcttcctctgcaacagcaatttgctattgtacaatgggggcaaacagttggtgctcaataaatttgttcaatgaaaaaaaataagtgattggctgaatgcatgaatgaatggaaatgtttgaagtcaacagtctatggaatgaaaaggattacagtcctattatcaaaatgacaagtggcaggatgggtattttaagacagatcatcttttccatcactctttcaaataccccatagaagtacttaaatcttggcccacttttaagcctgactttgttaataactggaggagtcaaagccacaaattttccacaccattactttattccagtgtttgccaaaccaaccaacagtcactatacacttttgctactggtgttattatttacctagtatgtttctttaaattgacttactttttaacataaacaaatgtattttaaagggaaactataaatcactatttcaaatagaaaagcaactaatattccatgacatcagtagaattgacagtcaaaataaatgcaacgtaagcaactgaagcagggtgtttctgcctgccaatgcttgcctctgtcagataagaagaaggattaacaagtatacggaggtgttaaagccatgggggcacttagcagagactttgtcactggcataataaggattgcaggagcgttttgcaaggagccacagtcctgccgtgcgatgccatgttatttaacatgaaaagcaggcaccacgtgtaagcatctcatggcattttcagtcaatgattgtcaagctgtactcagaaacccaggggccaccaggtagtgttgaagaggctctagaaaaaagaggaagtatttcagattctgaggaattcagtcgtcagtgttatttgtcttatagagagtatgatttttttttaaatcctatttctataaggaacaacataatcaacagagaacaaagaaacaggttgaaccctgccattgaaatcaggagaattaaccttctcattggaggcatatttgctggtttaggcctcaaaggcattacatcaaccttggatgagacaatttactaaataaaaccatgttattaaaaaaatgaatggaccatacaaaataatatatttcatgtgctcccctagctctttagtgaagtatggccctctgtgggaggttaaattattagctaaatgtatatacttggatttaaacagaatgatccactgatgttctaggaagtaaatgcactaacttattcttttttatttgccaggtatttgcttttcttttaaataatgcatgcagtagaatatgattaatataattctgatgcagaaaagcaagattgcacacttaggagagaggtctctggagccagactgcctggtctaaatccctgctctgcccttcatcatctgtgtgaccttgggcaaagtattcaacctctctgtgcctacactgccctgcttataggatgaggatgacaataagggtattacccacataaggacatcataaggatgagtaatgcatacaaaatatctaagagtcccctatacaaaatacgcactccatatgtgctacctgatatcattacagtaaaaaaaaattacacaaaatgtaatttttactaattttaattacaaaatgtaattaaaactaagtcttccttccaccctagaccccacgcctctccccaggcaaagtactgtaaaaagacccttgtgcttcttctcagaactactctatacttaccatcaagtccatccctctcttctgtgcaaatgggagcccactatccactctattctacatattgccttttttgcttaacaacatttcttgggaatgagttcattgctagtttcatacctcattctttgccagagctgcagagttttgcatcatatgggtgcaccagaatttctttaactcatccccagtgttggagatttaggttgtttctaatatttcactattacagtcactgccagaatgaatatatttaaatatacatctttcattcatatggaagaatatctttagggtagagtcttagaggtggaattgctgggtcaaacagtccattcatgtttattttgatagatattgccaaatttctcttcaaagagattgtgccaacttccataccaaccaaccacatacagaagcacctgtgtcccctcattctcaaaataatattttaaatacattaacaagatatacaaggtaatcaagttttttagtctgtttgagctgatataacaaaatatcttagactgagtaatttataagcaacagaaatctattggctacagttctggagaccagaattccaagaccaaggtgccagcagatgtggtgtctggtgaaggcctgttcctcatacacaaggacttcctgccacatcttcacatagtggaaatgttaaacaggctccctcaggcctcttttataagggcactaatcccgttcatgagggctccaccctcatgacctaattacctcccaaggaccccacctcttaatacaaacacacagggggttatatgtcaacatatgaattttggagggacaccaacattcagactatggcaccaaggaatgctattatatggaagcagttatcaaaagattgaaattacacatctgtgaaatgctaacatatgtcctttattaatgcatcaaataacaaaatctagtggcaggtaggggtgtgctgaaaagatactttttagcataccggcaacaaccctaatgtggaatgaagatacatgttgatgatatgctcacaggtactgctaataatactgttgtttgtacttcccattcgtaattgaaggaaatgcttgatttgaggtggtggctagtgcaaataacaatgtaaatttttccacccaagttttagagcctatcttggagccagctcttagagcctcattccaatgaatggcagcttatttttaatacatcaggtcagctccaggaatgtacgcttttagggaagctcttaaaattcatgtgtgggaatcagcctccatctagcctaatacatgcttcactggccttctaaaatagcaagccgagcaagaagacatagacaggcaaaggccactctaaagataccctccggaggtgtctgcctcggctgttacttagagcaactgtttgctccttcctgcaatacagctgcactcctccaccacagggttttggaaaatatcaattaaataatatattttaaacaactttgaaaaagataaaggcatctttttaatttggggcaccctattagccattaagaattaatgttattatctcctcatctgtttagtgtttagaacctctcccaagtctgctgataatggtggcaatgagggccaaaggatggagctgcttagctctggtaaatactggccaggcacagaggctcatgcctgtaatcccagcactttgggaggctgaggcaggcagatcacttgacgtctggagttcgagaccagcctggcctggccaacatggcaaaaccccgtctctactaaaaattagccaggcatggtggcacacctgtaatcccagctactcaggaggctgaggcaggagaatcacttgaaccctagggacagaggttgcagtgagctgagattatgcccccgcactcaagcctgggcaacagagcaagactctgtctcaaaaaaaaaaaaaaaaaggcatggtggctcatgcctgtaatcccagcactttgggaggccaaggcgggtggatcacgaggttaggagatcaagaccatcctggctaatatagtgaaccccgtctctactaaaagtacaaaaacaaaattagccaggcgtggtggtgggctcctgtagtcccagctactcgggaggctgaggcgggagaatggcatgaacctgggaggcggagcttgcagtgagccaagatcacgccactgcactccagcctgggcgacagagcgagactccgtctcaaaaaaaaaaagaaaagaaaagaagaaaagaaaacataaaatgtccagccacccaggacacaactgtgtggcctgaccgttcagttgtatcactcctcttatctggaaagtgctccagtgactacagaagttgctagaatttccaaaagcaagaagaaagtgatgggaaaatgtgtcaaatccacaatgggagaacactgtgtcactagaaaattatatgaccctggcaaccttaggagtatggaagaaagatttcaaacaagtttctgactatgtatctttttctaaatttttttgaatgctgaagaaatgttaaatttcattaagttttacagccagatttaatatagacataaatccctttaatgttcgtttcagtcaaaagtgagcggaacattatcgttaaaccagtgcatgtgggagaattacttgaggaaaatcaaaataggcacagttgggaacattaagccgtggccatattagacgcaagtaggcgcaatagcaaaattctttaggctctaatggactgggctattttgcttctcagtttccatacagatgagctttgttctggggcaatatggttgcagtttgagagtctatctgaaggagctcatttctctttcattagtccatgagcacagtgcaatttcagctaatactgttacacagctcctagctgggttatttggttaaatgccttcagggaaagtagcaagacagaataaaaggacaaatgcaatgcggtttcttgttctgagttcctgtagctgtggaattacattggcagttaatcattaccacgttgtactcgtgatcataaactcctgttatttaagatgttattcaagtctcacaagaaacatcttgtcttctgtggcacaatttccttgaggtcgggtttgtgcacaactataaccatagagacctgtttcttgtgcttcgtggacatgctagtaggtatatagtgccatttgtgtgaaattgaaaatgacattccctactggtgggtgaactgggaaacagcaccctgtctatgggcaaattagaaaagatgtccccttctgggtggacaaatgagcaaaaggcagcccctctgggctgaccaattcttttttaaagcctcctccaccttggggtgtgggggtggtgcacatggcttggtaagtccaatgcagaccctagttgctccctgtgggcaggaacccctggcgcaatgcacaacctgcacaactgtacacaacagccctgattacagaatccattttcacaattttgtagttggaccacagagtttgcccctcagtactctaaaaatatctgttcaatcacatcagtggatgtccatattaaatacattggtcttctttcttatggcaagtaactgccactctctgccaagggcagtgttctaaccttggaaacaaacaggacactcgtaggttgagaaacagaagaactagaggacggtgactcctaggggcttgaccagtggtgggcagtggagtggtggaaaccacggtggcacctcttcaccatcgcaatgtaatgctctcctcagcctccatcattacctggtgagctggggctcagtatctgcctgataacccaccttcagctagcatgagacacaggaggagcaagcttcaaactcccaacaaggtagtcagcctagttcataccagattcagtggctgtagcccaggagagaacgaggtatggggcacgtatgtctcagagcagagagatctgcctagaaagacaaagactgagtgagaagctatagtgtgggctatcagagggcagcctgggagcccaagaggcctcggacattggtcagggattggcaaactctttccgataaaaggccactttgtaaatactttaggctttgtggggttttgtcacaacgacttatctctgctgttagagtgcaaaagcagcgactggcaattcataaacaaatggatgtggctgtgttccgatacaactttacttacaaaaacaggccatgggctgatttagctggtgggccatattttgtgacctttgctgtcggtgatcaaagaaagaggacacaacaggagaagtcaggtgaggcattgcccatactgcgtggggcaacgtgcttgccagcttacattccttgtttcattttatcctcacagcaaccaactagtaacagttttaccacctacattttgaagatgaggaaactacagtttctaaaaaataggaaaatttccagggtcaaaaacagcctcatttcaaaaccaagtctgtttgacttgaatgtctctcttccttcccctacatcaagctggtacctgcagacgtatttgtctagggcagcccagccagggaagcccattgatcacagaggcattaaattccagatttgaaggtatggatggcagtgccagggccaggtgcaatctcaggagcctcagaagcttctctgtggatgtaaaagcaatgggcacagccaccattgactgcaggagctctcacctctctcatcaccagccattcagatagacaagccccaaatccgaaaggtgtcatctgtgggcctgcgtctttgatagccaggcaattacagcacctcatatataaaaagccagaggaatctgtgaatataataagtgactgtcctttcttagcgtggtgcaggccatctgtttgaaaagtacacactgcaaacaatgccaagttgtaattattaaactttctagctaagagcgagtctcatctttcttcctaattatgcattcaaatattcagaaattaagccttagaattattatataccagggatgggtttttttcccctgtgcattaaacttttagaagagaacatgagccatcatcagaagtttctcccagaaataactcccagagaagccctgaggtcagcttggaatcaacccaaccttctcactttcggtgtgatggtacaatgataattcaagttcttaatgatgactctgaatcatctcgatcctgaatcatcagagattaaattattttcaccaaacagctagtattttctaaagcaggaaaatcgattaaaggatttcagtaaaaagttagagaagtccaaacaaagcaagcatctggcaagcctcggtgaccagaacattaaattcaccaaacaccacctgctccaaatgtccatgttaatggcaattatagaagactccagtagcattcaaggccagtttaacttattcctgtacacaaataactttatgggagacagcattgtaattcaaatcaataaatgactcggtttggctgtacaagcataaacagaacgcttgcaaaatatggttcctccttgctagaaaccatttgatttttagccagaaaacatacagccaaacaagaataacaactgtttgccttccttaatgttcagtgtagactgttacccaaggaattaagcattagtcatcaaaacttcattgcaaaggcaacaaaataattggggttcctgagttatcatccatttcaacattcagaggccaatttgaccccagacaatacaaggtctttcttcttgttataaaagtggttgcagagttctgagggttctctgctgtaagctctgctctcagaactctccaggtcctgcttccaacccctgccatgtccggccaaactattttcccagagtcaggagcagagccaacagcctcactcagacagaccccagtgataattatcagcccaaaagataagcccaagtggaaagtttgagaagccagtcactcaggcagcagctacaaagggacaaacactctctagttttccctcactgacttcatttccctctgccagcctggtagaaacatggtctcagtccgctcaggttttgcccctgtcctccctgtctccagaagcgccctcaagcttcaaaagattcatacagccttccagagagggagacggggacctagtgctggttttcatcatctgtccactctggcttctgcagtaacaccattcccattggcctcggtggtcagttcacccagatcctgcctaaaccctggatgcttattgtcctgaccacccgaatgtcctaggccagctagttctcagcgtcacatcctcaccaacctccgctccctgctctccactggggatcaagggaatgcaggatggagctgccccaagcctgtagctcagatgcctcacaggggcatttctgatctgcaacactatgtccctgttgtgagctgagtcccaggcctctctgaggttggacatcccagcgtgcctcttcccactccaacagcacacctcagaaggaagaggcagcctcaggggcccgctgagtggccactcgtgctggatttccacccacctcaccttagggaattttaattttttctaaagagaaacaaaccagattgggcagatactcttccaaatctactgcttaagtttcaatctcagctttgaagcccagaaaaaaaagtattaacttgtgtttctctcgatattcctaccccactaactatacctaagaatgctgttatctctgaaaaattcagaggttaggagaacagaacacccttggggaagacaagttactatttcaaaatagtatctctgaaaaaaacagaaatccaaatatcgcatgggaagtcagtgggagaaaggccaaatctgagagggtctcccaggaacacggattgcgggccagatacagaattaaacttttaaagtgaatgaaagcaatctggggtctaagtggggaaggagtcgaaaaactggcaacttgccagtagttatggtcagtggagacgagaagacttcctcctctctgaaagccaagtgttgaatgaagacctagatcctggaataaaggatcaacatgcttaagactccaggcaaattactgggccaaatttcagggtgactcctgcccaagtacagcatttatttaaataaattagcattacaactctgattattacaactactggtgattttgtcacctaaacaataaaacaaaaattaatggaattagtggagttgctcttaaaaacattatgccaccacattaggcttacaaactcaagtgtgtcacaaaacttgtgtgttatcttatgataaagcacagttcctaaatatgtctcaggacccataacatcaagaaatgccaaagctggaatgtgcctctaacccagtgtttcctggcccagtgtatactgtgaaccaagaagccatctggggtcttcatttcagacccccaaaacaaaggagaggagaatgagatgaggaaaaaggaacttgagagagagcagcttctccaagcaagcagagaagggaatggggaaggaatgggttattcactaaacaatggtggatcatctcccattacagaccagaataaaaggcaaaccaactaaagacctaaatgttaaagaaaaaaaaaacccacaaaattgcttagacagttttagtggctacataattattttatgtggggaaagattctcagtgggaaaaaggaaggtgctggatgacagagaatagtacacttttgaccatatgctgtagggcataagagttcatacagatacttattgaagtttgtaatggtacatttctttgtttgatctttcgattgatgtctgttcccgcaactaggctataagttacataagggcagggatgccaccattgtattcccgtacttagcaaagtctctgacatatattggactcttaatgatatttgttgagtgaataaataaggtcaattgtggacaacgtcagggccttgggcatggggtttaaaacccataaggggaaaggaaaccagcctatgctagtctgaaggaagaagctggttgtgagctttctgtgtaaagcaaggaaactctagaggccatctcacttgtgatgtgagaactagaacatctggccatctgtccaaggaaggattaaggaagcttaccctacatcttgggttccaggtgaaatccattaaccacaagggctacatcaacttgaaaggaagacagtcctggagaacacagggcttacatttgctaaccccttgaaggcttgaaataggatgaaatggggaagcctgaaagagaatatcaagagaggatggaaaaccccaaagacatgctttggctccaacacaattttgtgaggtttggtccagtgcagcacactaatccagcactccagggaggactagaaatgtttaaagtctcccagcgctttccctttactgcgcctctggctgtacggacctaatgagatgccttgtgtttttcagaatgccgaagcaagttacgacttcagcagcaacgacccctatccttaccctcggtacacagatgactggtttaacaggtaaactgggccttgggaggtctctttgactttaggctttggggttttattctactttgttttgtttcaggcttgactaccaccagcaaaataatccccatgcttcattaaattatattgtgatttttcttcttagtggttacattctctaaagtgaaatttttaatattacaatcttcctctagaataatcttttgactgttttgttctgctaacttgaaattatttgctactttaatccattaaagagaaaagaaaatagaaataagaagttctttctcaacccattacaaggtgatttaaaacatgctgattttgctttatgtgttgaaactgtcgtagagaagtattttgccccatgggtctatgtgtttttgaaaagcattctgtacgctttctgctataaccccataacagctcatggagtccctttcaacaaaacagtaagtgtgattggcagaggtttgaagtattgcttgggacaaagatcctatgatgtcaaactacccaaacagtccatccaagagaataattttccttcagcttgttttgccactaaacatggaaatgtggtctcttttttcttcaagtaaacatttttcttaaatggttaattacatataagagatatgaagaaataaagatgtgcggtttgctcaatgaaagaatactgtaatttttaaacctagtgtttccctgttattgacgtccttgggtgaagttcataaaaacatatgaacttcaattagttgtataaaaatatatgatgtgcagagcactttatccatttttttttttatttctcatggcactctaagtagcacataaaacaaatgttgtcatttttagtttagtgataaggaaacaggctcagaagggttgaagggcttccttggtcaaacagttaaaattcaagtcaaagccaagattagccccatgcttcaaattatttccaaatccacatttgtactattctttgctgagtatcatttctattatttgatacaggcagcatgatgaccagaatatgttcaagggtagagcctcagtggacaggaagcttagattctgtctctaaagttagcaagttgacctgagacccctcagtctcatcaagggttgacacagggtacacaggttctgagtacaaatgcagaaaataagaaaaaagaaaatgaaatttaattttgtaatattttgtaaagatcattgctgatgtcggatagcacaattcattctctatccacatcacctgcaacctgaaaatgacatacaatgcttggaggtgtgtgtttagaggatgagaatgtataaaaaaggtctgaaaacttttggcatgaagtgtgttttatctctgtgacttctaaccctagatggtagcatatatttagcaaataaaccatttcagacacaagaatgtgaagttaccaaatgtgtgccattaagctggggtttagacagaattggcagtggccatccagggcacagtgctgagaagggccatgagagggtctggcttcagcaggattgattaccagctctccgcatgaatatcagaaagtgcagtggcaacatatccactggctacttgctgtctttctgtaactagtaggtactaaattagtctttgatggattgatgtaagcacaaaaatataaccaatggaaagattatcccccaatctcattttctgaacccaaacaaaatctaccctagtcaaatcttcctgggcaatgtgctataaaaatactccttaaaaaaactaaaaggttccactccaagatggccaaataggaacagctctggtctgcagctcccagcatgatcgacgcagaagatgggcaatttctgcatttccaactgaggtatctggttcatctcattgggactagttggacagtgggtgcaaggggtcggaggatttccctttcctagccaaaggaagccgtgacagactgtacctggaaaaatgggacacttctgcccaaatactgtgcttttcccatggtcttagcaaacagcagaccaggagattctctcccatgtctgggttggcaggtcccacgcccatggagctttgctcactgctagtgcagcagtctgagattgatctgcaaggcagcagcctgatggagggaggctgagacttgagtaggtaaaaaaaagtggccaggaagctcagactgggcagagcccaccacagctcagcaaggtctactgcctctatagactccacctctgtgggcagggcatagctggaaaaaaggagcagaagcttctgcagacttaaacgcccctgtctgacagatctgaagagggcagtggttctcccagcatggcatttgagctctgagaatggacagactgcctcctcaagtgggtcccttacccccatgtagcctaactaggagacacctcccagtaggggccaacagacagctcacaaaggtgggtgcccctctaggacaaagcttcaagaggaaagatcaggcagcaatatttgctgttctgcaatatttgctgttctgcagcctctgctggtgatacccaggcaaacagggtctggagtgggcctccaacagcctgcagctgagggacctgactgttagaaggaaaactaacaaacagaaaggaatagcatcaacatcaacaaaaaggacatccacacgaaaaccccatttgtagatcaccaacatcaaagaccaaaggtagataaaaccacaaatatggggagaaaccagagcagaaaagctgaaaattctaaaaaacgagtgcctcttctcctccaaaggaccgcagctcctcgacagcaacagaacaaagctggatggaaaatgactttgatgagttgacagaagtaggcttcagaagctcagtaataacaaacttgtccaagctaaaggagcatattctaacccattgcaaggaagctaaaaaccttgaaaaaaggttagatgaatggctaaccagaataaacagtgtagagaagactttaaatgacctgatggagctgaaaaccatggcacgagaacttcgtgacgcatgcaaaagcttcaatagccgatttgatcaagtggaagaaagggtaacagtgattgaagatcaaattaatgaaataaagtgagaagacaaggttagagaaaaaagagtaaaaagaaatgaaaaaaccctccaagaaatatgggactatgtgaaaagatcaaatctacgtttgattagtgtacttgaaactgacagggagaatggaaccaagttggaaaacactcttcaggatattatccaggagaacttccccaacctagcaaggcaggccaacattcagattcaggaaatacagagaacaccacaaagatactcctcaagaagaggaactccaagacacatacttgtcagattcaccaaagttgaaatgaaggaaaaaatgttaagggtagccagagagaaaggtcgggttacccacaaagggaagcccatcagactaacagcagatctctcagcagaaaccctacaagccagaggagagtggggaccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacaccccaaattgcaaagaccatcaatgctaggaagaaactgcatcaactaacgggcaaaataaccagctaacatcataatgacagaatcaaattcacacataacaatattaaccttaaatgtaaatgggctaaatgccccaattaaaagacacagacaggcaaattggataaagagtcaagacccatcagtgtgctgtattcaggagacccatctcacgtgcggagacacatataggctcaaaattaagggatggaggaagatctaccaagcaaatggaaaacaaaaaaaacacaagggttgcaattctagtctctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtccttagagacctacaaagagacttagagtcccacacaataataaggggagactttaacaccccactgtcaatattagacagatcaacgagacagaaggttaacaaggatatccaggcttgaactcagctctggaccaagtggacctaatagacatctacagaattctccaccccaaatcaacagaatatacattcttctcagcatcacatcgcacttattccaaaattgaccgcataattggaagtaaagcactcctcagcaaatgtaaaagaaaagaaatcacaacaaactgtctctcagaccacagtgcaatcaaattagaactcaggattaagaaactcactcaaaaccacacaactacatggaaactgaacaacctgctcctgaatgactactgggtacataacgaaatgaaggcagaaataaagacattctttgaaaccaatgagaacaaagacaaaacataccagaatctctgggacacatttaaagcaatgtgtagagggaaatttatagcactaaatgcccacaagagaaagcaggaaagatctaaaatcgacaccctaacatcacaattaaaagaactagagaagcgacagtgaacaaattcaaaagctagcagaaggcaagaaataactaagatcagagcagaactgaaggagctagagacacaaaaaacccttcaaaaaaaatcgatgaatccaggagctggttttttgaaaagatcaacaaaagtgatagatcactagcaagactaataaagatgaaaagagagaaaaatcaaatagacgcattcaaaaatgataaaggggatatcaccaccgatcccacagaaatacaaactaccatcagagaatactataaacacctctacacaaataaactagaaaatctagaagaaatggataaattcctgaacacaaacaccctcccaagactaaaccaggaagaagttgaatctctgaatagaccaataacaggctctgaaattgaggcaataattaatagcctaccaaccaaaaaaagtccaggaccagacggattcacagccaaattctaccagaggtacaaagaggagcggttaccgttccttgtgaaactattccagtcaacagaaaaagagggaatcctccctaactcattttatgaggccagcatcatcctgataccaaagcctggcagagacacaacaaaaaaagagaattttagaccaatgtccctgatgaacattgatgcaaaaatcctcaataaaatactggcaaaccaaatccagcagcacatcaaaaagcttatccgccacgatcaagtcagcttcatccctggaatgcaaggctggttcaacatatgcaaatcagtaaacgtaatccatcacataaacagaaccaatgacaaaaaccacatgattatctcaacagatgcagaaaaggcctttgacaaaattcaacagcccttcatgctaaaaactctcaataaactagatattgatgaaatgtatctcaaaataataagagctatttatgacaaaaccacagccaatatcatactgaatgggcaaaaactggaagcattccctttgaaaaccagcacaagacgaggatgccctctgtcaccactcctattcaacatagtgttggaagttctggccagggcaatcaggcaagagaaagaaataacggtattcaaataggaaaaaaggaagtcaaattgtccctgtttgcagatgacatgattgtatatctagaaaaccccatcgtctcagcccaaaatctccttaagctgagaagcaacttcagcaaagtctcaggatacaaaaatcaatgtgcaaaaatcacaagcatttctatacaccaataacagacaaacagaaagtcaaatcataagtgaactcccattcacaattgctacaaagagaataaaatacctaggaatccaacttacaagggatgtgaaggacctcttcaaggagaacaataaactgctgctcaacaaaagaggacacaaacaaatggaagaacattccatgctcatggataggaagaatgaatatcatggaaatggccatactgcccaaggtaatttgtagattcaatgccatccccatcaagctaccaatgactttcttcacagaattggaaaaaaactactttaaagttcatattgaaccaaaaaagagcccgcattgccaaaacaatcctatgccaaaagaacaaagctggaggcatcacgctacctgacttcaaaccataatacaaggctacagtaaccaaaacagcatggcactggtaccaaaacagatatatagaacagaacagaggcctcagaaataacaccacacatctacaactgcctgatctttgacaaacctgacaaacacaataaatggggaaaggattccctatttaataaatggtgctggcaaaactggctagccacatgtagaaagctgaaactcgatcccttccttataccttatacaaaaattaattcaagatggattaaagacttaaatgttagacctaaaaccatcaaaaccctagaagaaaacctaggcaataccactcaggacataggcatggacaaggacttcatgactaaaacaccaaaagcaatggcaacaaaagccaaaatagacaaatgggatctaattaaacttaagagcttctgcacggcagaagaaactaccatcagagtgaacaggcagcctgcagaatgggagaaaatttttgcaatctacccatctgacaaagggctaatatccagaatctacaaagaacttaaacaaatttacaagaaaaagacaaccccatcaaaaagtgggtgaaggatatgaacagacacttctcaaaagaagacatttatgcagccaacagacacatgaaaaaatgctcatcatcattggtcatcagagaaatgcaaatcaaaaccacaatgagataccatctcacaccagttagaatggtgatcattaaaaagtcaggaaacaacaaatgctggagaggatgtggagaaataggaacgcttttgcactgttggtgggagtgtaaattggttcaaccattgtggaagacagtatggtgattcctcaaggatctagaactagaaatatcatttgacccagcaatccaactactggatatatacccaaaggattataaatcatgctactataaaaacacatgcacacatatgtttattgtggcactattgacaatagcaaagacttggaaccaacccaaatgtccatcaatgatagactggattaagaaaatgtggcacatatacatcacagaatactgtgcagccataaaaaaggatgagttcatgtccttttcagggacatggatgaagctggaaatcatcattctcagcacaccatcacaaggacagaaaaccaaacactgcatgttctcactcataggtgggaattgaacaatgagaacacttggacacagggcggggaacatcacacaccagggcctgtcagggggtgtggcagactgggggaggggtagcattaggagaaatacctcatgtaaatgacaagttggtgggtgcagcaaatcaacatggcacatgtatacctatgtaacaaacctgcacgttgtgcacgtgtaccctagaacttaaagtataaaaaaaagaaaatttaagaaaaactaaaaacactaaggaaatgtcttctctcttaaatatttcatttgcaaacttgttctcaaaattataattttaaaccagctaaaaacctccaattaggactaattagtgcttagggcaataaaactcatcattgtcagcggtaagaattcccaagtgtccaattacccaagacacagtcatagtgactcaggcaagcatgatccccatgccttagggagccaatgattaagacagagtgtccactttgaccagtaaatgggttcttttcaattatcaagtcattttcaaagatcctcacgcactatggcttgttattacaaagactggatgatgccaccactcaaatcgcagctactttcaaacataactaccattgtaaatgattatgggaggctggtgaggtgaagctcaagtccacagaaccaagaaaatccttagttcaaaacatcaccattaccctgaagatgattcctgcttgagtgaaggagaatttgaataaagcgtcccttccatgagtgtacgatatgtttatttcaaaacccctctgggatgaaatgatattatgcctgatgttttcttcagtattacttatggcttgtggcaggagggaagagaatgactgaagtatagaggcaataaaattggttatgggttaatcattgttaaagctctgtgatgagtacatgggattttactctatttttgtatgtttttgatttttttctaataacaagaagtaaatttaactagcatacggcataaaaagaggtaataacaaaactaggacttcagtttggtatcatgaaactgttttggtgtgcaagcttccaaggagcttgcaatgtcaaatgattgggcaacagatgcccaagttactacaatgcaaaaatgtagcccagactaaaataacacaaggacagctaatgcaagttgaacagttactgtatttaaggcactgttctgtgttttgcatgtattcattcaactaattctcgtagtaaccctctgaaataggtattatgattttccccttttggaaactgaggcacagagaggttaagttacttgtgcaaggttacagggctaataagaagtggaggcaggatttgatgccagtgggtcattggtctaggattttatctaaggcaataggtagagttgggagtagggaacgaatgtatcccagggcaaggatataatctggacaaagataggctggcggggaggtgcaggatatgttcaggaggtggtctggataactgctgtgggatttggaggctggtgcaggaggcagcattctaagaaggatccgcaagtgaggtggagcataaaagggttgaaaaagttgctaggagaaagaaataaattctgtggttgggtcagaaactgggccaggggcatagatgaggctcattctctcattacactcaagataatgctgctactctcagaagccccaatagcctggagcctggcacttgttgttggctggcataggacccagcatgagcctcccaccagctgtgcagacaccaaggcatcccacaggttcttcaggtgttttctgggcataggcaccaaatccgatgccccatctctgttcagcagagttggggctcttgagaaaggctggtgtcagcatgccctgaaactccagtatagggctgacatgctgagcagcgataggcttgttgctattaactattccagccacactgactgccacaaaggctagttacaatgcaggagcaattgcttcacaggaaaaggcagcggctgtccagcacgagattctcactgctgtgaaaatagaaaataaaatgcactataggggacactcaaagaagtaaaatgttccccttggttgggagactgagttcaatagcaacacatctctcctaggttttcctgacactttaaaccatcatctcataccctctgcatttactcattgttttcctttattaaactccacgccaagggtgctttaggaaaacaaacttcatacatatgcagaactgcttttagggaatgtgtatattagaatagcttgccttgtgctcgatttgcttttgttggattattcctgtttaagcagagcaagcgtatttattctactgtgaaccatttaataattacatgcagtatctgagctccagggatgtacttgaaatacagttaagacattttcaaaaagagtataattttctcttagcttgcaatgagcaaaatacatttgaccaaacaaaataataataatagtaactcaaattgtaaaaaggtagaaaatacacatttaatcagcatcagtaatgtgcaaaacagatataactgatttgctgagagctatcaggatttagcatcacattttttcccttgctggcactcaaaaaatattgactgactggttgatagatgagtggcatacctttcaaccatgccaagatgttgagtggccttgacatctgtccattgtcaagctgcctgctgctctcaaggtctgcagcccacgttttgtcaataatcttgcagccctgctcattttaggtcaatgtttggtgatgcattgcagatctgtattccattactgtgctgttgtccataaaaatctctcttgcatagcatttctttgacaggtgttcactactgaaatgtcatccctgccattgacgatatttatgaagcattggggacgcagcatactctatctattaaaccctaaacagtgagagattctaggttagatgcaattcttggctgcagaaagtttactataaattcaggaagagagaagacatttattactcaagcaaacaaaatggagggaaggaagatggataaatggaggctgaagaacatttatctctttgtgagccaatgtgattgatagcattagttaaaccttcaaataagaaaggttttctgggattaacttttattttcttattaaaagtcatacttcattctgaagaaccccaagcaacaggccacaaaaaagtgtgagaaaaaaggccctctctggttggctattttcacactgatgtaagctgataccttaccctggtgatacttaatggtttgggagtagatgaacatctttcccttatgtctttatgaactaattctgaaacacctcctggataataaaatgcaaactgttttcaaagacatagtctttttcatgtgagctttaagactacctcatcagtcgatattagctcaaaggttactgcttgtaaccaaccctttctacatccaaaccagagcacagtgaaatccaacagcatttaatttttaaatttctagtcccctacctggattagaaaagtatttattatttaaatttttccttcagctaaaaggagtagatgtaatatagatttaggggttatggagaaaattataaagatggtaaaagaaagacctatatttgggtataattagttctactttgtaagctaatgtgtacatgccatatagagattttatggtactcagacggcaatcaataactcttttcttaagagagagaaatacagcacattatgtagacaaatgtaatattatgttaattgcttggtatggaatgagtgatccctgaatcagttcccttatctataaacagggactaaagctcccaccttgaaggcttgtactgcggattcaagacaggtatagagtgcttggtacagagcatggcacatggtaagcactccctaaccgacaaccaatagagttgtgaaattcagcaaagagatttctacaggagctaagtcaaagattattcaacgacaaagaaaagtaggagaatttatgctacaggagtaaatgtagcattcacccacctttctcagacatctgctctctcatttaagcttttgacagaaactggataacagtcagctcaaggttaaactctctgtcaagattctagtgcctgtgtttctgcattgctgattgaaaaaggagttatagccaaagataccttgtatgcatgaaacaaagttgatctattaggaaatttgaaatgtctagcatctggcctcagaaagatgaggagtctgctcacttctccagaaagcaatgggtgcttgccagcagactcagggacttccccagaggcagctttgctcattctcacctgtcacctattctaacctattctgcctgagctattcatttctcatctattctatcaagtaggctcttgaaaccccaaagtcttaccctgtagagctcattggacattagccagcaaacgtggtcgacgccaaactagccaggaagtctctgcatttcagttctaatatgtctaacactggagcttctttctccaaagccaagggtgaaaagactgcagctggccaccatgggtcttctgttgtctaagaatctgtagatgcagagagactggagaccagaagacaaagacagcctcatgtgcatgaacttagccaagttgcacactggcttgctgactaatctgtcttatctccttatctctgtgaatgcagatccctgaaacactgttgtagaaactggttgtcagaaacagaactaaggagtcaattgaaacaatcataggaccagtagccaggaaaggaagagaggtaaaaaaaaaaaaaaaaaaaaaaaaaaaaaaagacgaaaaaatatctccacatcaaaattatcctaaaatccactattccaaaatgcctgaaaaaaatacacctaaaaaaactaaaaatcaggatattaatttgtactatatgaaatcggttctatgaagcagtcttgaaaaagactttatcataagttatttttagtttgttcagagtgataaatgcatgggtgacatacattttaaagaaaactaaatgatggtggaaacataggcaaaaacaaaagcatggacatgaaaagaaccaattgcagctgaaaaatacagcctgtggaataaaatctcaataaatggtataaaatctagcctggatgcacttgaggagttaattatcgaattgaagataacagcctgtttatcaaaaacctacagcaaacattattcttcatggtgaagctttgatagcattctctaagtctgacaagatgtgggttctccctatcatccctttaattcaacactatgctacatttcatagctgatcaaatagttataaatctaagaaaaggtgtgagatcattaagaagaaaattataaaatttacaaaagaataaaggagtcctaaataaatagagtggcatactaagctcagggataagaagatggaacaatataaagatatcatatcaaattaatatattaattcattgcaatttcaattaaagtttcaatagattattcagtggaactagacaaaattgttttaaaattgatatggaaaaacaagtggccaaaatagaagaagacaagtaaggaggaggaaaaaaggagaaaaaagaggaagagaatgaagataaagaagaagaagatgaggttgaagttcagcaacaacagaacaacagcaagatgggaagctttgccgaccggataccaaaacattacacaaccataataatatgagattgtagggttagcatacagagagacaaaaagatcaagaaacagaatagagagtgcaaaaacagacaccacataaaaggaaccctaatatatgattaagatagcaataaaaacaataaggaaatgatggagtgaaggtattcaataaatgtgataactatgcacatggggagaaataggcacccacaccacatactgagcataaataaattccaggagaatgaaagacctaaatggatataaatcttttaggaaaaaataaagaaaaacatctttatgatcatgacatagggactgatttcttcccttttctccccaattgatttagaagtttattttgccaaggttaagggtcatgacccatgacacagcctcaggaggtcctgagaacaggtgcccaaggtggttgagtcagagcttgattttatatgttttagggagacataagacattaatcaatacatgtgaagtagacattggcttggtctggaaaggcaggacatcttgaagcaggggcttccaggttataggtagattcaaagattttctgattggcaattggttgaattattacctaaagacctggaatcaatagaaaggtgtgtctgggttaagataagggtttgtggagaccagggttctttttatgtagatgaatctcctaagtggccactcttagaggcaatagatgacagatgattcctgttcagacctttaaaaggtgctagactctcagctaatctctccaggattggaaaaagatctggaaagggcagaggattctctacagaatgtaaattagggatggatttcttaagccactaaaccacatggaaaaataaatgattaataaagctggctacattaaaattaaacacttttgtacaaaaaaaaaagtcacaataaataaatttggaagacaagccacagactagaagacgtgcagcaaattttatggaaaaaaaggcttaatatagaaaatttgtaaagaacagctacaaatcaatgaaaaataaataaatacccttgtagaagaaatgggccaaggttattaacaggaaattcacagaaaagaaaatctaagccaaatagcctatgaaaagattaccttgctagtgatgaggaaatgcaaaatgaaacaataacataccatttcacaccaactggactagcaaaaatggtaacattcaacaatgatcaatgttgaaaaggattgagcaacaggattgctcacaccttgaaggaggtagtacatagccatataacctgttttaaatcctacaagaagacctcagagaaactattccttatgggtacatggaaataataaacaagaatgtttcttttcaaattatttgtaatagcaagcaaattgcaaacaaattaaatacctatcattagaagtataaataaataaatcacagcatatttataaatggactactacacagcactaaaaatggatgaactagaattcacaagttaacttcagaaaatgtagcaaatgaagccaattttacatagatcatacactaggaaattttatacagtttgaaacatgcaaagagtgacatgtatgcttatgcatacctgattataagttcataaaaatgttctgaacagcaaatttagtacacttgttacctctgaggaagcaaagaggggaaggaatggcatcagagagggcctcaaattgtatctgtaaagatttatgttgtttcttggcgcggagggggttgttttttgttttttgagacagagtctcactctgtcgcccaggctggagtgcagtggctccgtctcggctcactgtgacctccgcctctctggttcatgcgattctcctgcctcagcctcctgagtagctgagattacaggcacgcgccaccacgcctggctaatttttgtatttttagtagagacagggtttcaccatgttggtcaggctggtctcaaactcctgacctcgtgatctacccacctcagcctcccaaagtgctgggattacaggcgtgagccacagcgcccagccttttatttttatttgagacagtctcattctgtcacccaggctggagtgcagtggcgtaatcttggcacactgtaacctccgactcctaggttcaagcaattctcatgtctcagcctcccgagtagctagaactacagagacaggccaccatacctggctaatttttttgtgtttttagtagagacggggtttccaggctggtcttgaactcctgatctcaagcaatacgcccaccttggcctcccaaagtgctgggattacaggagtgagccaccacacccagcctataaagaattatgtttttctaaaaataatccaaagtaagaaaaatgtttggctttgatagacttggatggtggctatatgagagtcatcatactattcactgaaattgtctatatttttttaaatatttcataatttcacatatttaaataataagcctgagccaaaatggaaaccccaaagtgtcagacaggcccattcaccattaaaagacccacttctacacaccagcctcaaagtgcgcattaaataaacgaatgccaaaagtccatcatgcaccctgcacacacctagtgagagggtaggggaattcgaccactagacaaggcagccattttttttctgttcatcaaagactgctttgtactgatccttgtcacccaacatctctttttgtgggatccttcaaattagtttatgtcacttattattagaatttatccttccaaaacagtttatcgagtaggatctaataaaattataggaataatcaataggaataagattaaaatgtgctagttcatgttatcctagtagctgtaacaaataaatcttggccctgaaatattagtggcttagcggcttagcaccaaaagaagtgtatcactcacccaccagtccatctctgtgttcctggtggagcagctctcctctaagcagtgattaggggatgcagactcctttcatctttggcataggtttccaatgttcctgggcttttttgcatcaaactacttgaggggaaagagagtgaataattgcccaagggtaatttttatgggccaggttaacaaatagcatttacccatctgctcacatatttgccataactcagtcacatggccacatacaagtgcaagggaggatgggagccttactgcagcctggggagaaaagagaatgactggtgaccatttagcattttctgccaccaacaaaaaccatgttacagagtgagagacaatactgtaccagaatacctagttgaatggtgatatggtttgactctgtgtctccactgaaatctcatcttgaattgtaattgccataatccccatgtgtcaagggcaagaccaggtggaggtaactgaatcatggggtcagtttcccccatgcggttctcatgataatgagtgagtcttacaagatctgatggttttataagcatctggcatttcccctgctggcactcatttactccttcctgccaccctgtgaagaggtgccttccaccatgattttaagtttcctaaggcctcccaagcaatgctgaactgtaagtcaattaaccctctttcctttataaattacccagtctctggtatttcttcatagcagtgtgaaaacagactaatatgggtattagcaaatgactgaactaagaaaccagcaaaagcagatttaattacttagttactttttgttttagtcatggttctccagagaacagaaccagtaggatgtgtatacatataaaaagaggttcattataaggaattggctcacctaagtctggagactggcaagtccaaaatctgcagggtgagccagcaggctggagaccctgagagccaatggtccagcttgagtctgaaggtagcctgctatagaaccaggaagatccaacgttacaggtgaagtccaaagacagtcttccagagaattctctcttctcagagaaggccagatcttttgtctatttaaaccttcaagtgattggatgaggcccacgcacattatggaggacaagctgctctagtcaatgtccacaaattgaaatgtgagtctcatccaaaatacccttgcagcaacacctagaataatgtctgactgaatgtctggatacctcgtggcccagccatattgacaaatgaaattaaccgttacaattttaatctgcatgtttctaataggattacatgatagttaaagatcatggttaagagcagggctttggaagcagcagacctgagtttgaattcttgtcctgcctcctatttgagaagtgacttcacatctatctaagcttcagttttctcatctttaaaatggggataataataggctgttgtgaggatttaataggataatacatgtaactctctcagcacagggcccatctcatagtaggtgctggtaaaagaggttgttttattcatattgctggatatatctaacactattccctaagtgtagtacatatataaatacatgcttttggctggaaaaactaagtgagatgatcaaatcactctgatggaaaagccagcagtgtggatggaaaaggtgtgcctgttctttctctcaggaaatccacagggttgcgcacagggcctcaggttttcatttggacaccccagcagcccctcaatacaggctattcacaaaagccccaatacagtcaccctgacagtccagctgtgaaccctggctccccacacgtgagccatggtgtccctctagccttgttcattcattgtgtcagtaatctactgccatgataacgctgcataacaaattattccagaattcagtagcttgaaacaataagcattgattattgctcccaagtctatagtttggctggaaagttctattgatctggaccaggctaggcttgtcttggctgagctcacccttgtctccctggtcagctggcaggttgctgggggctgattggtttaggatgacctcactcacatgttgatggattactgttgactggggtgtcaggcattacaggttatgtgtctttcatcatccaataggctagcccgggcttactcacatggagcctagacagggtggcaagagaaagcagaaaagccacatggtctcctgaggcccaggctcatcacttctgccacattctttcagtcaaaataaatgacaagagaagtccagattcaaaagcccagggttgtgagaaggcttggtgttaggaacaatcgtaagaaacctctatttatggctgattgctaattagtgttgcctaatttagcaatgaaatgtttcttcccatatgttcctctggagagcccatggcattcctctcccccgcttaagggccaaaattaagatacagaagacttatttaatatctttactttgttcaagctggttcacatacacttgtcctccagcctttggtgaactgttttaggacagggacaggtttaacacaagggccgacctctgcagtgacactgggtttacatatctgggtacatgataggcgggtttcattcttgttccaaagagaattttgaggcatgaaatatgtagcctttatggaggcaggatttactttgactcatacagagaaagaaaatgtgtgtgtgtgtgtgtgtattttcaatccttgcatgtgatatttttaagggctggtgcgatagctttgcttgccccaagaggatgtcccagacagtgcactagttgatgctgcagaaatggaaaattcctagggatatgtagccaatgaaccccttcacccacatttcctgattgtttgccacaatttgaacagtgagtggaaagaccttgtgcattccgcaggccatactcgcactgtcccagcagacctgggaatgtgcccatttgattcagtagttgttccacccaccattaaaatggacttttctagccacactcagcagctcacagctgtaatcccagcaatgtgggaggcttagatgggaagatcgcttgagcccaggagtttgagaccagcctgggcaacatgggaaacccccttctctacaaaaaatacaaaaaattagccaggcgtggtgcacacacctgtggtcccagctactgaagaggctgaggcaagagaatcacctgagcccaggaagtcgaagctgcagtaagccaagattgcaccactgcattccagcctgggtgaccgaggagactctgtctcaaaaaaaaaaaaaaaaaaaaaaaaaaaaaaaagaataaataaatataaataaagtggacttttcatggttggatctggtagttccagatgatttgtaccattggaatcttttgcatcttgaatgctgtttgggtctgaaaacacagccttctcagtgattcagcttatacttgttttatttctctattgcggctttacaaaccaccccaaaatggggcgctttacagaaaactaaaagacaggtagataatggtttgctcagcactttaagtcttcacagaactttaacacaagggctgacctcttcagtgacacagggtttacttgtatatgatacgcagatttcatttttgttccaaagagaattttgagcccatgagagatctagccaaattcgtttcactgcatatctaatgtgtctttatatttttccaaagccacgggacccgatgtgcaggagaagtttctgctgccgccaacaacaatatctgtggagttggagtagcatacaactccaaggttgcaggtaagccatccctgccaaacagaggcccccactaggtatcacactgatctcaaggctgactgtggcccagcaaaaaatcccactggtgcagaaaagctaggatccacagatttggcacaagtgaaaaaaatttttttcttttaacctgcataacaatatcaatagttttaaatttttaatttaagcataatataaattcaaaaaagttaacaaatcataaataagctaatgacttttcccaaactggccatacccatacagtgatcaggaaacaaaatgtaaccagcaccccaaacatgtccccttccagttactactctgacacccaagaataatcatgatcttgttttttaacagcaaaaaaaaaatggttattgccagtttttgaaatttatataaatagaattgtcagtcactactcttctgtgtcagtgtcaataacattttaatgagtctcaaatatagactatagaatacaaggtggtgtgtataaattatttgtaaacatactcagagctcttcaaaatgttttgcacaatggaactcatctttaaaaagagaaattctgcctagaacctttttcttacatttcattgggtaggatatttaagaatttcctattgatggagcctttagaaataagagtggcaagtcactggaaatttagaacccaatatccctcccctctcagaaaaaaaaagagagagagacacagacagagacagagactgagagattcataagctttcaacgagatgtctgagaatggagtggcaccagtctttttccaagttttgcatcaaattgattcttaatttattcaggctgagtcacccaaccttgtttttcttttttcttttcttttttgtttacaactgtcctgatattttcttttcctggcaatttaatggaaccataaacctactttctgctgacactccatttccatggaactaaataaagcaaaggtaacctatacaaacccactattaacctcttttcaacactgtttgctaagaggcttgcctgaactgggtgctgaatgtcacaaaagaatacatctggaggtttctaaaatgtaaatagaggaggcttagcccctgggtttcagctctctttactttgtgcacatccaaaatgctggcattaaaatgtcaggagccattatgagctcaggggaaagaatatcactcggttaatattttataagccaggctcagacctgggatggaatctaagggaggcgggttctctactcacaggacagaactggaagcaactgaaaaattcaaacctgaatttcttgttcacacacccaaggtaactggtttttggaacaaagtaaaatgaccacctgcaaaagttaaaagagttagggggagctcacagctttctggaggttcctgggagcttctttttccatctccttcttttccttttttcctcttctcttattatttgcactctgaaaacacctgagcattgagtgctcatcaaatgtatctaattctcctgctgtcttagtttgctctgcctaaaagcaaaacctgagacaaggattccgggcaagcagttaatgtgggaggtggtccccggaagccagagtgagggagttggggaagaagacaggaaaggaatggaggccaacgaagtgagtctcatggacaacaggggccccgtcctgcaggtaattctctgaggaagtgtggagaacacccctcagaattgaccccgctaatgtgaggaggctgcggcattaatctgccagttcccatctttcattgttcgggggtgccgtcgggcctgtccagcctgcccagctcgcttgaactgagtggagctccttgagcagaggacacccccaggcaaaaagccagggagcaggccagaggacccggtgggtgcagcagcctctgcctcgcctgctgaatgcagcctgacacctcaaagacgcgactgggcttctgtgaagcccaatgacagctagggcatcacagcaacgttttgaggttccagaaaccaagaacagacatccaaagattttgagcaagggaggctcctttctttcttttcccactcccttagccccagcttggctcccctgtgaccacgtacgctggttctaactacaagggctgcgaggctccagtcccatgcctgtgccttagggaacccagtgtcctctggctccctggggcgtcagcatgaattcttgaggaagcactggggaattactcatggattacaaaaacagcagagtttatcttacaaatttaaggaaaacattttattcatcctggctggcaattccaaaagttggctggtttttaattatttgctaaaaatgagccaaaccctccagagaatctttccattcgggagctttctgggctaaggaggtctaaagcgccacctggtggccaactcggatcgttgctggtctcaaagtcgaggtgttcgttcgttacaggttaggggggcgcccctgtgatgtctgaggtccttccccagcacccctccacgctgtctccagaaaaagcccaaagttaaaatgtggttgaatcttaacccagggattcaaaaaagaagagtggagattgtaaattgagtcctctgaacagaagagagcattgagcatctctgcatctacctgagttcctcttctgttcataaatttttctcatttttccatcaaggctcctgtctttttcttgttgatttgtaggcattcttggtgtgtcccaaaggttagcccctaacccattttaatcaatgcaaagatcttctccttcatttctcttcgcgtccgtcttcatttcaaactccgtgacatgtagacccgcacatacgggatgtcccaaaagtcatcctgcagtcttcaagctttaataaccccaggaacattatttgaaagtttatttacatttccattttcactgatttaattgtataaattttgaagaaaaatattactttttttattttgaaaatgcctttattcaagtaactgtcttttttaaaaaggaccccattctttccttctttcttttttcattttaatttttaagtaaacaacatcttcaatcaaaaagattgagtcaaaaattaaaattaagtgtgttattcaaaatccacaaaaccaagcaaatgtaccacaaacaatgaccttccaaatgatggtttttgcaaatttgtcaaatgtatatttctgaaaatattaaagctcgagaccacatcaaggagtcgtaacactgtctcctgccttcaggccttttgtgtggtccatagttactgtgggcaccttcctgttgcaggggatggaagctggcggacaggtcccctgccccatatagctcacagtctaggaggagaaaaagacagggagcaaataaaaaaaaatcagataacaactcatgaaagaggacagagagtaaccagggctcagggacaagaggcgcctgagggtggggctctacagttcctcactgttctggatttctgcagagactctcagagcagccctaagagggggccaggccaggtgggtttggtcctattcaccttcctttttaaaccaaagcacacagatttacacaccgggcttcgggatgagatcacctttgattgaagattttgaaaaatatttaaaaaccacactgttgaccattgtgaaaatgccgtgaaatttctctaccagctatgaagtgctttcacatattattatcactattattattggccaatgaatctcataacactgcagataaacatattttatctgagcttttcaataaacaagtaaaaatcactgtaagtacaatgactaacatgagttttcagaacctaaaacctggatgagcatgaatttcctccttatcatccagagctaatattcatgagcacaaaaagtggcattgatgagcaccgaagtttgtgggcagatgtagtatttactggaggcagggacaggcacaccttgtgcaacaggagcagaggcagagagggtgcagctcaaatcccctggacatgcagcccccggggcaccagggctagccacagtgcatgctgcacaggcagacagagaaggctctaaatgaatggaagagacccacagagtcacctctactcattaatgtgctgtgcaggcctgcctggggtcagatagaaacacttgatgtgtgcctgtgtctgttcttgcccatcaaatacacatatcagcattgttagggatgtgaagacacagactcctagctcctttgatttctctctctctctctctctctctctctccccccacttccttccctcctcctcctcccccccttcctccctctctccctctctctcttcctcccctcctcctcccccccccttcctacttctctccctttcctctctctttccctctcctctccctctctctctaccttctctctcctacactctccctctctccctctcctctctccctgtcctctccctctctctctaccttctctctctctcctacactctccctctctccctctcctctctctctgtcctctccttctctctctaccttctctctctctcccactctctccttctcctctccctttctctctacctgttctccctctgcctctctctatcccattctctttgtctctctccctctatctacgctctctctctctctctctcccagtctgtctgcctctctccctctctctctccttctctccctctctctcactcggtctactctctgtctccaccccacattcccctgtagctcctagagcatccaggggcagaggagaggccttccctaaaaacccttgggtcacgctgagcctctgtcttggcttggtgcagttgcttgcaaaattaatactgtatctcattcaattaatgcatgcctcattcctcttgagcttaacaagattaaaagaatgtcgggtgcctggtccctgaatatgaatgagagacttgctctcagcctgtggccaccctataatgttaaaacagtcagaagattaatacacatccactctgaggttcttgcgcagcacagagggagcccatgaaggtgataagagctgcaaagaggaagagggttcaaggcacagctggaagtgccatgcaccagccctggcaaaatccagggctggcattcgttggtttgtggggcagcagaaacctgctttggccggggttgaatttctcaccttccagttgagtgggccattcagtcctggtcatcttggcactaggcaagttcaagagcatctgagcaagtgaacgccagcctctgtctatttcccacccacagagtgggcgtgactttgcacaagaagaagctgcactgaccagtttattctgtggttcattggtcacctgcattaaataaagtttttaaataaataaaaacataggtggaccaaaagcaaaatacagagtcttaaatttcctatctccttataaaatgaaccataaaatttaacatctggaaagttcaaaccaaagactaggcttattctagataatcttcctccaggagaaagaatgctaactgataactgggtgtttgttgtcaaaaatggtgattacacttatgggttaatagtagaagatggataagcagagcctgttattcattcttctggacctgttatttgtgttggggagaaaatcaactaaataaggtaataatgccagatatttattcaccaaatatttgtcaagcttaaaataaataccaagcatcatgttgatcctcaaggacatggaagtgaacaaaatagacacatgccctatactcaaagaccatgccatctggtggtatatgaaacacgcaaataagtagttgcgatagaaggttaaaggtacacaagaagagggctatgagcactgaagaggaaagtgagatcctcgagtctcctgaggactgaaagtagtagtccctcaggaaagaaagcaatttcatgtccatttcagctgcctggcaaggacctgggtggcttttaattcgattgacgtgctcgccatgttagagagtgaggcttgtgaaatagtgtccttcaggcacaacatcctttggccaccggggacaaggaaggagttttggggcccagattttgactgtgcatggcccaaccccttcattccataatcgcagtgggtggaaagactcaggtcagcttcactagcactctaagctccatgccacagaattgtgaacccactgacccatccagatgacaaagcctggagagaggcatgtgaccccgtcagcgaagttttgagggtagtgatggagagacagcacacccaacccaatggcggctactgagatccccctggagaggcctttgtggatggccaaacggggaccggaggcctaggagcaccagctctgcgggggcagcgccagcaccttcaccctgtgcccctgtgtcttaggattgtgtgtcccacactatcctggactgcaggactttgctccttcccaacattctgtgagaaatcactcccacgaggcatcagagaggaacacaaactttacagcgatgctatagggaagaaaggagaggcagccgtcagacacagaattactaatacagtttagaatagccatctctgcctttctgtcctctccgaagtccctctcagctacagtgcaaatgggagttcctctttcctgaccccacccgctcctgcactgcccctgcccctctctctgtcccctgccctctgccctctgcctgctggaatttctcctcaaatatcaaatattgattgcctcccccatctatcatatgtagtagctttatttctcccttaaaacttggctgcagccaacacccagttctctgaggccaagcttctacttagaaacgagcttatcaaagcatcgcttcagcaaaggtggtctctcccatcatgaattctagtaagttttgctaggggaataaaattgtctttaaatcattacatcagcaaagatgtgggtgggatgcagaaaggagccagtaggaccgtctgtgcctctttcttgatccctggactgcacagtggccccagagcacctgagatctccaaccattccaagtacccagggcccaagccctcctccacctccttgtctcctgcgaactggggaacccaaacatggtgtcctctgctcaacgtgtccacaggcatccggatgctggaccagccattcatgacagacatcatcgaggcctcctccatcagtcatatgccacagctgattgacatctacagcgccagctggggccccacagacaacggcaagacagtggatgggccccgggagctcacgctgcaggccatggccgatggcgtgaacaaggtaagggggccggccccctaggccccggccactcacaagttgggacaaagtgggtggaggggtagatgcaactgggtgaaccactgtcaccctgtgtgtgagtccaggtcctgcaggaatcagacagcacaggggcttagccatgcaggaggctgactgcagggaggcctgtgatggataaggagagagggcagaaaagcctcagacgcgatgcctacctggctcctgcaaacgacagtgggaaggaaggggccgggggggggagggtctcagacagcagtccccacgccaaagctgcccatcacagacagaaaggggcctgcactggcacccccaccacccactcagtcgttggctggcagtagcacacaggattttgggtctcggcgcacacagggcggtagatccaggaggcagcagccaagactatgaccacaatgctcgtggggcagggggtctgagcatgcattctcacagctgctcctctgagattagcccaggcttggacagagctgaggagaaggaagctgggcagagcctccaaagggatgagatgcaggtcagtgctgcatagggaggggaagggggccccttctctgagacgctggggctggagccaccccagaggagacatgaccccaggctcagggaccagaggatttctgggctccagtctatcaggaagtgacttagcctcgcctgtaaaacggtgataatgaggggtcactatgatgtataaatgagataaagatgcaactgctcggcactgagaagtgcctgcaaagagtcagaatttgtcccagtctcgactgccgcttaagcaaccaccccaaaacttcatagcacagaacacaactcctttactacgcttgggatgctctgggtcaggaatttggaccgggcacactggggatggctcatccgtcctccatgattcctggggcctcagccgatagattcgttacttgagcatccattaccaaactgttgcgtcttcatgagctgttctgatgcatccatctacttgccacgcgtggcacagctcccacccctaggcttacgcagtcttctcaggcctgtcctggctgccaggccagcagttcccccccacccacaccgtgctcccagaggactctctgtaatcagcctggacgtgggactcacaccacaaggtcactgccgtgtgtggagtgagttgtctggtgttaagtgagggaaaggacagtgtgtgagattttgtgtgtggcttttggaactccattttgggaatgtttttaaatttgcttcttagattttggtaaatttcaaatagatgaaatggctatagaaaccagcactattataaatattttataaaatgcatctgctccacatacacatttaagttatgtacagtctgtttatggaaaatgcataaactcattacttatacattgataacactaaaataagtgaatgtacagaacgctatgtttaacgcaggcataaaaaagagaatattgaagaaaataagagtgggcaattgaaggctgcttttccatacatttcttgaggtcagaaaacatgtgttttcctgcccagaccatcctcaggaactggcccggggtttgagaacatagtggatgagctgttcagggggcaggtatggaattaatgcagacacgaaatggtacggttgagaggctgaaagtcacatcgaaatctatgactacaatggatgccattggtgcccaccaagatcccctttaccaggcctgggggccaccccagctgctgtgagtgttggctgctgatggctcacagtgggccctctcacgaagcattgccttgacgatggaatcttctctcccagaaagttatgccccccacacccagggcacagcccacagccgatgactaaggcaggagcctgtttgcctccaacagggaggagtcttcaatgcaatttatggtccagagccccctgtgggccaggccaagggaaagctttacccaagactacatagttttggagttccttcccctctgtatcttacttcacttccttgctcgcaggttgctcctgagagccctccctcaatgagtctggggcagccgaatctctgcctcaggctctgcttctagggaacacctcccacaaacactgcctcaaaatttaccccattaggtttccctttttcctttggctgccaggaagcttagaactaagtgtgtgcctattaccattggttttttagactaggttttcttctaccttttttttttcttttgagatagggtctcactgcatcacccaggctggagtgcagtggcacaatctcagctcactgcagcctcaacctcctgggctcaagtgattctcctgcctcagcctccagagtggctgggactacaggtgcatgataccatgcccagctaactttttgtagacatgtttcaccatgttgcccaggctagtttcaaactccgggactcaagagatcctcccaccttggcctcccgaggtgggattacaagcatgcaccactgcacccggcctcttccaccccatttttctccatctcttcaccactcacagcctccaaaatcatcccttagcttctgtccctgtgtccgtgtttgtattcctagtgagtctaagcctctgaatgctaggcaatgtaaaatttgtaaaagaattgatgaaatgagctcagtctgattagattatatttagccatgagaaatctaactttggatccttactaaattgttgcttgcttacacacattcctagtcttaccagactaaagcatctcactggacaaaaattggcaagttcacatgtaacttcctcagagtctcagccctaaacaatagtaaacaatatttcaaaccaagtggaacccttcagcgcagtgggtggccaactttggtacacaggctggatctaacccccagacttgctttgcaaagacagtttccttgggacacagccaggcccttccaggtctttgtgacattctgggcacctccaaccacagctgtcacgggtcccaggggaaggaagcacatagggcaccaaatgaaggggctcatctctcagaatcaggcttttctggatgctggtcaacgtctctgtcttcactagagagccgacactgcacagcagcaggtccgtcctgttgcagggatatttcagcaggtggagagctcttgacagtggagagacctgagttttaacctcagtcctgccccccattggctggggaacttcagactagtcgatgtctccattcctcactttttgcaaaatggtctgagtcagtgcttctcaaagtgtggccacagcccacctgggagagtgaaaaatgcaaaacctcagcgcctcctcccctcccacagatgccgcattttaacaagatcccattaaagtttgcaaggtgttgctctacgtgatcttgaggatccaaatcatctaaccctgagatcctaagaccctaacatatggtttcttaaaacctacaatgaatagaaaagggcagcaggggtgacacatttccagaaaggaacagccctgtatttcctcatcagacaatgggttggacgggtgggctgtgtgatgactgagccacacgccatttgtctctgtgttgaagaaacagaggcctaggtagcccaaataaattggtttctcgtaagaatgcaccaggagggccttggcatagtggctcacgcctgtaatcccaacactttggggggctaaggcgggtggatcacctgaggtcaggagttcaagaccagcctgatcaaaatggtgaaaccccgtctctactaaagatacaaaaaattagccaggtgtggtggtgggcacctgtaatctcagttactcaagaggctgaggcaggagaatcacttgaacccgggaggcagacgttgcagtgagctgagttcatgccattgcactccagtctgggcatcaggagtgaaactctatctcaaaaaaaaaaaaaaaaatgcaccaagagggatcagggcaatgagatagattcaggcaagacctcatagtgcctgggaccagacagacatcctgatccaaggtggctgcaggatgccagccccaagaatgtgtggaaagccacaggagggctctgcggtcacggggctaggccacactcaccctgtttgcttctccccggtttcgtggctccggctctccaactcacccttccccttccttgaggcttatgcttagaggtgtttccacttggacaccaccccattggcacccttgcttgttacaatctgtcagcctctgctccagctgccacctgcccttgatgctttcagggaaattttggctcaaaattaggggaaacaccccaagatgagcctccaaaaccaagaagtgtggttctgttgggaaggtttggaacttgcagggtcagaggccagtcagatggtttctaataaaacccctttctttctcctctgaggacatcaaagggtagttgtctatattcacagtcttcttaggcatctgatggagtaattttttctgagctgttgaattctttcaaaggtctgaacagaaatataagactgtatgcccctgtattaatctgttttcatgctgttggtaaagacatacctaaggctgggcaatttacaaaagaaagaggtttattggacttacagttccacatagctggggagacctcacaatcatggtggaaggtgaaaggcatgtcttacctggtggcagacaagagaagagagcttctgtagggaaactcccctttttaaaaccatgagatctcatgagatctcataagacttattcactatcaagagaacagcatggggaagactcgcccccatgattcagttacctcccactgggtccttcccacaacatgtggaaattcaagatgagatttgggtgggggcacagccaaacggcatcagcacctcttctgttgtgggttcaattgtgtccccaaatattcatatgttggggtcctaatccccaatacctcataatgtgaccttatttggaaatagggtcattgcagatataattaattaagatgatgtcatattggagtaggatgggcccctaatccaatatgattggtgtccttatttaaaagacaaaaaaaaaaaaaaagaacaggaacatctgggcacagataggcatacagggagaacagcatgtgaagatgaaggcagaggggctggggatgcatctacaagcccaggagagccagagatggccaacagcccaccgggagctgggaaaggaatgggatagattccttctccagaacttctaggaatggaattgaatctattatgtctccagaacttctagagatggattctattcctagaagttctggagacggaagtgtcagcagggttggctgacacttccgtctccaggatttctaggcaagaaatttctgttgtttaagccactcagtttgtggtcctttggttgttactttggtcctttggttgtggtccttctgtagcagccctggcaaactaatgcaccttccagtcttagaatggatcatcaaaaaggaggtttggcagtgcgggaatgacctgctcactgttcaaggtcaccttgatgtcacctggccctctgctttacagccaagatggtcaatagttgatccaattacgacttttttcttctagttcaggaccttgagaagtctccctccctcccttctctgatgtagcttcctcgaaggaatgagcgtgtgaaaatgctcacgatgcagtcctaggagagaaacatgtttccaagttagggagagtgctgtgctgaaatgctcccaataacgtcacactgggagcttgaaattcaacatggaaattgacgaacactaaaaataaagcccttttacgcccccttcagggagctggttgttaaacattgaatagcacacctctcgttagaggactcttctgacttcccttaaattatagcacttacatacctatgtgttctccctgcaagtaacagccacccttgccttcatgagtctggaagttccctttgcgaagtggaaaagctggaggaaaaacacctgaaaccccaaggttttgtttccccaaaatgacaagtttcccaaccagagtcctaagttaccccaagactgtggaggacaacttttctaagtcaaggaaagatctcacactttaaggaattcaccacttttacattaaatacaaggatcccaaaaacacaattatgagatgggaaacagagtcctcgaagtgaacatcatggtgacagcagctaaatgtccattgctacactgttcaggaaatagtgaagacgctttattacaaggttatgccagtctgctgttgaaattcaacccatctgaaacagcaacaggagcctgacatttgagtgacacaatgcggtttacagagaatgtctgccaacaggatcgggtggcaggaaagtgacgtccctaccctgtttcaatgcctggtctccttaagaagcatttaggatgaaatttttgatgcacagacagcctgtttccttattgcattattcattgtgtgactggagagaaattgttacacatccaagccccagaccaggtgacagcaggtgcccaggggaacagttggcagattccccctttcctcagcagacatggattttcactgagaggcactttttttgacacctgaggccaaaagagagtcgggaaggtaggagatgtgtgccctctgtccagactgacagtgcagatggtggcagcgctccacatccctgggtgcccctgtcattttccacggacttctgcacttctccactgcctctcgaagcaggatatttctctctcctccatctgtagcctccctggctgcaggtgaaaaggccctttcaagtgtgattgtcctgcaaagcatgccgagcccgctgaagcttaagagaaaaattgttatgactgatcttcagatgacagcaagtacatcttttagaaagtggagtgagtatgatgaaaaatacattatttcacatttgacttttccccaagaaatgggaataaatttccccaagcaatgggaataaatttccccaagcagtgggaataaatctttccttgtttcaaggtgacattttttggacaacattgtagcattttggaagtgagggttcattgtgcattagcgaaggttttctcctagtgacttccactgcctggtctactctaaggaaaaatccacttctgaaaggcaatcttcacacaaacaaaggagtcagagaattacctgttacacaaggcacttcttacgtttgtctttcaattttatcatcctgtacatatgttttgtttgaccaacatggtaatgattaaaaggaagagaacaaagaggagatggataagagacttttatcggggcatgcactgtttgccatagatcccaccattcccagttgtctgatggctgcttcacacaaacatcacctacctgactccttagggatttgaagtttgcacctcctacatttgcttagtaaatacttgagagaagcagtgaggagtgggcaagaaggaaatcctttttttcttttgcttagtagtctatgtgttgggtttacagttacagcatttttcacgttgtatatgggaagagggtgacagtcagaggcccctgaattaccagagggttcaataattgacttctgtcttagttttagatctcctagaagcagatcctgaggcaagatttgggatcaagtagtttattgggaaggtgaagagaataccagtgatgaatgggaggtgtggcaggaaagagacagggccagttaagggtatgttatcctgccagtcatcgctgtcagcaactggagcttaatgccactgggaaacttcagaaaaccacaccaaaacttgagaacacaccccaaaggtatcccaccctgtgggaaaggagctggaataaaacccattgatgaggtttgttcccaaaaccttgtaaatgccccagtgctttcagcctgaggacagatgcacagagcagcctttcagcctcttgggaggaagcccttagacaaaaagatgcatatgctgacatttggaaactcccaggcacagggaattctaaagcccaagggatatgggctcacacacaactcccaaagtgcagcttaagcaaaacctaacctgagacttcgagtcatcactctctggataaataaagcactggcaaggtgatgtgtttactgttcaggaaaaggatgtagcccttgcaaagagggagctacaaaaaccagccattatgggacacagcatcttattttgctctgacaaccagaaggggaattcgggtgacgctagaaggtcttgaaagtgacaactgattcatgaacgtctttccacaacttgaggaaatgcagccacccagggcaaccctggcacaccttttgctggctctgatgactacatcccaacttcttcttaatcactcttcagagttgctgctggagggaatattttaggaatatttaaagacaaggctacaaaaattctctaaggtacagatgagacagcgcattgattgtttactccctaaggggctgcaaagggcaaagcacagaactcaggtcttcttccagctggaatgtatggacagggaccacttacaagaaaaccaccatccaggaaagcaggggacagagagctgcctggggagacagtgattaatcaggcatgggcgaggggaggccacagtgcctcctgctgaaatttaatcagagccacgggtcgtacaccatggcggcgagtgccagggcctctggcagacgatgaatgcctcctgccaaggagctctcacgaatactctgtgagcccagatttatgctctgcagccagatgaaggtcgcaactgagcagaactgctgcagcgtggaatctgcagttcagccttggaaacagctggtgccgttaccgtccttcctttcatttctgggataaagagaactaagagaaaagtctggtgggtttcgggtgatccttgtgaccagccgtctcattttgccagggactttcctgtttttagcattgaaaagtcctacatctcaggaaacccctcaatcctgggcaaaccaagacagttggtcacccaccctttggcgctattagtagcgttggcccacctgggcccagtgagaaattcacccgaggttagaagttgacatgaatgtaaactcagcagcacctctgacatcagaaagattcatcactacaatggctggatcctttgagcagtgagacagaataacacaggattctgacctccaaggtggttacacgaaaaccagacaataactaaagacaaccacaggcgccatcaaacactgaatcgaggtgaggatttaaatcagaggccagggcaactgcatcatccttagcttggcttttccagagaacctgataccctactcccgctgaactaccacagaacccacagggactctgcagagtctggaactgaccagtgaaagttccaaactacaaaggataccatctatcatcactcccactcacaactcattgattaaaatggcttataagacctcacccaaccacaaagaggcctggtcatgggctcagaccgtggacagtttgcaatatttagcaagcagcagcaatgactaccacaatgtgtaccgaaacagttaggtagctcaagaggtaaccagttgacctagtgaggacaaatgtgcaaatgtcgaagatgtttgtgaatagtttgaataaaatttgccaaagatgttcatgaataatttgaataaaatttttcatgaactacgagtgcagaaaggcaatattcataaatcaatacattgtttcatgtgcaatttaaaatgtgtttattttaaaattcatattttaataacagattaaagtaatataatggaaaagtgtctgcaagtctaaatccaacacatcaaagaaaaaggaaaaactgagtaaatatatatgcacatagataatgaaaatctagctcagtttcttaatacaggaagagctcttacaaaccaataaaaggaataccatgaggtcaggcgaggtggctcacacctgtaatcccagcattttgggaggctgttgtgggcagatcccttgaggtcaggagtttgggaccagcctggccaacatggtgaaactccgtcatctctactaaaaaaaataaataaagaaaaataaaaattggctgggcacagtgctatgtgcctgtaatcccagctacttgggaggctgaggcaggagaatatcttgaagctgggaggcaaagactgcaataagtcgagatcacaccattgcactccagcctgggtgacagagctatactctgtctcaaaaaaaaaaaaaaatctatgaaagaaaaaaacataggcaaagcatattatcttttggggcttggggctttgctaaataataaagcaagaatacaaatgagcaggaaagacacaaaaagataaattcaactttagtgaaaaaatatataactcaaaacaataaggtactatttttacccaccaaattggcaaaactatttttaagaaatgacaattctaaattatgacgcatatgagctgaatatagagttctcatgcactgctggtaaacatataaactgttaacaaactttatcaagaacaataatatggcagatggactaagaatcgtcattcattttttttcacccagaatttcctcttttagaaacactgcctaagaaaataaacatacaaagacatatataagattatgttcattttaaacataaagcacttttttaaaaactagagacagcattccatgtacattcaagaagaggtgtaaataaattgcggaatggctatttcataaaactaataaaaaattatggtgtagaagagtatttaatcacataaaaaaagtcaattatataaattgtgagaaatacattttaagcaggccaagaaagttgatctatttttattatcccaatttcactttcaagcccgttcttatactttgcatttatatgtaaaattggcaagaatccacaaaatatcaccagtgattatctattcatgtaagattataaaggacttttatttccttcatcttctatattccaattattctataataaatattattttcatagtaaagaatacaataactttttccaaggtatgctaatgttgtattaagaaattaaggtgactggaaaataaaaattactataattgtttacaaaaagataagctctcccaggcttgcctcaccaggggtctgcaccctgcacccataccaaccccagaccagcacctgttctggtcattaaccctggtggctacccattggttagggtggagggactgactcactttagccacaagtttctcagagtgggatttccacctcctcaaatgtaggcaatgcgctggggacacagcaagccactgcaccagtctctagctggaatgtcaccttagctgacggtaagcaatttgtaacattctttttatattatgagcaaaataaaaaaattgcttgaatgtttcagaaattttgggcttgtgagaggctacttaaggccatgcccagcaagttccaactcactgctctcactgagcagggtttctcagcctgggcatatggacattctgggcaaaatactgttttgtcggtggtgaggaggttgtcctttgcatagaagtttagtagtctccctggcctttatggactagatgctagtaaaacacacatggttgtgatcaccaaaaatgtctccatcactgcatcctggagaaaaagtccacactagttgagaaccagggtggttaagtacactccatagtacctaggttaaaagtttccatttggtaaaaacttttgagaaacactgtaatcccactaaactccaaaagactggcagaattcaaagtggagttgcaccactcacttaatttcacctaaatgcacttgcctttttttttttttttttttcctttcacccaggctggagtgcagtggtgtgattatagctcactgcagactccagctcctcaaactcctgggctcctcccgagtagctaagactataggtgtgcctcaccacgccaagctaattttttcttttgtacagatgggggtgagtgggcctctcgctactttgcccaggctggtctcaaactcttggcctcaagtgctcctcctgcctcaaggctccacttcccagagcactgggattacaggcatgagccatcaggctggcctacttgcctcaggcagctgacagccattccactcactgagcatgagctgcaggattagggtggagaccccgccccccagcagacagccccacccacagtgctggctcttgggtcatggcctccctttgtccttcagctccagggccaccctctaatccatgggtgaattcccatttcccttttgggttttaggctttcctttaacacctattccctggataaaattccctctgttgacctgccaagtgtggcaatatttgcctggctgaatttcaattgatatattgtatatttattgggataatgttacatatatataaatatacatatatatatgtatgtatgtatatatatatatgtatatttgagactgagttttactcttgttgcccaggctggagtgcaatagcgcgatctcagctcaccgcaacctccgcctcctgggttcaagcaattctgactcagcctcccgagtagctgggactacaggcatgcaccaccacgctcagctaattttgtatttttaatagagacgaggtttctccatgttggtcaggctggtctcagactcccgacctcaggggatccacctgcctcagcctcccaaagtgctgggattacaggcgtgagccactgcacctggcacatttatatattaacatagggaaaattgacatctctgtgatcctgtctttctattcgagaatatggccaatatctttccatgggatcaaatcttcatcttcgtccctccttccatagagttcagagaggttcaaagccttatttagcacttccttagcttttttttttttaagtttgttgaatttcttcccttttttttttttttttttttttttttttttgtgacggagtctcactgtcgcctaggctggagtgcagtggcgcgatctcggctcactgcgggctccgccccctggggttcacgccattctcttgcctcagcctcccgagtagctgggactacaggcgcccgccacctcgcccggctaattttttgtatttttagtagagacggggtttcactgtgttagccaggatggtctcgatctcctgacctcgtgatccgcccacctcggcctcccaaagtgctgggattacaggcatgagacaccgcgcccggctcttcctaagtattttatcctttatgtggccagtgtaaatggggctgcctgtagggtggctgtgaagactgaataggataatatgtgaagtacttaacaagtccctggcatgtagtaagtgctatggaaatgcttgctgtgatagtcaacctttgttttctgcacttcttcctctaacgggttatggtttagatgtgagccatagttgttctgtctcgatttctgcctagctcctgttcaggtgaagctgagaggcagaaatggatcaagccttaagcagatgcccaagatcaaggcactggcaggttcagtgtcttgcaaaggctcactctctgcttctaagatggtgccttgttgctgtatctcatagaggggacaaacactgggtcttcccatggtggaagggccaaaaggggcctagctatttccctggagcccttttataagggcagtaatcccattcatgaggaccaaactctcatgacttaattacctcctaaaggtcccacctcttaagactatcatgttgtgtctcaggttctaatatatgaatttgggggggacatataagttcaaaccaaagtagggtggcatgccagcaacagccccatcccataaccagctctcagtcctcttatggaggtcccttccccactcatttctgcccccagaactagagaattttcctcactggcccatcttccccagaagccagagactttttggtgctaaaacccaatcaccagaagcaaggacacaattattattgcttcatgtgtcctatctagcttaagaaaacaaagtttaatattcctagaaaacgaagcattcttgtgggcaagtctcatggtttaaaacaaaattaacgtttgctgtttactgttcacggttcagaaacaggctgacaattgctctctgtgtaacagtgagctggctgcataacaaactgccccaaaactcagtagcttaaaataacaatcatttaattttgctcttgggtctacaggtcagctgcgttgttctgctgatctgcaccaggctaggctaatctcaggagagtgagttagagactgacggatcgaggatggcttccctcctgtgtctggcagctgtcagcaggggcagtgaatttgactggaatacttctctcttatcaatcaggaggctaacctaggcttatcttcatggtgcaacggagttctgggagagatcagagaacataggagttcttgggactgatgtttggaactgatacagaatcactttcccccacattctattggccaaagcaagacataaagccagcttggagtctaggggtaggaaatagaccactcttcttgatggatggggctgcaaaggcatagtgcacagggcataaatacagggaatcatgaataattagggtcacaatcaatctaccacactccccacacaaagaagagaatgtttagcatcgatttccttcattttagcaaacgttgcttcatctcactagcagtctacatatggactgattcaggagaaagttctgcagatggtcaacctcactcacccatttattgtgaaacacatcagttgtactttgctttttttttttttttttttttgagatggggtctcgttctgtcacccgggctggagtgcagtggcacaatctcggctcactgcacctcccgaatagctgggattacagacatgtatcaccacacccagttaatttttgtatttttagtagagacagggtttcaccatgttggccaggctggtctcgaactcccgaccccaggtgattcacccacctcagcctcccaaagtgctgggattacaggcatgaaccaccgcgcccggccacacttttgctatttcttgataccgagcccaaatctgagtctgtttgagagtgtgatcctccacaccaactgtagggatatctatttccctcgctgtcctggtttctgagagcagttccttgttttggttggagttttccagcatagatttaccaagatgctgagaatagttcccagctagtggttgaataaatatttgttcacttgtcgattcaatcaatcacaggctgattaattcccagtgctgttagaagtgattgaaaatgtcacatctgattgtcaggcggcagagagcacttggaggtaatccagtcatctctcttccttctggcttctccactcttaaaccactgattctgtgtcagtttcaagcgtaaggaccatggacacctggtgaccacacagggagagactttccctgacaatctcttctgtcttctccctctagagggtaaccaagccaccctgggccaggctgtggagtggctggaggttgcacctgccccttgcctccggcactgcatggctgcactcctatccaccctcccagcccacaggtgaacactaagcagccccaggccccattgccttggggtaagaaagtgggaagcaagaaactaatggtccaatcctgggttgtttaggtagagaggaaaatactcagaagacaaggaaaaggatttttaagaacctctaagaacatggtttgaggagaagagccatgctaactgtagggacttatgcaaagtttgccatttaaactaattagcatgtggcaataactactgtgcttactactgtgtgtttaaggttttattcactgtgtgttttacttgatcatattagactttcctcctacatttggagttcccttgctcaagtaaaatgtcatatattatgtgtttaaaaggattctagtatccaattgaataaaaaagaatatatacatatgcacacacacgtaagatttttatatatcatggagtaaatgtatgctttatatttataatgtctacatatcatatttaaatttatatattgatatatagctatttaaaataaaaggtatatatcttctataaatgttttgtatagcttatgtagctaagaaaaattatatgtccatatacttgcattttcactaaaaaatgtctgatacataaagagatgtaagaatgagataataattacctctagagagttgttttttattttcctttccatacagttagacttttcattgtgagcatgtaccacctttctagcttttttaaaaagcagtttatttgtaaattttaagacagttcttccaattttcttacctcattatccccagcttaaattgtaaattcagttgacttttttagattgaattcttcctggaaaaaaaaagtttcccacaatgccctgccagaaggatatggtgtccaacccagtttaaaaagtgcacccagtctttaggttcaactgctgaagaagcccaacccctgggctggagacctcccctgccccctcgcagcccaggctgtgggtagcggcagcgtctcccctgctctccccagggccgcggcggcaaaggcagcatctacgtgtgggcctccggggacggcggcagctatgacgactgcaactgcgacggctacgcctccagcatgtggaccatctccatcaactcagccatcaacgacggcaggactgccctgtacgacgagagctgctcttccaccttggcttccaccttcagcaacgggaggaaaaggaaccccgaggccggtgtggtgagcacgtccccttctgtccttgtttccttagggccactgcacctctgtgtcagggtgggatgctgggacactggcttgctcccctcctgtcccctccctcagagcctgaactaaggctctgaagggaagaccccttttctctatgcccagtcctgctttctaacaaagcacagacctcccatctgcgagctagtagcatgatcggtgaggactcctttctggatcgttttccatagattttcttgtttattgtttctggcttacaagtaatgatgaagtctggtttaccaatcagttgccccattccatcacttacaagaataactaactcattgtaagaaccaaggcatcacactgtaaccctgtctgaaacaagaacccatctgtttatttatagcaatttaaaaaacaacattcacggatggacttttctggatccataaaccccgtaaaattgcacacacatctgttattttctcagggaaagagttgtgattttcatcatattttaaaatggagccatgatttttagaacaaaaagattaataatcacagatttattgtttgttgctcttttctgagcaaagaaaaaaaaatcttcctttcttggcaactaggtataatggtgaattttccaagcccctgggaaatacatcatctgtaaagcataataagcttttttggatcttttcctctctggagattttgctcacagatcagccttttcttacacctccaaaccaggatttagtaggtggttcagtagtcatgcatgaattatatcctgactggctgcacccatctccactgaggcttcttgagacaggaggacaggagctcaggacaaaatcattagtaccatccagtgtttcgatcccacgctcccacgtgggatcccaacttggcaagatggccatgcccctgcgtgagcgaggagaagccctttacctggaagggacgcagaccttaaaagcctgtccttcccacgagccctcctgcattcccccttggtcttggggaggatgaagaatgtgccagctcctcccaaacagaagggggctttgacccctcttatcctgtaagctgtatggacagaaagggagaagggcagagcagacagggacaggtgaggtgacacttcactctcacgcctgaaagctccactccctaccccaaagacctctcagtggtgtaaatttgtcctcgacccgtatttatgactctttctacttgggctggctaaaggccttgagtttcctgtgagtactataattttgctcaatagatgcccttaaacctccctggtaatttcttcctcaaaataataagctctcttgaggatcctacagacagaggaagaattcccgtcgtttatacatgattttaatgaacaccctggctctcacaaacattgaaaatgaggtttttcactttgtgaaagtcctttaaaaatctgtttaccagtctcccctctaaataagagttgtggaggtgatacccacatattgggttgtcttgactcaacacatctcagaatctctccgtggattttagatgtagagaaacatgttttaatagcctgcccttctagagagactttagctgagcatgttgattctttcctcttcgggaatgccttctttcccccaagaaggaaaaagaaatgctgatgaagtggcctttggcctttcaagggccagtcccaatgcaacaaaactagggtgggggtattgacatcactttccacttcataatgtttccttttaggtttcaggaaataaatctctctgtagtctctggaatagccacagatatgcttctttgaacaactcatttatcttgtggacactgtaactataactgactatatatccccttttacgtgggctactaggaagctcagataaaatctagggcaaaagagaggcatatggatgctaagtttatccttagtttcatcttaatcttcttgggaacaaagcataggttaaataaaaggagtaggctgggggcagtgactcatgcctgtaatcctttggaaggctgaggcaggtggatcacctgaggtcaggagtttgagaccagcttggtcaacatggcgaaaccctgtctctactaaaattacaaaaattagccgggcatggtggcacgtgcctgtaatcccagctaattcaggaggctgaggcaggagaatcgcttgaacctgggaggcggaggttgccatgagccaagatcatgccactgcactccagcctgggcaacagagtgaggctgtctcaataaataaatgaataaataaaaggagtagataatcccctgctccacattgtgcgggggttcaaaatagcgtgatttatccactcattactcattatcttcccttccaggcaaccacagatttgtacggcaactgcactctgaggcattctgggacatctgcagctgcccccgaggcagctggtgtgtttgcactggctctggaggctaagtatgttcatagctctgggtccagggccagctctgcagggtggactaacacgtgtctctctgcccacatgccaggtgtccatggagggaaaagttgatgtgagaggccatgaatagtcagggccaatgaactctgctgtgcatttctaagtggcccatgtgcccaccagcacacgtgcgtgtgcatacacacacacacgcacacaccataaaaccacattcctgggagcacacaacacccagcagcacgtattagcaacttactcagatacccagtgaaggcacagagatatttctttcttcatcaaatttacccctctatcctctgtgtatccctgggctcttctactccagtgatattcacaatcagctacttgaagacaaatcaaattgccaggctggtgtttcagaacatgtggcaaacaaagtggtcccactcaagatttgttaatttgtgaagtggattcactttttaacactgaaacaagataggcaaagtcacgcagtgtagaccaagatatgggctttcctgggagaccttccaagctgaaggtaagaggagaccatctcctatgtcctcaccatcctatggagaggccacatattgctactgctggacacaccttggatttgagtagcagtggaggtacctgcccacctgctactctactttcttttaatgatacctgaggctggccttatgttcacagaatgaacacatgggcttcagacaccacacacatagtgtgagtgtaagtgccggctgtgtagggaattgtcagagaatgcagttcccagcaacttgtgagaagttggattcagtctcttggggaaggagagtagagttgctaggcaaccagggctcccagcatcaatctctaggcagccctgcttgtctctctccacataggcagtgcattttctgatttgcaaaggaggcaggagttggttcctagaatagaaaggggcttcaacagattacctagttcaaccctctaccttcacaagaaaaggcataattatcctccctttacagataagaccccaaattgagagtgacttctctttttggacaagtctaaactttgactcttctaacaaaattcagatagaaaatttatgatgccaagacactggtcaaagctcaactattaggcacagagacctctgccctatcaagcacagaaaacaaaatttactcatatccaatgtacatttcctgaagataaaactgttcatctcagggtctgagtgggccctggagcctgagctggccttgctcactgcatccgcaaggagacaattagcacagcctgctgcctgtagctgagctgtgcagagccagggaacaggagtgctccaaaagcgagaagggtttccggttgccctttcaacctcagaagtcaggacttgactcacagtcttctggatttttgacaaacaaaatcctatgcctatgcctagatccataggcacacaaatggaagacctaaataaatcaaagtgggggagtgaggctgctggactcctagagattcatggctctgccttgattagtcaccattcttttagcacatacgtccagatatcctacagaaaagaatgcagtcaccattcaggcatgctttgttttgaagcaatgatcatgaacttaatattctctgctggcataaagaggaaaaaaatataacacctggcagcttgtgggtaagtccatcacgggagccggtcctaaaattcttcaaaataccaactttctgaggttggaagcagaccctgagatgagattttggtgcaagtgatttattaaggaagggatcccaggaaaggcagtaagggagtaggggaaacaagttagggatggggaagaatccaagcaaaggttcaacttcaaaagttctggcctcagtctaatcccgagtgtaaattaggcctcagagtttgttctacctccaggcaaggaagcaggactgtcatattcttatatgagtcagtcatcggctaagagctactctggagaagtaaactccaaggcatctctagctttaggcaaagcggctccaatagccaaaagtgaaaaccattggtcaggatgagatactccaaatgagagcccagagggatgaggaatagggcctccacagagcagtcccaaagctcatctctctcttatcttgagataaggttacaggaagtcctcatgcataacaacaaattatctaaatgtatgtccatcaggaccttgaaagagagagaacaacacttcccccatcatgactgtaggggagaaaaagaaaaccatctctctctcctaaccagttgtcactttgtagtttaatatcataatgtacttttctgcctaatgcttgaaaatgcctacttgagtcacaggaaatattgctcccatctcccagtatcaccaatatcagagaaatttcaaagaattttagtgggggatgactgccaccttcgaatatttaggtttctctcatatgacctggtgctttctctgtggtcctagagggtgagctaggctcgaggggtagatgtcataagaagatcagtttttgactcaagaaaatcatctggagtaaagtggtccacatgctggactggaacaacatttccaaaactgaccttccaggggatggatttttaatgtaaactctttagcgagtatagtatatagaaagaaattcattaggtgtggctccatgacattttaactaaatgaacagacccatgtagccagcacccaaatcaagaaacagacgatttatgtgccctgttgctcagcagtgcaagagattcctccatgttcctgtatgtagttataggtcgttcattctcattgttgaatatcattccattgtataaatggatatttggattgtttccatttggggctactatgagtgatattgttaggaacattcttgtacatgccttttggtgaacatacagatacatttctgttgagcgtctactagggagtcaaaatgttgggtcattaatatacatatgtgcaattctagtagatatcgtcaaatagtttcctgaagtgggtgtacccattgaccctaccttgagcagtatatgagaattacagttgccccacatccttgccaaaatgtggtattattagtcttctatattttagcattcttatggatgtgcagtggagtcatattatagttttaatttgcacttccctcatagctagtgaaattgagcacactgggtaaagttttttaaaaaatacattcccaagcctcacccaagcctcatagaatacaaatccctagggatgggtggcccaggaacctgacttttcaatgcctgttccccgggaatacttaagctgccagcctgtcgctgatctgtgaactagggtgtgaggatgatcaataaggcaatagctctgtgaatctatgactctgggtgcagagtgtgggtagctggcttctgcctctgattaggtgttggtattcagtcaagatttaatgtttctgcatgaaacaacgaatccaaataataacagagacaagggtttatttctctgtcatgtgaaagaaaatacagagataaggaacccagggctggtttagggtaccggggtaccattgtgaatcagggaatccagctctttctagctttctgctcctttgctctgccactttcatgttctctagacgtgctggaactccagccaccatgtttacatttcaggcaggaaaaggagaagcacaaagggcaaaaaaataaataaataaacaaataaaagagagagagagaaggagagagagaaagaaagagaaaaataaaaaaagaaagaaagaaaagaaagaaggaaaccagctgagtcagccatgttgaaggggttttccaaggagccccacccagtggcttctgcttatttctcattggctagaactgtcacatgaccaccgccacacttcaagggaggctgggaaatgtaattttatagctgaatgcattgctgttctgaataaaactgaagttttcttaataaggaaggagaaaagatagatatggagggaaatacaactgctaatgtcttctggcatctaagtggacaatcactcatctctggatctctattgtcttatcaacaaaaggtagcaagttagatcatcaataaggttccaatgacttcctggaatattttagctctgcttctgaaatattgtttttttagggaagttaatattttaattggatgtctggtgatttttaaggttgaatatgccttaaagctgaaaaacgttcatttacatacttttaaatattgaggtcaatacttaggaaatagtaatctaatttactttaacttctgatatatgtgatatatgttatcattaataataataaagtctttttattcagtgtccagcactgtgctaggtactttacatacataatttacatttacatcctgcaacaaacctataaggccttatgcccattttaaagatgtaaaggctagagctcgaattgttaaagtaacttatccgagttcacacagttggctttaagcattaggatgcctgttccactgggctctcggtggaacatagaaaaggccctgccactgtcttgcctgtggggctcaccactcatcctgccatggcaatgggttgcagtgaatgagttagctcttcctcaaacatgatgcacaaaatcaggtttcactttctttgagatgagattttccacaccacaactacaccagggagtcatgaaaactgaatttcctctcacgtccttataggacgtgagcaaacaaaggctatggagaaaataccagcttgactcacaaatgcattatttttctcagactggaaataatccaacctttgaaattattttttaatcctatcaaaatttagaggatagactcagaattttaaaaatgaaagaaaatgaatggatcttttacgactccaaacatctcttatgatgaagagaacgagacccagagaagtgaaacaacttgctccaggtcacacagtttacattgtcagataaagatcagatccaacaagtaaagggattaaaattctcctgttgacttctagaatttaccagatgttaggagaagtgattcctccaaccttaagactacagcatcatctttaaaacatttccattttcaatttctctaaagatgcatgtgctgactttaaattacttttgctgccttgatcattaggaggaaaatgttaattgggttcaggggaacttgatgctgtaaatagaagtactatgctctgaaagagaatggtgagggaacagccttgcacacgagaaaaacaatccattctgttagaagtcaggttcctacaaaggataaatgcttgaggtgatggataccccatttaccctgatgtgattatcatgcattgcatacctgtatccaaatatctcatgtaccccataaatacatacacctactgtgtacccacaaaaattaaaaattaaacattaaacaaaaagtcagtctgctggtcagccacttcctaagagatgcttgctgacccctggacccaagtttctcagatttcctgatgatcagaatcctggagtgcttgttaaaaacacagataccctaagcccactggagatccatagaatcagaatccccaggggagcccctggaaagctctatttttcaccagcgcccccacccccaccagtgccgtccaggaagttaggaagctctcccctgaacgaggtttgctgcatactgaaaatactaaatgtttggaggaatccatggaatcaaaacctctgaacctggacatcatttttttaaccatccccaggtgattccaatgtgcagacaaggttgagaaccactgtcccagactaccaatgttctcaaacatcactgtacagaagaatcatttggattaaatgcaaattctcaggcccacaatctccaagatgctgattcaggacaggtggaaattcacatatgtcactaatggtcctgacacagggggattgaggatcacagtgagaactcctgactaggataacacagaggctccactgatgcctccctcagcatcctgagctcccccatcatgacagccctcacattttcaatactgagttgtccctctgtccccctaggctatcagctggtggggacagggacatccgtctgacatgcccagagttagcacgatgcctgaatgtggtagacactcaacagacatccatacaatcacttcattgcgcagtaccttctcatatatctgcatcttattttcccgactcatataaaacatttgagaacagggaagaacatgtcacatttcttgtcctacagtctccaaaacagtgacctgtatatcgcagatactccataaatttattttttaattatttaataactatcacctgtaattcttgggctgctatggtacaattaaagcaggttgatgaaataaatacctactttacagaatattgtagtctgtcaattcctaaatcattcagaagggatactagaaggaacctggttttactcttcagacatatgcaaatagcaggtcaaacagtgtcatagactcagttacactggagagtgaactatgctgtggtttatctcaaaagtgaaaagttccttgttctgaaacattatttctctctctctcatgctctctctctttctaaaatgcaccccatgagaataaatctgcagagaaacatttaagggagcccttctccaggcatcagaagtacagcccattttcatggcaaagatgagaaatgagaaacctgctagccagccctctggtcatttagatcctcatttgtcaacacttctgagattaataaactcagaatccccttccagcaaaacactcagtttttagccataatcaacttaaggaacttttacaccattttacatcatttacaccattttacaccacttacatcattttacaccatatgtccaagacatgttctgaatctcctcaaataagcattgaccttccttggaacttgcttcttttctttttttctttttttttttaattatacttttaagttctagggtacatgtgcacaatgtgcaggtttgttacgtatgtatacatgtgccatgttggtttgctgcacccattaactcatcctttacatgaggtatttctcctaatgctatccctccccatccccccaccccccacacacacacatgacaggccccggtgtgatgttccccttcctgtgtccaagtgtggaacttgcttcttaatagaagaaggtctgcattcaagagcacatggatcatttgaactcttggttctgattcagatcttccaaccaatgaactttgcatatgttgaaattttatcaaatgagttatgttgctcctggtcctttgaattgtttgacttctgaagagaactgtagtgcaaggttttgccaactttttgaccagaatcctcggtgagtaataaattttgcactgcagctcagcacacacacacacagctaccctccaagtatttcatgaaaaaatagcttcctgtattatgtgcagtgcatactgcttttctattctgttccattcattttttaaaataataacaccaaccattaaatcactggttctcaacattggctgtctgttggaatggtctgagaagttttaacagtttccaatgcctgggtctcactcccagagattctgatttacttggtctgggatgaggccctaggcatgagatcttcaatgcccctaggagaaaattttcatgggcagtcccaacaacctgtgcgataacctggcccaaaaacaaatcatgatttgcaatttgaaaaacatagacaatgtgtagtaatagacactaatttccaaaaacaataacatttacaagaagactagtttattcactgaacaatgtgccaaggaccatcctggacactaaggatataaatatgctaaatataatttctctacccttgaagaactggtaccctccttttcaaaaatggaacacacccacatgccagttcccagatgaagggacagcaagaccagcactcagaagctccctgtatccccttccagtcactgccccacgagactgaccactaacatgacctccaacagcatagattagtcattcttgtttttatattttaaacagatggaatcatactttatggtctcttttctgcctggcttctttaggccaacatggtatttgtgagatttttccatgttgttcagagtacctggagttcattcattctcactgctgtatagtaccccacattctataagttacacctcaattagtttactccctatcttttggatggcatgtaggggtttcacagtttggggctaggagcattctagtacacaggtctggtgaatatgtacacatttggtcaggtatatgcctaggaaaagaatttccaggccatagcttaagcttaactttagaagatacagccaaacagttttccagtttagttggaattacttgcacgctcatccacaaagtacatgtgttccagttgctccacatcttcaacacttaacattgtcagtctttttcattttagccattccggtgtgtgtgttagaatagacttttgaaatcaatttatgtaagtaagaaaagcaagaagatttctttaattgacttatatagtggttttgaatggtgcatggacaccctcccttgaatttgagagttcacagagattccaaaatcttacaagaggtctgtgtcctgagtaatatttctcttaatcattgtgcctctctccctctctcaccctgccttttgcccttgccctcttgctctctgcttcctgtatccagcctgggtctgacctggcgggacatgcagcatctgactgtgctcacctccaaacggaaccagcttcacgacgaggtccatcagtggcggcgcaatggggtcggcctggaatttaatcacctctttggctacggggtccttgatgcaggtgccatggtgaaaatggctaaagactggaaaaccgtgcctgagagattccactgtgtgggaggctccgtgcaggaccctgagtaagtgggggtagtggtccctctgctgcatgtggaaagtgcccctgagatggctccatggcattggcataatatcacattccctcttcatgtttgggtcaactgtattttttgtttgtttgtttgtttttttgagacagggcctcactttgtcacccaggctggagtgcagtggcgtgatcacagctcactgcagccttgaacttctggtctcaataatcctcctgcctcagacttccaagtagctagggccacaggcatgcgccaccacaccctgctaattttttttattttttgtagagacaaagcctcactatgttgtccaagctggtctcaaactcctgggttcaagtgatccttctgccctggcctcccaaagtactgggattacaggtgtgagccacaatcctcggcctggatttgactcagggacaaccagtttccaagcagagctgcaggtttgcataaatccaggaggcaccatttacatagaacacagaacccctgcttttggttgtgagccttaactgtttcagtgatgtatgccattatttctaagggcacaaatcaaccactataaacatcacccagctcaataaggagaacatgactaacacccccaaaggccccctgccgtgaccactgccattaacatccccatgccagcgtagccatattcttacttctaactccatagcttaacttgcctgttccatacttactagaatcatacactatgtcctgttttacaactagattatttcgcttggagttatgtttgtgagatccagtcatgtttaatgtgtacttacagcttttctcattgctgaagagtgttccagtgtatgactataacacaattcgtttattcattctacctgtgggacaatctaaggacttgattttccgctgagtgaggtggattttgccacttggagggatttgtgtatggggttccctacacagaaaccacagcgttagtcaactgcacccacttcccttccaactgccccaccttggcaagtggattggtcagtaaggatacttcttaatttctctctgtcctccttgatgcattagtaaaatggagatagtaatttttattattatcactgaggtattatttacatgtcatcaaatacacagaacttaagtgtatcatttgagtgttgataaatgtatacaccctggtaactaccactgaatcaagagatgaggcattccatcaacccaggaagattcgtcatacctgcttccagctcgtccacacgctccacaggcaccctttgtttttgcttctctctctgtagattcgtttcaccagttttcagactggactgtgtccagtttctttttctcagcatgaggcttgtgagattcgtccaggtcaccatgtgtagtcgtagctcattcattctcattctaccttgagaatacacctccgtggcttacatcatttaaatggtggtaaaattcattccctgccagggtcatatttccgaggaccatcgagcctggccagagtccaacccctctcagactttatcctcctcgccactcttcattggtcctagacttgctgcatctcttctactcagttacccagacctgaattccaatcttgacttcaccaacttagacaatacttttgacatttctgaccctctgctttagcaattctcaacctttgtgccctgtctccctttgacagcatggtgacgtctatgggccccatcagtctaatgttctccaaattcattagataaaatgcactggattgcaaaggaaaccaattatgttgaaaccaattagaaaataaattcatgctgaaatatatgtccccttgtcagcacattaagtaaaaagctctagtggcaagtctaatggccacaataatttcagagcagcagtgatgactaattgctgctgcaggatccatgcagtggctgtggtgggacacgaaaatctgccagctctttgatgacaaagtccgaggaggagctaatgccactctgctttgtggcctgcattcataatcgaaagagaagaaaagtttctgttataatctagtgaaaattaaaatgtggaattttttccattgaaattattagaccccctgaattctatccaaatgggccccaaaataagagatttttttctctttcctcaccagtaaaacggagctaatgtttttcctccgcaggctgctgggagactttagcaacacacaagtctacagcaggcacacagtaggcacttaataaatgtaacattgcctctccttctcattcatgactagatgtgaacacttctagcttacacctgtagaatcaaaagacagtaatctcctagagtttttggtgaaataattgtctgatttttatgcaaattccaaatcagatatcctctcagcctaaaatatcctccaatggacaagcatgtgccctgggattcccatcctcccatgggccagcagcctgccatagatgggctgcctaccataggtaagcatcctcccacgggccagtgtcctcccgtagatgggcagcccaccataggtcagcatcctcccacaggccagcatcctgccatatacgggcagcccaccataggtcagcatcctcccatgggccagcatcctgccgtagacgagcagccaaccataggtcagcatcctcccacaggccagcgtcctgccgtagacgggcagcccaccataggccagcatcattccacaggccagcatcctgccgtagacaggcagcctaccataggtcagcatcctccacgggccagcgtcctgttgtagacaggcagcctaccataggccagcatcctccacgggccagcgtcctgttgtagacaggcagcctaccataggtcagcatcctcccacgggccagcgtcctgctgtagacaggcagcctaccataggtcagcatcctcccacgggccagcgtcctgctgtaggcgggcagcctaccataggtcagcatcctcccacaggccagcgtcctgctgtagacgggcagcctaccataggtcagctcctccacgggccagtgtcctcccgtagaagggtagcccactataggtgagcatcctcccatgggccagtgtcctcctgtagacgggcagcccaccataggtcagcaccctccatgggccagtgtcctgctgtagacaggcagcccaccataggtcagcatcctcccacagaccagcatcctgctatagacgggcagcccaccataggtcagcatcctcccaagggccagcatcctcccatggacaagcatcttcccatgagtgagcatcctcattgtttactcactgaacccctagaaagtggcaccaagtggattactgccaagctgagtattttttttccatgaaacagtccatgatttaagaaggcctcactctaatcagcaccacatggaaaaaataaagcttcagcccaagccctataataatctaaaaacacagagctgcccaagtcccaagtgatgttacaaatgtcctataataaaaatagctactctgcacagttcctcaccattttccaaagcttctgtgtccacacatcatttctgttcactcccgtatccctcctcttggcaggacagacttctctgagctctaaacaagttgattgacacagtcaagcccacagaggctgtaaatgtgagactggaagtcacttttattgagtgccaactgcatgctatgtgctttcatacacgtaagcttcacagccaccctattgttgagggtgtgccttatactcgcacagtcgaggtgggagcaggggtgaatattttgcagccttaacaacaaactggtcccatgctgggtgtcagggagaaacaccaactaggtgtggtatatgctaggcccatttacattactgtatttaatccttgtaagcccaggaggtgtgtcctatcattattactttttatacacaaggaagctgagatccagaaaggataaaaaaaaaaaaatgtgctcagagtcacaaagggcagagcaggacttgaagcaaagcccatctaaacccaaaccccaggctcttttcactacatgaccttgaccttaatcagctcccgtgcatacaggtcctacattaggccgtatgtgagagcagccctactgtgagctcacagtgccattactgatgacaggaggttgggaaaggtcaagggcatgctaaatgtcatccagctactaagcagccaaactgggatctgagcccagtcactttgacccctcacggtgggctctcaggtatctcagtgactccccctggagaaggtgaggcttgggtaggggagggagtttcagtaaacattcccctggggattctgaaacacccacctagtgggtgctcccatctcccaaaccccatcactggcattccagaggcccttttcactggtctacaatgccaaggtctgccgtgtcttttgggaatgaacaaagagacaagactgggaaccactgtccaaatgggggatttaaggctaaaccctactcatcataactaactttacccaaagtcaacatgaaatgggcgttgacaactgtttcccttgttagagttcagaataatttcttgagaaatttggaagtgcagtgactttctgcagtggtgaaaatgttctgcactgtccaatacaatagcttgtggctattgagtgctagaaagtggatgaccgtgattaagaaacaagagttttcattttatttcattctcattaatttaaatttaaatagcaacatgtggctggtggctaccatcttggacagccatgtctaaggcacatctggtagttacatcttagcaggagggatgctgaattgtgcaaaccgaatgggaagtggagatttaataacataaactctatgaaggggtgtcaagaagatgagactgcaagaaaggcttgctggtccattttatagcctcatgccttcccccagcacgacatccaattgcagcatcctagaagcctaaaggcagccttgggagggtgctagtaagaactgctgctaagaacttctctcggaaagtcactgggatagcactttattccactatctcatttaatcacaggaggttggcatccctagtcttaatttaggtgagaaaacaggatcagacaaataaagcaaacggccttaactccaatgtccttatccattccacaaggccctggggcctggtacctcattcccttattgcaaaaggagaaagacttacgatgtctgtgcctttacagacactctgcaagcagggagtgggggctggaatgtccctcacaggcagtgcaactggcacgatatctacacttacttgcatataagcaatatttacaattaacaaaaaggcagcaccgttgcagtatttaggggaagagttagcttggaatgtactgcggccctcttagtcaagctacgtgtcaataccaggctatattttctgagattgcactggacaagccagacggacttctaatgatcgtcaagcaccatatgattatgagagagggcaggaggggagcaccgcgggagagaaggagagagagggaatgagggcgtatgctgagatgaacggcagtttatctcccagtttctgaatatgcttagcattccatcataatctgcatacatgtggaatttaaggccagagagaacactggaaataatgttatccaagtccctgtaaggaatctgaggtccggagatgtgatcatcccaacatctcacaactatccaggaactttatgcaagatcaatgcagtgttttcaatgaagagaaatgggaaagcactatatttcagcactaactcagttggggcctcccaatggactgggccctcgtctgtcatattcatggtgtaaccctagtgcctacaatagtgctgggcatatagtagacaggtgataaatattttttaaatgaatgagggaatgaaaatattcagccagcagcagccggacacaagggaaatgtctgactgctggcaataggaccggcgggccagcaaggcaaatgtgggaaggaggctctgccttggttggaagggctctgcctcctctcagtgccctccggtccctcgtccacccccacaccagaacttgttctcagatgcagatgagttaggtctagggcaaatacacttgttgaagaatgcagaggctccacagggagatttggagagcagccccagggctggctgtgccgcttgacagaggaggcccttgtgaccacgaagcacactcgaggagcggtggggtacaggaatcaacagccgtggcaatcgccactctccataatgtgcagggctgcacagaaacagcttccaaggtggagtgagtggtgattgtcaggtttgtgggtttccttggcattaatcttcccggagatggagtcaatttgaaaagcaattttctaaagaggctttatcaagagagtcagtgaaggatgctcagctacaatcaaaggggaaaatacacctggctgtgaccagctgcaccagctgtgtgtagaatgagcagagccagcccaggccggccccatcagccagctgggagtgacctgtctaacacagctgcccccagcccctctgggcaccctgaggggactgttcactgagctcctttaaggctgtgccaaaatatgtgatccagctctgaagtttaagtgaatttggaaataaatgttaaaacctggtatcaatgccggaagcagcatgggagtgagaggtcagcgtgtgctcggccctgtgccacctgggggactgtggaccagcactcccgagctgcagaggcttcctgcacaagttcatgcccacctgactctgctacagggggaggagaaaacctcaccatggccacctgctgcgtgtcgtcatgtgactgccacaaaagcaggcatcttgggcacttgagaaagagtggctgtcattgttactattgtgattattctatcaaaacaatcacagccttataactttttctttttttttgagacagagtcttgctctgtggcccaggctggagtgcagtggcacgatcttggctcactacaacctccactgcccaggttcaagcaattctcctgcctcagcctcctgagtagctgggactacaggcatccaccaccaaacccggctaatttttgtatttttagtagagctggggtttcaccatgttggccaggctggtgtcgagctcctgacctcaggtgatccgcctgccttggcctcccaaagtgttgggattacaggcatgagccaccacagcttcataactttatcttacagttgaagattcataacacaagaagcattccccagggcctcctgggaagcaacacctatttcttgacacaaggcagtttaaacacttacttgcaatgatacacaataaaataaagatacaagccaccccgacaaccccaagtttgtcttttataagactggaacactacgattttgcatgttatctctaataggtcaaagaagaactcttttttttttttttttttttttttgagatcgagtctcactgtgtcacccaggctggagtgcagtagcgtgatctcagctcactgcaacctccgcctcccgcgttcaagcgattctcctgcctcagcctcctgagtagctgcgattacaggtacacaccaccatgcctgactaatttttgtgtttttagtagagacggggtttctccatgttggtcaggctggtcttgaactcctgacctcgtgttccgacccctcggcctcgcaaagtgctgggattacaggcgtgagcctccgcgcctgacctaagaactcttaaacctccagaaagcatgcttcattttctgcagcaaatgagctccagatcatggcctggaaactaacaccctgtgactatttaaaatgtttctgcagagcctctttttgttccaccaccaacctcctcctatttaaccttcttataaattgataattcctgagcatatatctcctttttgctttaaaataagaatgtttcattccttttcttctcataaaagcaatacatggtcactgtaagaaaatcagaaaatgcaagtgagcaaatgaagagagaaacaagaaacatctggaaaatactgttcctaggctctcccaatgccacgatgccagccaaaaaaacctgacctgtgaggggagaatggtgttctttctctaccaagttcgctgcctctggaattcacagcatgcttttaatttaatttcatagtaacttaatattctcagaagagtccagccacatgtctcctctctcagcagacccagctcctgtgcaggaagcagttcacatggcagggcaggatcggggcgtttttctagctggcagtctctccgtggtgctaaaaaagccagactcctcagccaacgtgaaaagagttgttctagtgctgggatgatctcttatgatggaaggagagaaatacagattggaccaaacctgagatgaccttcaggcacaccatggctaagggggtttcagtagatggtgacagtgcctcttgttcaggtccccttcactgggctatgcaccaccccagctactgtgggcattggctgctaactgtggtcttctgcctgtgtctctgaagaatcaccctcaggggctatggaaacctggctgaaataagaatacataaaacccatgctcctgcctccaagcaggacaactgtgtggtggcgttgatgctccaaagccagcatggcctgtgacccccaggcacaccccagtgtccaaggcttctaggaaaatgtgtgattcttaacacaagtttgtgtgtttgtccctactcccacctgtctttcggctttccaaggtgcatggaatatgtctttcagtctccctccatctctcccttgcaccctctatcacaaatgcacaccactcactctcaaataagacctttagcctgggcaatcggtggcctgtgttctagtttccccttctcagcctcgctgtcattttccctcccttagtcttagtcgctaaggccttccccatgagcgtggggctcctgggagaaacagatacgacagccaccatagaagattcacacagacaggaacacaccggcccttgttgttctgccagtgaggctccttcttgggactcaaattccaggctcctctgccatgcccttaatgtcaaagtggtcgccggcctacatctatctttacaataacttcttaagggctttttaaagaaagcaaaagaagtgaggtgactgagcccacagatggaatgaggcccatattctgtatcaccaacgatgacataaatatagtcaatagtcctcagacactgtgcagagggatgtggtaatcagtttccaattgctcttctccagagacagataacacctgttttaggttgggttgctcggaagcagagcctgagattgggtttgagtacatgtgctttattgagggagggcttttcagggagaactgtaggagagtgagggatttgggaggggcagaagtagccaagaaaggatgtggaaccaggtatgtgcatgtggcctgacccaccgggggctttggagcatcaacgccaccacacagttgtcccgcttgggggcaggagcattggttttatgtattcttatttcagccaggtttccatagctcctgagggtgattcttcagagacacaagcagaagaccacagttagcagccaatgtccacagtagctggggtggtgcacagcccagggaaggggatctgaatgaggcactatcactatctaccaaaacacccttagctgtggtatgcctgaaggtcatctcaggtttagtctaatccatatttctctccttccatcataagaagtcatctcagcactagaacaactcttttcacgtagcgaaggaccttatagttaattcacagaaacttcatgtatggtgggctgtggtcttatttctagcaaaagtggctgtctcatctctgattcttagccaattgaagaaatattttcagttttccacaaggcaagcaatgccatttttctgccagagtttctacaaattgacttgtaaagggtctgtcactatgactccagtccacaagggtcctgggtgcaaattgggacagaaaacaaattttcttagaattcagctggtgttctgaattcttaagataatagtgaccactgcacttgacaaatgattagtgatgttttataatatctataatgattgccactcagttacagtctttggttgttggcttgtgaatttccttcttgaaacttttcaagaagccctagactacaggaaagaaaagagagctcaaattcaacacagaactcagagccagggtctctcttcctgttatcattctctgcttcctgcaactgtgcttctcaaagactcccaaagcccctctggctcaactctagaaggaaagcccgattctgggcctggctgcttgtctgcctagaaaccctgtgatagaatgtgtcatttccctcataccttgaggttctggatgaatatttcagagtcctccagagaggtggccagaaaacctgcaaaacaaagctgcagtttccccaactgcttttcctagagcctgtgagccgggaaaaaactgaatgcccttgaaacagaaggccaagagactctctgcctgttgttgttgttcttatcagattcaaattcaacatacataaacaatttagacccgcactgtccagtacagacgcaaccagccacaagtggttatataataacatattagattagttaaaattgaataaaataaattgaacattcatttcagcactcacatgatctatgtttcaattgctcattagccacatgtagccagtggctaccatactagagattatatatatagaatatttccatcatcgtagagtgtcctattggccaatgctggtctagacatttgtaaatatactatgtatatgagtatacatgtatatacacatatagacacgttatatatatgtgcatatataatgtatatgtaggataatttatcttgccagcaactgttcagggcaggaattaatagctcagatcatgcaaatacttgcccacaactggactcgtactctgagactctttgtgctaccctacacagctgtccactgctgggctagagcccaatctttagttattcatcaccttacctgttttgtttctgatcttgttctgaataaatagcaccatctttgagaaatccaggttatggccctcattaccccgacccgcaaagttggcttaatgcctgctttccaccaaatggatggtttccccagatcctgggaacagaaagaccaaccccaccatcactggatccccatagctgatggacactccatacatgattcagcatcagtatccgggggtgggagaggggaatacagcagtactccatgaaaccgtttaagtctatatttgtaaagttcctccagagagtattaatgaactgcactgtatgtttcagcaagccctcccaggttcatggccttggttcctagggcaatgcagaaccaaggcttgactccaactgggcacatgaccactgtctttttgtaaatgtgctttacaagatgtgtgtttaaaaatattttacttatactccaaaataaaagccatattgaggaaggatatttgcataggcaatgggccagtacatgtgccaagcattgtgcctggtattttattttattttattttatttatttatttatttatttttcagcacaggaagataatatttattatattttaactagaaacagaacagatagcaagttcacgaggtatgaatatttttttcttaaatcaggcttaaacaacaataataaaaaacaagtctgcatatatatgttggtcactattataatcttcaagggcacaaaagccagcagcataaagaaacatgaataatgactgagaagttttgatgtgccaaaaacaaagatcactgcgttgaactcctttattttgttaatattattattaaacatttaacaggtattaattattgttatttggcaaaatatccaacatgcacatggtattcctacaagaatcttgccttaatattgttaatattaacactaagtttattcctctccaaaattcaatgagttatgattccactctctgtaagtgttagtgttagtggtaatatgcaaaactgattttgtgtgcagggttaagtagcagattgacttcgcatttggtggccagctgtgtaccctaatttttatctattttcttaataaatttaattacatttcataagccctgagataacctgctaatgattgtatacttttaatctatactttattccactcaatttgaaccccacataataagtcttcaaaattatttacagatggttgtaattaaagcaatgacaaaatttactacttgtatagataagactgataataaggcctttaactaagagttgcatattttacatgcacttttaacttgctaggagcaactcttaaaattacatctatcattctgtcagaaagcagttaagtgcttttcattttgcttacttctatatgtgtaaccagactcacttttttcctcccgtgtaaaacaactgttttttttccttccccaaatattaatacttgtcttccaactgaacaattgctaaaaggaacttagcatttacacagcacattgataactatagtgctcagcagagacatatgcccataataggcatctgataaatgtttgttccacatggaatgaattgtaaggcagctgtttgagtcatatactgttcatcatatactgcaactaattttgtttaactaggaaattcagtttaccagatttaattcaccctcaagtataaatccaaaaactttaaattaaaaaaaatcgatttactaatcctcagaaaaagtaaacaagttaatcatagttgttactatgctattagttgatagaaaatttttaaaaattactttccactaaatattgtgtacaactaagtgaggggaagaaagttttaaaaaatgaaaagatattagctaattctcatcattttctccacatttatccttgcagcttatttgttcatatatttattcctgttaacttctctagctgaaagagaattttattatctgaatggagttccccatcaccttacgtacaaaatattagtgaaaagctagtgtaaatgtaagattgtattttcatgtcatgccatatttctgcatttattttttgctagcattaaatttttcgtatttaaatgatgctgtatagaatatgagataatctgccaattgctatgatattgcttgcttacaatattcagtttttgttgatagctttaaagtatattgcacacttgtcatctagcacactaataaataactatttttgaaaggatacactgacaaattcttaagttaatggctttaacccaacatttttagtcagttaaagaacagcaatggcaaaaacattgacaatacagttcatggtccagttctcccatcttacggtacaggttccatcagatgtggtatcccaaaaacaggagctgctgtgcgaaagccatatgcgctcttctggaccactgcacatttcacaatacatttataagcttttcccagcttaggcagatgtgttaacgataattccactatgcttgcggtccactggttgatgttgttgtaattataatcttcaccacctaaaaccccgtctgcacattctttgacaatattgtgggcttcctcagcattgaggccaacctcgtcgcagtggcgatggtactcctccatggtagcgcctgttctccctgggggcggagctacgcctgtgcctggtatttcatacatggtcttatttaaccacacaagaatcatacggccgggcgcggtggctcacgcctgtaatctcagcactttgggaggccgaggcaggcggatcacaaggtcaggagatcgagaccatcatggctaacacggtgaaactccgtctttactaaaaatataaataattacccgggcacagtggagggcgcctgtagtcccagctactcgagaggctgaggcaggaatggcgtgaacccgggaggcggagcttgcagtgagccgagatggcgccactgcactccagcctgggcgacagagcaagactccgtctcaaaaaaaaaaaaaaaaaaaaaaaaagaactatccacaatgacagtgaaacttcgagtgcttaaataacctgcccaagctctcatgagcagtaaacatagaagcagaattctaatccaaatgggtttattctcaaagtctggagtcttgatgttacaccacgcaatcctcaaatgcggtttccttttttccttctttctactgcaagaacctttgagcttctcccactccaagaaggccatctccagaaaggagattgcctgtaaggacagcctagagagtacttgggcttaacctcgctccaactctcgccaaagactcccccaaagtctcctgatcattcattggactgcctttcactggaattaatttacccattttcagcttttctttttttttttttttttttttttgaggcagagtctcgctctgtcacccaggctggagtgcagtggcgcgatctcggctcactgcaagctccgcctcccgggttcaagccattttcccgcctcagcctcccaagtagctgggactacaggcgcccaccaccaagcccggctaatttttcgtatttttagtagagacagggtttcgccatgttagccatgatggtctcgatctcctgacctcatgatccgcccgcctcggcctcccaaagtgctgggattacaggcgtgagccactgcgcccggcccagcttttcttaatggtagtaatggcagtcatattagcaacagcttctatttatcaaagcacttagcactttgaaagaaagacattatgagttcctgcctcagtctgggttgtcccagaagtccaacctgagacaagacttgggtgctgacagttttttgagaaatgatcccaggtaacacaagtgaggaattggagatgtaaaataaggaaggggagaaaagccaatgaagagtgcattaatgagcgagttgccaccgtgggcagctgagctcagtcccactagggacactgagttgtcacgctgaggaatagagaaaccggggtaaaaacctgtcagtcactgggagagagctacccctcaaaggttaaatccctgccacctttgggccgccctgcacgcaggctgtgcaggcttccacggaggtgggaggaagcccagggggaacacggggagattctcgtgcctggggtgggaagcagtggacgtgcaagggagcttcagctgcaggtgaactcagaagggacttaggagactcaggagggacatcacagcatctactacattctccttccacacagaaggttccaagcgtaagtaacttgctcacagccgggcgtggtggctcacacctgtaatcccagcactttgggaggccaaggcagctggatcacttgaggccaggagttcaagaccagcctggccaacatggtgaaactccgtctctactaaaaatacaaaaaattagccaggcgtggtggcacatgcctgtaaccctggctactggggaggctgaggcatgagaatcacttgaacccaggagctgaaggttgcagtgagctgagatcacaccactgcactccagcccgggcaacagagtgggaccctgtctcaaaagacaaaaaaaaaaaaaaaaaaaaaaaaaagagataagtaacttactcaggctcacacagccagtgtgggaactaaacccaggtctgattgatcaaccccaaagcccttgccctttccgccacctgaagctgccctcaaaatcccttgtaaggtgcacccaccactgcttatcctatctcctcttcactctgccctcaggaaaataccatccactggcaagttggtgctgacactcacaaccgacgcctgtgaggggaaggaaaattttgtccgctacctggagcatgtccaggctgtcatcacggtcaacgcaaccagaagaggagacctgaacatcaacatgacttcccctatgggcaccaagtccattttgctgagccggcgtccaagggatgacgactccaaggtgggctttgacaagtggcctttcatgaccactcacacgtggggggaagacgcccgaggcacctggaccctggagctgggatttgtcggcagcgccccgcagaagggggtgctgaaggagtggaccctgatgctgcatggcactcagagtgccccgtacatcgaccaggtggtgcgggattaccagtccaagttggccatgtccaagaaagaggagctggaggaagagctggacgaagccgtggagagaagcctgaaaagcatccttaacaagaactagcgctgcacatccgcctttcccaccgccctccctccccagctccgcctctgtcctcgctccacgtttcaggcaggcacctagcaattccatcacccgtacaggcaattccgtcttcttaatctgaagcttcactcactgtcaatgattattttcattacaatggaaacaatcttttttactctatgccccaaatatagcgttcccaacaacatccatgtcctatgtgtgactctaaattctttatttctgtcattcaaatgggtgatatcctgaaaaaaaaaaaaaaaaaaaaactgggacagctttcccctcatttttttttttgtttctgagaaaagaacgtattttaaaagccacatagagtgactccaagaacaattgtccatggtctcaaacaaggggctgttacataacaagaaaatcaaagctgaggacagggtgtgagcgccacatctctgaaagcacaggagacactgtgctataaatcctttggggagcgatgttttgaatttagtgagatttaccagggatgtagattaaggtgatgtgattcaaaagatgccattcatagagagccctagttactgcatggggaaagagatccaggaagcatgagtgctggatattttactaccaatgccaagataattcactctactcagccggcgtggcaaatataaaacttacagagcgtggctgtgctctcaccagctgctgctctgagttatgttaaaatccgctagagcagcccaaatttttctcagtttgtatagagttcatcccagccccaattttctggggctcctcacatagctacccaaaagagaaaaaaaattaagacaagcctggcaacacacctggtgaagagtagtttactagcttttcaaacaagaatgtcccttttcctaagtcactttgaggtgtctcaatctgatctgagtgagaggcgacaggagtatttttttttttttacagctttacacacacagatgtgggctttgatttccaagtaatataatggaagagaaatctcatactcccccacagtttgatgtcattaatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactagacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaa

SEQ ID NO: 147 - DNA, 33053 bp, Homo sapiens
gctcgcagactgtgctataaactgcaatttctatttggggtcctcacggagaagaacaccaggaaagacagacaggaccagtgccatgggccagctttgctgctttcctttctcaagagatgaaggaaaaatcagtaagtgggatttgtactgtgcagaatcctaagtgcttgactattttgtgcggttgtcttctaggggtagttttgctctttttttaatgggaaggatagcagactaatcagctatggtttttaatgtgtgtttcttaaagggactggtaggtgtgtagttacaaattaactgtaaaagtactgcaactcagtagatgggctgtgttaaaaatacaaaatactgaaaactcatttctgattctcctctgttggtattctcccagctcatttttatcccactacattagagtcagagtttagttttgagtttctttaaatcactgcattcgatttgatatactgtacaagccagactttatttttcttatctgaaactggcatattttcagagcaatgctcaacagtaacaaataggtaaagctggttctaaaatgacacatattagacacttgcagatattttcatgtgtcccctgctttgttcttcctggattcaagtgtgcctgtgagaccactctaaacaagtgatgccgctttgcttctagcagaagccccattgaacctgcctaaatgaatgttgaattccacagcggcttgtgcctagaaaagacaacttaaagtggtgacatttgcactgaattttgttcttcactggcttatgtatattcacttacattttagctttgttaaatggaatactggcattttaattagtatgctgaatagagtttgccttaccctagttgccccgaaatagggaatttttacttccttttcaatataatgtttccagtcatacttgctaaatttgcaaccacatttgtgtcatatcagtgcttgattctaatttaaataggtccatggaatttcatatctggttcagatactgaaagatatacgtctggtttatatttcctgctgcttgttcttcaggaaactagccagggactgttaaaaaaaaaatacatatgctatacctgttcacttgggaaataagacagtttttacagtaactctttggggaatgctttggaataaatgctgaagtctccaaacattggaaactgtggagcatttgattgttaacaaggagccaataagctgcgctctaaattttacttgtgaaaggatactgtaaagtgtgtgacagtcctgctcttacaacttgagatgaccttacaacaaagtcattcactttctaacaaagaccattggcattcatttggcagcccaagactcttcagattatttgtcagaatgatttatttgtagttcctgaagatttgggttggttgatctttttcttggggaatgctcctctctgaaaaaccttggcatgggccgatgcagggatagtgaattctttccccaccctcttcactttctgttccactgctcagggttttcccctggagtgcctgctctcctgctctgtttctcttcttcccctgtctgtaagcatcttttggctccatctgaagacgtcaagtttcaactccagaaggaatttgttcttttctgtcttccttatcagggactgttgaagaacagtcttctgttttacatacagtgcttcctaatattgatggacaggaagtaatatgtactgcttttggggcttactgtttcaaattccaaactttaagaaaaaaatgaagatagaactctatatctgaaatgaagcccgagtctggaggtgcaaattatggttagaagaaatgcatttgcacccctgcccccattcactcctgatggccccctgggtcctctccattttctgcccatcattctttcatctgtctgattttgtggttacttcactggttttctcttcctaatctgcttcatactccgttcacactccccatggaaacacatatgcacattgtagagctgtttcctgatgcagtgtttaatttctctggtacaggatggtctaaagataggcttctgtgccaggcatcactgtccttctggtaataagtgcctaacagtacttataaaggggacatttaaaaagtggcagagaatttattgctcagcgtgcctcaaggaacatataaattagcacaaactgtgggtatctagtctgtaagttgtgctgataatgtgaaagaatccataatagacatttgggagggtccagcttttttctgatcttgctgctcgattgtaccgtaacctcctgggtcttatttatctttgtgtcatctcctaatagccttgttagcctactctgagcaatgtactccttgagcatctactaaaagcagagcacaaaaatgtgaatactcacttcttctaattctgtaacaggcggtggccctagaatgttcctccttgaaggtagcccaaattatggagaatttgatgagtttttggtgaaagtttaaatttgtgggtgttattctcaaaacacaggtgagttggaaagctcgtcctctgcagtcctacagagatacagcaaggatatacccagttggtcaagtggtaagagtcaagtgacccctcccctctcctgctgctattttatcctgcttttgccgtttggtggtggtggtagatagaaataattctaatttaattgatttattagtgctactgttttagtctattgatagcaaatgatgatttttttaaatcaactagttgtgtgggagcctaagctgtagaaagttaactatatgcatacccagaaatattcttatgcaatttgaattgatacataatcgttgtacatatttatggggcatgtgatattttggtacatgcatgcaatgtgtaaggatcaaatcagggcaattaggatatccatcacctcaaacatttatcatttccttgtggcgggaatatttcaacttccagctattttggaatgtacaataaatgtttttaactatagtcaccttactgtgctgtcaaacattagaaccaattccttctatctaactgtgtttgtacctattaacctctcatcatctttctcccctacaacttcccagcctctggtaaccatcattccactctatctccatgagatctacttatttatttatttatttatttatttatttatttataagctccaacataggaatgagaacatacaatatttgtctttatgtgcctggcttatttcacttcctgtaatgacctacatttccatccatgttgctgaaaatgacaggattttattcttttttatggctgaatcgtattccatagtatatatataccacattttcattatccattcatctattgatggaaagttaggttgattccgtatttggctcttgtgaataatgctgcagtaaacatcggggtgcaggtattcctttgatacactgatctccttttctgtggatagatacccagtagtgggattgctagaaattttgccagtgggctgaatagtcaaatacagcagagcttgtcatggtttatttattaattagtgcagcacaaaacacttttttgtttaaatcttggaaattaaacatttttccaaactgtatttttcaccacagtaagtagaatacactgccaataaattcatgtttcttggaagattaggctctttctcttgctctacgggaacattgttaacattaaaaattactggaaatattataggtttaacaaatactataggtattttccaatgtagtttttgctgactacttatatagaacttgatttatttgaattacctaatttctcatattgagctgcctgaaaggaatgtctatcatgaacagaaatgtcattgcagataacccacagtggtcaatattgcagaggcatatggaccactctgggttatctatcttattaagcaaacctcacaagaaaacttaataactatgtagatacctctgtaactaattagaaaacattttattttctcttttgctgttgctgattttcccattttgaagtacactgcttttatgtagaattaaatggatgaatggtaaagatgaactgacctacctcatgagttagtctcttgtcactgaaagtattcaaggacaggatggggacatcataaggacatcaccttctagggatgttgtaaggggagaatggacttgctaatgaatgaatgcactgacaactcagtttctttctagtcctgatattctgtgatggctgaaaataaaatattagaataagtatgtgttttaacaagacacattttaattttatacatgaaatatgtgttagtatagtctttttgtgtgggatgaattactgggaccatttatagtactcattttataaatatgagtcaaatgttgagataatttctgatattacattaatccataaattgaggtatgcagtgtggatttaatgtctggtgaatacatatatataaccgtaattaccataaaggtgatcaaattttacacaaggacatctatatttagattttccaattacctagaagtcatcctagaaatcctatagccttatactttgctcttctcatttgcacctaagatatgctgacttcatggttacctttcacatgtctgctctatcttatcacatggatttcaaacacctcgtattcagggtaggtgtcgtacatctctcttagtggcaccagaccctaacatagcgtgttacccagaggaggcatgttctaaatgtttgtcgatgaagggaatgatacacatttcttgtgagtgtgagagagcttcagtgtcaatcagcctatcagatgatagaatatggaataactggttaatgttggaacccatgaagagctttggttactgaacgtaccagagaaacattttaacaggctcacacttagactttacattctgggccccagggaatgaggatagggaacctcccatcaaaggacagtgacactttatttttcttccttgccagtaaaaatgtgtttgcccacaggggacacagcataactccagttctgccactgcctgttaaaaacatatggcccattgcttggcatgcagttcttactgtagacagagcacaggcctgggaggacagagagctggatgggaaacccagctctgctattacatcctgtctgtctgagcaagctgctaacatctcagggcttcagttcctcagatttaagaagtgggggttgaactactcttgtttaattcatattttctcatttgccccttagagctaagagtctagggaataaaagaatgagtgatatagatgtgatgcaattctttctcttcctcctcctccaaatcttcctctttgacttcccctctttttctcctcctcttaatttatttaatgtttactgtgtgccaagtactatgctaggattatgttcaagactgcttattaaatgcaactgttagaaaatagatgctccctgtctcatttaagagtgcaagttgctgaaagccagaagtgtgggggatttctcagttacagtctcccggggtgccatggggctgagagctggtagaaggctgggatcctaggcagctcagcatctgctgccctctttctgaagcagtgaagccagaggtattgtgtgtaacctgagactacattttgcgtaagatttctgtgggtaatattgtggtagcagcaggaatggtgtgcaaggtaaaacaaacatttaaccatagtcactaaaggttagattttccctttattaaataatttgtaattaggaggcttatgtttctaaaatcaagtaaaggaacattagagcaaatgctagtacttactattcttatcttaccttcctgattccatctattaattcataggctatgtggtaactggattccttcttgttattctgacatttttagagtttgcaggattctaccatcaaatgttgaataatttccatgaggaatagcaaggttgtagaattattcccagcccccagtagagccattgactgccatgagctgtatccaaaagccctgtccttcagcagtgtgatgtggtctgtcctgtgtcatcttcctggggggccatgaaagaagcagcaggactctgatataccgaaagcttttggctaataaaagaaagtttcatatctgaattactccttcctgggacattattattattattattattattattaaagagatggcccaagcaggtctcaaactcctggcctcaagtgatcctcccacctcggcctcccagagtattgggattatagatgtgagccactgcacccagccatggatttgcattttaataagaccaaattatcccaagtgctcttgggaaatatttatagtaaaataatgaaataaaaaataaaagataagcagtgatgatgacagcccaactcaaaagagtttcaaaattctcaatgtctatatggtagaaaaatggaggctctagagacaaaatggctcagtttgcacttttggttctgacatttaccgtttaacttctctaagatttttttctgtgcatttgtcttaaacagtatctacctattgagaaaattaaataagctaatgcctataaaattcctgacactgtgcttggcatataatagactcagtaaatataaatttctttgcagcaaatagtgtgttaattgcatagccgcagtaagaagtcagcttgagcttgggcaacatggcaaaaattaactgggtgtgataatgtgtacctgtagtcccaactactcgggaggctgaagtgccatgattgcaccactgtactccagcctgggtgacaaagtgaggccttgtctcaaaaaaaaaaaaaaaaaaaaaagtcagcttggcagaactatgcttttatttctaccttatgcagtagagataaaaaggcacttggaatgtcagaccttgaatttttgagtagacttgcagcattgatctgcacagcctaatttcctatggggaatggggaactctttcccccacttcttggggtcttgtccatcatgaggccttacttcctgccccaggagagacatgtggtcctagcaaagtcaaccatgatcttccttgagatttgatagagagcctgtcttccttttgggttgtgagcagaaaggctgtcatcctaagatcacagtacttggtactgtagagcaagtaccatcaggaagagtcgttctgagaatggagccagcacagaggaaagtaagcctagggaaggagagagtcctgatgagtgtctgagcctctgagttcagccatgcccaagaccttctgcactacatgaagcagtaaatcctcccttttttctttgtttacacttgcttgatttaggggacactcagtgtgtatataagtagaaataaaaccatagttatgccaagctgacttctaaggtgactgtggttacacaattaatacactttttttgttgcagggaaattatattttctgagtttattagatgccatgtcccagtgtgtattccgaaacaaatattaccaaacctagtgaagaagtgagagttctctgacttactattcatgttccattttagttgcaatgaaatgtagccttaagtcagagctgctgttaaggaatagcaggttcacttcaattaatgttgttgagcccatgattcagaaaactctgagccaggtgttctgaaaggtatgatgatgagtaacacatgcttcctactaatggattctttctttaaaaagttacatggccttgtaaaaagaaatctgtgagacctcaaagtttattatgccttgaacgtaaaaagccaagataaaggatattgattgatgctttcagtctaacaagcaaagccatgcctcttacatgcccagggagttccatagctaagtcactgagagtgagttaattactacccaaattggaaattaccttaagcttctatcccaggcaggatttacaacttgacatgaacaaacagttcctacagcaaacatcttagcaaataaaatcttctgtgactaacattcataatgtgagttacaagttaacagaccttgaaactattaaaataaatctttcagttgcatggtaaagttctttgcccttagcaaatagtcatagacaaaagcggaactgtatgatgaaaatataaagaataagtatagctttaacttaaattatatggtaactagaacataaatgttgttaattttattaaaggttaaatcagagatatttgaggcttataattttctgcacttatttatatactttcccccaaaacttatgaatttagtcaagaacattaataaacctattatgtatctatgtagtgccagggagaaagtgatatacaaacaagatgcttggtgtggattgacagaggatctcatattcccaagggagtcagagctcacctagttacctagtttgtagtgctgatgggagagggaagaaggaatcaggtggaaagggtgattcactctaaacgacctggctcagagcccctccccggcttctctcctgacttcgaggtcagatagtagttgttggcatttgccatgtgaattacatcaggcttcagtttgatgtctcatatctgactgtttaagcaaaaatataattcacactttctaagcattttaaatgttcagctaaagttagctgtgaaatgcagccttttcaggatttgattgatagctgataaactggcaagcagatgacttgttaatctcagactttctatctagggctattgtagtcagactttgtttagagtactggccagctggagtgtgacctgagggaggccaggatggtgacgagcctggaaaccacatcacaagaggaaagctgaaggactcaggcagcttagctgggaggagagaaggtagaagaattagtggtcttagaacatttagagggctctttaatgtggaagcaaaagaagagttgttttgtatggctctaggggaacagaattaggacagtgagtgttagtttaacacattttcttttggtggtcttagaagccagtggtaaagatacattaaacccagtagtattctaattatgtttgcagtaaatcttgttttaaacaatgaaaatactgaaatgggatcataaaatagagaagttctcatagtcaaattttgtattagtaattcataataaattgcctgagagaagattttttaaggcagaattttcaaactattttaagtcaccgaacaatttaaatggaagagcaaaatttttttaaattttattttaagttctgggatacctgtgcagagtgtgcaggtttgttaggtaaatgtgtgccatggtggtttgctccacccatcaacccatcacccaggtattaagccttgcatgcattagctatttatccggatactctcttgcccctcatccacccaacaggccccagtgtgtgctgttcccctccctgtgtacatgtgctctcattgttcagcccctacttgtaagtgagaacatgtggtgtttgttttttttttctgttcctgtgttagtttgctgaggatagtggcttccatatccatccatgtccctgcaaaggacatgatcttgttcctttttaaggctgcatagtattccatggtgtatatgtaccacattttctttatctagtctatcattgatgggcatttgggttgattccatgtctttgctattgtgaatagtgctgcaataaacatacgtgtgcgtgtatctttataatagaatgatttatatttttttgggcatatacccagtaatgggattgctgggtcaaatggtatttctggttctgggtctttgaggaatctccacactgtcttccacagtggttgaactaatttacattcccaccaacagtgtaaaagtgttcctgtttctccagcctcgccagcatctgttatttcttgacattttaataatcgccattctaactggtattagatggtatcttattgtggttttgatttgcgtttctctaatgatcagtgatgctgagctgtttttcatatatttgttggctgcacagatgtcttcttttgagaagtgtctgttcatgtcttttgcccactttttaatggggtggtttgtttttttcttgtaaatttgtttaagttctttgtagattctggatattagcccttggtcagatggatagattgcaaaatttcctcccattctttaggttgtctgttcactatgataatagtttcttttgctgtgcagaagctttttagtttaattagattccacttgttaatttttgcttagaacaccaaaattttcatgaaaaaatgtctacctttttattttccttaatttatagtcactattaaatgaatattttaatggcccggcacagtggctcatgactgtaatcccagcactttgggaggccgaggtgggtggatcacctgaggttgggagtttgagaccagcctgaccaacatggagaaaccccttctctactaaaaatacaaagttagctgggcgtagtggcacatgcctgtaatcgcagctactcagcaggctgaggcaggagaatcgcttgaacccaggaggtggaggttgcagtgagctgagattgcaccattgcgcaacaagagcgaatgcagcctgggcaacaagagcaaaactctgtctccaaaaaaaaaaaaaaaagaatattttaaattaatggctttaagaccaacaaatatgctttaagatagaagtataacatacaagtttgggctcaaatacattgttgtaacacttacataccacataaaataccaattattgaactaatggtaacagctggcagttggtaccaatgaatcctagagataataaactaaggtgtaatgtctattgtattattgtctttataaataaaatttttatgaaactattttgtccacatttaggtttaaattaattttctctaaaattagtttggtaaatttaacataaaaattcattgagatgctattatatacccagtactgtacttaacctactgaacctccaatgtaaaatcagatttacagattttacagagcctaaaaatatgtagtaaaactgttaaatttgaatattgaaagacataaattgttttatggagaatcaagttcatgaaatacgcatttttttctaaaaaacttcaagctcatagctgttcctttgtaccctttgcctctgtcgttcatgtcttagtccgctgtaaataaaacattgtgggggggaaatgaagaagtagtttgtatcatttagaatctaaccaagaaaatagaaactacaccagttgctttaacagagagaatttaacgtagggaattagttaagtaagttttggaggaataaagggtggaaaggcaatactgagggaaaagatagtaacttttaggctgggttacttgtgggaaggacccccacatagccgagactcagacctttgaggagaggttactgtctccaaggaggtgtcccagtaacacagaatagggaccgtcaaagctgggcttctggcttttgaggaggggacattggccaactttgctattgtctctaagggaatgcagtgaggctgataccaggagggaaaagatgaaaactagagccatctgctattggaaccagttgttggggcaacactgatgagagtaatgaacaaatagcaaagggcaagatcctgttccctttgcgcagctgtccagtttctctctgcctccccctcttggcagaacttttagcagatccagcgggcaaaggagaaataagtgagttgagtcccagctctgttatcataaacctgagtaaggaagggtgggcttggagctgaggggcagtggtttaataactggcacatcgttgttggctacacattttggcaatatcttttttccccattgttccaaggtgagcattttgtttatgccaatgttcttatttcttttgggacaaaaaacaataaccgtattttaaaatgatgtatttttcacaataaaattccataattttttacaaagtatgcaaagatatgaccacttcaaaagaaataatttttaaaaaaatatatatatattgcaataattcaagttagttgttaataagacgtttccaaggaaaactctcacctagatcaattcaacaaacttaaaaagaacaaatcatttgaaaactaatctttcaatagttttgaacattctttaaaaataatttcttctaagtttgttaaccacgtgttctgcaatgttatagtatttttatattttgctaagccaattctctcaatccatattaatgatatccactgtcaatctatgatatagggagatagcaaattagattggagttaaacctgcagccaggtagagattagcatttgagaataataagctgtgttctcacggcttcaggtttaaaggggaccaaaggctcagacgtcagggggccaaagcagtggctagaatgttctgaagtctgaggaattcttagaaggatctgggaactagtcagcagaaacagaaaagggcagtagagccaaggcagtgagaggatagatgcccggaagtggcatacatcaaggcaaatctgttctagtttttattagaagggaaaatgtaatggctcacctatgcaaacaacatgaaaggggtagagatcagccttgagaccaacttacagacaccacctctccatctcttctttcagcttctgttctcagcctcttaggttcccttgctggtagggctctggcttccagaagcttctgtgtcgtcactctctctggcttcactcagtgatggggatatgacttccagcatttctggagaacacccttactgcttgacattcaaggagaatgagtttccctctcctcattcccatatatgaaatttgaggaaaggtacaggttgtaaactacaatgtgtatgcaacctgtgaggcagtatacacattgaagacattgtaatttgtgtgttatggtgtaaagtgcctttctatacaaacgaaagcagcatgttgtgaaaatttcccagaagatggaaatgaagtgtcttaaggaagggtcacttcttaaaagatccatgcagagcatcatatggacctgtggtagctctggatcaacagccctactggagccagagagaatgtgagaggagcagttaccaaggggacaggtgcagtggatacttttataagagaagggtgaagggtaggtgaggaagggatttggggcagaccattgtaaagtggatgtggcctagagccctggagtggggcggcaatggagtagccactctgatcctaagctactgtggtgtgtgctttgggctcttggcaatgagaaccacaatgcatctcctttcactctgaattttgggaagctcagaactcaaaacttggctatggggatttgcacctccataatctgtttttccccccattctttacttgctattataatttatgtttcctttgggtcctgatttttactgagagtgtatcttttgctctattttttatgccattaattatatccagtcttttggggatttaaccaaaaaggaatgactggatggaaagcagccctgtgactgaaagtatgtgttgattgtacaaggaaggtgagagcaaagctgaaactgtggatgattgcgacgtttaccacatgtgcttaacatgtgttctcaggtagatagtacttggaaagttgcatataaactgaacttgattcagtttggtgcatctagaaacctaaaactgtatgtatcacactatttctgctgtggtctgtttatgtctgctggaagccttttgcaagcataactaggagtagctcttctctttacctatcatggaatatcacttagtagcaaaagaatgtaaatgttagctatatagaacagtgcataaaattattgtttacagttatttcaacactgtttcaagaaatatattgtataaagtgagtaggtttcccatattatgtttgcttacagaagtgtttatcaggaagatcataaataaatagccttgtaaccttctaacttgaaagagggtcacagtgtctctttcatttaaatcaaatggtgataatagtagctatgttaggccatttttgtgttgccatcaaggaatacctgagactgggtaatttataaagaaaagaggtttcattggctcacagttctgcacgctgaacaggaagcacggtgctagcatctgcttctggtgagggcctcaggaagcttgtactcatggcagaaggtgaagtgggagcaggcacatcacatggcaagagcaggagcaagagagggactggtgagaagtgccacattcttaaacaaccagatctcacatgaacttagggtgagaactcactcattatcatgaggacagcaccaggccatttatgagagatctgccccatgatccaaatacctcccaccaggccccaccttcaacactggggattatattccaatatgagattttgaggggacaaacatctaaaccatattaatagctcattttattgattgctatactataggccaatcatgatgctaagtgctttgtattattttctttcttttttttgagacagagtcttgctctgttgcccaggatggggtgcagtggtgcaatttcggctcactttaacctctgcctcccgggttcaagcgattctcatgcctcagcctccccagtaactgggattacaggcatgtgccaccacacccagataatttttgtatttttagtagagatggggtttcgccatgttggccagcctgatctcaagctcctgacctcaagtgatccgcccgcctcagctccccaaagttctgggattgcaggcagctttatatgattttcttacttaattttgacagcagccctgtggtgtagaactactgttttccctggctcacagataaagtgggccatagaggggctgagcaactttcacagggatactgaggagggagttggggagctaggattccagcccaggtaatcctgaccctgtaactcaagagaaagcaatataaatagtttctggttagcagtctcattttagaacaaaaaaaaattacagaagctatcatagaaatacagttccatttgtcagatgtggaacagcattatggtataatggcaaaagtgtgatgttttggagccacataggtctacatttcactttgtcagtttttagttttgtagacttcggcaagtctcatggcttctctgactcttgtttgtaaaggagtgataatagaaagctttttgacttcaatgtgtggggggaaaacccaggcacataatagatgcgtactatgacgtctgtttgttattactaaaaggatccataaatataattgtcacaactaagtaaagaaataatacgtgttggaaaatacaagtgtgcagagtttgggggcttaatgagcaggacactagatcttggaagcagctggtggtgaaagaacacagcccctcacctccagagatcccgggaggagaccctcagcagcctcagtggggccaactctggcttactcttcaggaaggaacagtaggacattgtagaggacaagactgggattgtctctgacctcctccttctaatcatcgcctcggttccctgctttccacacagaaattaatcttgcctttagggtggcctgtgggggaagcccagcatgctagtgactgttcttagtccatcctagtacacatgcacttgttccccacagagaactgaaattcctttgcctgggagcagttcgtgcacatgtgaagatcaagagcttgagaagcaaatgtcaactgatgggtcaaattaatttatatttacatgtcatcagtgtactattactcaacaagtttaaatgctagttccatttcctacagtaagaatttacattttcaaagaaccttaataaacagtatacatcaccaaagagaactttaaaacaatttagtttttgtctgaatactttttggagcctcttgtaaattgataattgtaggccactgagaagagaaatatcctaaattactttcttcagtcattcttcatgaagctaaagcaataaatttatgagatcaccaagctgcaggggtttttgttgttgttgttgttgttgttgttttttaacggtgtgctctgtctctctgttcatttttatgatatttctagaaaagttggccaaagatgaccctttctcttgattttgttgtaatgattaatcaacttatcttcaagttctctttagcatcacactctatttgacccattattattacttttataattctcgataaacttggttgacagattgattagtattcacaagcaagatgtactgaccaaatatttctgtgtacctggagtttcatgttcagacttcaaagaaaaacagtggcagttaaacctattttatgtgtttgctagctgaataattagaaaaattcacagggtaaaccatattctactcactcatccaaaaagcatttggtttaggattagtcagctgagttaaagattgcagagctaattttgaataattttaaaaaatattatgaaaaaatattttaatataatgttttcaccctgtgatgtttaaagtatttgtgatgctcttggtcactttgtagttttgcttacattttaggccctctcactaagcataatgactggatattggcatcaaagataaaatgaagcagcatcactagtcagtgacatatcttatgttttcccataaaataataggaatgttctgagaccgaagcttacatttcataacatgagcagttttctgaaagtcgaattttctttagcgttatacttcacaggttgaaataagcaaccttgaagacgagccttaataatttgtgtatgtcttagaatctggaagtgcaatttgatcatagtaggtgcttgagaaatagttgatatgcagactcttcagtgtgtccccctggagccttcagggtctctcccttgcataagtttccaggctcatcattctcctcccgcccacctcatcagttacttaaccagagcaagttttgctgctataaaacaagccaagctggtcttaactctctctcttgtggcatttcttccctggcccacttgagaaatacttattcattctgtctgatccagctcaaacatcacctcctgcaattcactttttgaaatattttcccctagacggaattcactgctgtctactttgtgtacccttgtatatcgtacatctttccttgagagcgttcatgatctcttatttatttaatgtgtttctacctgtactgaattgcaggtttcctaaggcagggcccatgtcagattcatttctgtatttatagcacaatgcttatcacaaaagaggatgctcaatgaatacttggggaaagatgaaagcatgggaaggaaggaagggaagaagggagaaagggagggaggacttgtattgcattagaaggaagggagggatggaggaagtaattgtattgcattaatcaggaccattatttagtattggacatttcaagctgagaattttctgttttctaattaaccaatcattaattatgtgctatttctcacataatatttctctctcgtataccttcactttcccaggatgagagcactgtgaagtatatctgcctgggggtgggtgtcttggatgaactaagcttcctaattcgtagtgagggaattatcagtttccatcactactgctatgtgatcataggcaatttatacaagtctcattgttctacctgtaagtgggaagaatgacacttaatttacctcttaaggtttctgtgataaccaaatgcaataatgtttccgaaaacactttggaaagtatgaagtgttacctgaacaagtggaaaaaagtgttcctgtgactgctgttagtgagctggcatcatgggaattttctcagcctgcgaagccctctgagtttggtgtgtccttactgcttataaaaggagtgaagtgtatttgcaacttatggtttattttactagattacattaatggcaacatttattctgccgacgtacatcggtgaacattgccttcagaacaggaaagtgaccttatttctgctcatatcaattcctagcctaggataatcagcctataaagaaaagtctgtattctcatgagcaggtgtgttggccaaatatgtaaaaattaattccagtttcatgcttttaagttttaggtaatgctctcttaaaatacatgataagaaattacatgaatgtaataatatttagattctaaggagtccttcattttctgatttctttgtttttctaccagacaaaagcatgattatttgaaaatttatgcttgtgacatgtttgaaactatatttatttcttctttgtcataaaaataatttttcaatgatagacatacttctgttgacactcctgtggaccaggaattgtgtttggaatacatactactttttttttggaaacagagtctcactcactttctttcgcccaggctggagtatcgtggcctgatctcggctcattgcaaccttcgcctcctgggttcaagtgattctcctgcttcagcctccctagtagctgggattacagacatgagccaccacgcctggctaatttttgtatttttagtggagacaaggttgcaccatgttggccaggctgctctcgaactcctgacttcaggtgatccgccaagtgctgggattacaggcgtgagcccctgtgcccagtctagaatgcatactacttttaacactactcagaattgcacctctcaatcagttctgcacaaaatgacttggagtggtcttgagcaagcagtcagggatcttgaggcatccccacattccaacctgaacaaatacaggaaccaaaattcagggaggaaaccaccgtggttaccatatagtagagaacatatgatatggaatagcaaatgggaaccaacaaacaagacaaggcaaaaccagtcagcaaaacaaactgccatgagcacagtgcccctctgaaggagatttaaacaacagagtgagggtgatcacatgtcaatcagaatattggctaccaacttagtttgtactctctgagcagattggggcagatgatacctgtctgatacactgaaggggagaattaaaacaatttatttgagtcatatttatgctcagaaaccaccccagtctatttcagtggaaattattattcctattttggtatgaagcacacagaaaaatatgattcagaaggaaagcaactgagaatctgaggcctgcagctgtgagagattacagatattacagttgagatgtgtctaaaacagaggggctgagaaagccatcatcattaccagccacatgctaattgcggagtgacagggcactagtccattcatcaggttcacaggttgaccccaatagaggctgaacttgtccctcatcatggggaagaaattgttcccaatatggtttgtttttcattgaggtataatttacatacagtaatattcactgtatataagtctgtcagttgtaatcagcacagagtcatagcaccacaatcaagattgtgaacagttccatcactctccaaaattctctcatgcccttttatagtcaacccttcctgttacagctacacctggaaaccgctggtttgtttgcagtctagttttgccttttccagaatgtcatataaatgaaatcatacagtatgtaaccctttgaatctagtttatttcacacaacgtattttagtttcatctgtattgttgcctgtatcagtatttcattactttgtactgagtactaatccattgcatggatttaccatagcttattgattgattccccagttgaagagtatttgagttgtttctagtctgggataattatgaataaagctactacaaacattcatgtataggtgtttatgtgagtatatgctttcattttatttgatttcaagtctagctagaagtagattaatgggttgcgttgtaagaatatggtcaactttttataagaaatttctaaactgtttttaccaagtggctattaccatttttgcattcccaccagcaataggagttccagttgcttcacatcctcaccaacacttagtattgtctatctttttaattgacagtcattctgttgggtgagtagtagtatctcattgtgactttaatttgtatttccctgataactaaaaatgttgaatgtctttttacatgtttatcgaccatctgtatatcttattttgtgaaaaaaacttttcagttattttggccgtttttgtatttggttgcttttcttactgttaagtagtaagagttctttttgttttctcgctacaagttctttaatagataaattttgcaaatatgttctcccagtctgtggattgccttttgttttctaacagggtcctgaaaagagcaaatgttttacattttgatgaagttcaatttacctcttttttttaaagtttgtgcttttgttgtcctatttaataaatctttcccaaatctaaggtcactaagaagttcttctgtgttttcttctagacagtttatacttacaaagctctcgtattaggtctgtgattcattttaatttttatattggtgtaagagttgaggttctttattttgcatatggatatataattattctagtaccattccttgcaaagattattcttttttaattgccttagctcctttgttgaaaattaattggccatacgtgtgtgagtctagttgcggattttttttgttttgttttattatctatatgtctatacttatgccaataccacactgtctctctttctgtagcttcaaagtaagtcttgaaatcaggaagtataagtcttctaatcatgttcttcttgttaaaaactgttttggcttttcaagttcctttacattttcataaaattttatttttttaaagagatggagtcttgtgttgcccaggctggagtgcagtagtgccgtcatagttcactgcagccttgattttttttttaacaaatactattcattatttacaaaatacatggtgatcataagagagcactttacaaattacaaatgggaaaagtacagggaaaagtagagacacatgagtcaaatgacagggtaaccattcgtagggagtctgtttagaataaaaaagttctcttttaaagtcagacaaggccacgaataggtacattgcggtttaaaaaatggcagttactttgaaatatacctctaccaaaaagtagaaaagcattggtagtgtgtctaatgtgtcctaaattaaattacatatagttccagtgttccacagtgcaaccattgcttttaggcagggatctgtgagagacttgattcttgtcactgaaagagcaaagccccgggactggtgaacttccctgccttccataaggctttgttcagtgactctggaatgtggtatcaaaaaatcccattcatttctgtgtcttttaaggaatttgcccatttcgtctagtttgttgcatctcttcacataaaattgtttatatttcctgattatcctcttaatgtttgtataatcgatagtgatgtttccaccccccactcctgatattggcaatatacatcttgtattttttgtttctgatcagtctggatacagttttatcaattttatagattttttttcaagggattagcctttggtttcgctgatgttctctactgtttatctgttttctatttcattctcctactatttttattgtttccttctttctgcttaatttggggttaattggatcctctcttcctatgttcttaatgtggtagctttgataactgacttgagaccttttcttactttctaatataagcacttagtgtataaagtacagctttagctgcattccacaaatttgatatgttttgttttaatttacgttcagttaaaggtattttctaattcctcttgatttcatctttgattcatggattatttagaaacattgtttaaatataaataactaaaggattctcagggtatctttctgttactgatttcttatttgaatccattgtggaacaaaaacatgcattggatgagttcagtatttttaactattgagacttgttttatggctcagaatgtggtctctcttggcaaaggttttctatacactaaaacaaaagtgtattctgttgttggctggagggttctgtaattttcagttaggtggatttggttagtactgtagtttatgtcttctgtattttcacagaatttctattttatcagctcttgagaatggtcttgaaatctcaaactgtaattgtgtatcatctattaaccttttagttctatcagtttttgcttcaggtgctttgatgctcttgttaagaggcatatatgcatttaggatttttacgccctcttgaagaattgattccctcattattatataatatctcttccgggtaatactttttccgaagtctgctttgcctgatattgattctttagctttctttccattgcattagtgtggcatacctttttccgtattattacctttaaccttcctgtctcttcatatttgaagtggattttttttggtacacatcatagttgattctgattttttaatccaaatcaacatctctgactgttcattggagtgtctaggccatcttatgttttatacaattatcaatatgggtgagtttaaatctcccaccttgctagttgttttctacttgtctcatctgttctttgcttctttttctcctcttctactgccttattttgtattaaggagttttattatttcattttatctccattattggcttatttgctgtgcctctttttgtttttacgttagtggttactgtagggttttaaagtatacatctgccttcaaataatattatgccacttcacgtttaacagaagaaccttacagttatttgcattttccccctcccaatctttgtgtgctattgttgccataacttttatttctacatattttataatacccacttaaagcagttctcttttaaagaaattaagaatgagaaaagtcttatttttacttacgtatgtacagtttttggttctctttttgtttctgagtagatctaaatttctctgtagtatcattttccttctgcctcaggttttttctttgacatttcttctagtgctggtcagctgacgatgaattcatttagcatttgtatgtctgaaaaagtcatccttcaccttcatttttgaaagataatatttttgagtaaagaattctgtgttgccttttctttttttttttttttttgagatggagtctcgcactgtcgcccaggctggtgtgcagtggcgcaatctcagctcaccttttctttttcttttagtactttaaaatgttgcactgttgtcttttcttctgcattgtttctgatgagtaagtctgctgtcattcttgtctgtgtttctctgtatataatgcgtcttttttctttggctgttttaagattttcttttaatactggttttcagaaatttgatcatgatattccttggtgtgattttcttcacatttcttgtacttcacatttcttctcaagaatcacatttcttgggattctttgagtttctcgatttgaggatatgtagtttttgtggaatttcaaacacttttggccattatttctgcattcgttttctgcactctccctgtctttccttatcttccttccctaattaaattggtgccatggtttagtattcctattcaactcttgttgtaatatgcacctcactttcctactgcatctaccatggttcatatcctcattgtttctctttttatctgttgtaaaacctccctctattgtttttagagatgtggtctcactatgttgctcagactggacttgaactcatgggctcaagcaatcctcctgcctcagcctcatgagcagctgggactacaggtgcatgccactgcacccagctctctgcctctatatttgtccctcttcagtccacagcatggtacataggtccctttatccccacctgttttctagctttctttccccctaagccatcctcacctcacccatgactctctgaactctttatcctgacaatatggaatacttccagtactccaatgcatcgtgctttctcatgctcctgtgcacatgcatatgcctttcttatgtctggaaacctccctgcctctccatcatccctgtcgccatgcctggaaactcttattcattgagctgaaatacctctcctttaaaacttacctttttatcccatcccaactccactagaccttgagtgtattctgttacagcacttaatctattgttttgcaatcatcattgcaattaactaggtcatcctcctagactgacttgtgtgtggtcagagactgtatcttattcatttttacatacttagtagtggtacgtaataggtgcttactaaagtgttgattaaataaacaaataattggcatttagcaggtattgggcatattatttttaaaataagttgaactcagatttaatcataacctacattttagcatgcgatgtttcaggcaccattttaggcacttctcatacattatctttaatccttataacatcaatgcaatgtatatattgtcatccccatgataccccaactttggtttagagaggtcacggacaaggttgtgcagatagaaaatgccaaaatttggtttcaaacctgaatgtatgttttgcttttctctccttgcacacacattaggagttctgtcatatcaccatcagtattttctaagatttccagtaagaaatgacagctatctgcagaaattgtataggcagcaatgagaatcataatatagagtcagagaactgatgtcacagactgacagagaaaagtctctaaggggctgtgctgggatatcaggaaaggggaagcaggagggttcttaggtgggctgcgtggcctacaaacatccatcgcatgtctgccgccatctttgatgtgaccatatgaggagccatgtggagggcacaagtcacagggctcatcctgaaccatgtggtttggggattcctacaaggatgtgcggatcggggggctggcttcagacagcatcttggggaacggcggaaagaaatgaagattccaaatgcgccagcacttgctgtgtttacaaaaggcctgaagggttcataatgctttgtcattatgacactttagctgaggctggaatcaccacccctgcccactcagactgtaggccaaatgcctgttgagactctgtctcccctttgtttcttctctcaaggctactcttgattttcagtttagctgcattccacccctaccatccccagtgtaaaaatgatgagggtggagttgggtggagggacatacagtgtagcagtctccaaaacccctgtggggatgtccttttgtacatacagcaacatcattttcctatttattctgtgctactgaatctagaataaaccttacaaaggcatggttccttcccttttgaaatttacattatagaaaatgttttaaaatatggttttggtgttttaattataaaattttctggtgtgtatgtgttgggggtgagttttggtttttggcaagaggaggggagctgtatttgcaggaactctgtttcctggggtactgcagctaatacttttggcagataagggtcccgggaccgtgtcagtttaaatgtgcacttgaggatgattcctgacctgtccttcctcacagatcagttgcaggtagtgtgcaaggcagccgagtatgccatcctaactttgtgaatagcctacagatctatatttagtgcttctttttagttagatggacaaaagaaaaggtaagctcagttaaaaaaaaaaaatccacttctgaggaggacacccttatgcatcgggaacaggaagttccagtgaaggggaggatgcttaggaagcttttgttcagataccaaatgaggtttctgatagttagaatgtgagcaagtgagaacttttaatgttttcatgtttagtgtttgaatgtgattattttaacatggttgcactccatcttaaactgtattgtaatgaagatttttctttgttcccttttccaaaaaattagcctgatttgttcttttcaggacaaataggcacctagatactggcaatgggcagggtgtgtgatggtttctggagcccttcatgtgacatcagttaagctgttgttgggtcaactcacacttaagaccagctgaagcacattaatgttgaccttcagttttcgcagtaggtgtaaaatatttttgctaccacaaaggagttatttattttcttttcaataaccacagatataaattttatccctgcaatgatttggtatcagagatcttgggttaatataaacaaaacagaatcataggtacgaaccctggatgaacgatgccacaactcctacagagagtggaattgcttacctgaagttgattgaaaagtttcttaagtctgtatttttagggccagtgctgtgtttgatgtgcttaaaagatttttcatgacttttcttttatatttttactattctcctaagaaattgatcaagaatattctgggggatttctaaaataacaatgtcaaagacaaaggctaatctgtcattttattaggtagaatattaagtaaccctgtagtccaaaaaagaatattcctatcaagaatgtgttgcttacattggcaatactttttatatgtacttctgttggaatatcaaaagatagtttgtgtgtgttgcgccagcatgttgaactgccattattgaaggacctacagttaaaatgagtgtagccatttgtctgagagctcactgagagacagatacttgtcaggtagttggcagaagaaaaatacagcataattctaatcttaagatccctctttttaattaagttgaattaggtctgctaggagtgggaacacaaatgagatctcatagggatgaaaatgtctattttttgaattgctgcattattgcagggctctgtgataagccttcctgtagactcatccctgggctaatggtcatagtctgaggatactttgtggaaatcataaagggaggccagagtccaggacagatctagaagattggcttctaaatttattgttttgattggttggttggttagttagttattataagtagctaatatttgtcccataggtcagatattttgtcttactgaccaggttcatcaagcgaagtggaggtagatttttcacatggatatttaaatgattccagaattctctgctcttgttttaaatttagtattaaatttaaatttctggtcattggtgtgctgtccttataggaagatagaaacatttttaaaatgttgctattggtttcaaggacttcagtcatcaattcacttgactaacaaatatgtattgagctcttattgtgatgaataattggtgtcctatgttagcagagggagagaactgagaagccgaggatataatttctatactcaagactgtctttagcagagcagatactgaatcagtaatgttgaataagtacattaataaataattctcataatttgtaaagaaattaagaaaaaaacccagtgggatgttgctttgctcactgctttgtatccttatagatcctcagtacacaattgttgaatgaatgaccaaatggccatgtactatacatgcagtgagagttattagaatccagtggaggctcatcagttccagctagtatagggtattagtccgttcttgcattgctgtaaagaaatacctgaaactgggtaatttataaagaaaagaggtttagttggctcatggttccacaggctgtacaggaagcatggctggggaagcctcaggaaacttacaatcatggcagaaggtgaaggggaagcaggcatatcttacacggccagagcaggaggaagggagaaaatgggggaggtgctacacattttcaaacaaccagatctcatgagaactcactcactatcatgagaacagcaagtgggaaacacacctccatgatccagttacctcccaccaggtccttcctccagcattggggattacagttccgcaggagatttgggtggggacacaaatccacactacattagctaatcaggaaaggtttcatggagtagatggtattctaattgctgaaagagagggagggtcgtctagaaattgggaatggtgtggaagcctctgaggagatgttggaagctgacagtggaggtgtgcagtggtgggcaggcagccaggaaaggcaaattttggaaagccttggcagacagacgtttctctgtagagtaaatagtgacagagatgtattagaaataataactaaaggttttatacctggcacattgaagacgggagaaatcatgaagcacaattgacaaagcttggtaattaagggggttaatgagggaaaggaaggcatcaaagatggctacaatctcgttttgagcttgactgcctcgaataatagtaacagcataaacaaaaataggacatcagcagggaaaattcactttttttttcttcttttttgagacagtctcactctgtcaccaggccggagtgcagttgcacgatctcggctcactgcaacctctgcctcctgagttcaagtgattctcctgcctcagccccctgagtagctggggctacaggtgcatgccaccacgcccagctaatttttgtatttttagtagagacagagtttcaccatgttggccaggatggtctcgatctcttgacctcgtgatccacctgcctcagcctcccaaagtgttgggattacaggcgtgagccaccgcgcctggccaaaattagctttttgtaggaagattcttgtgtttaagataacagggacacttcactgtggactagtagaaatcacagaagcatggaacattagacccaaaagggatttggaggttgagccattcattggactcaaattcaaccctgtcatcttgctgatgagaaagctgactagattcaggaacagcccccagggtgcaatgtctggccttgatacagagcacaagtaggatggcagatgtagacagtcatttacagtgttttggagggtacttaaaaagtattccttcatttgcagttggatttttcccttttaaatgggaagagtcattatacaaacagttccagttaatgcatttggagatgttgtctgtagagtataaacaccgtgttgtaaggttgagataaaatccctaaatattaggcaatatattcattcattcctactgataaacaaaaagtcttaacttgccacccaacatgacattaccaatgaatttactttcatagtaaatacattaccaatgaatttctttaaccgtattatttagtaagttctatttagttattactgagttgacatttactcaattctaaacatattttgcactgcagatgttctatcttggacatctgatcatgggtctggggtgccatattgcccatatttgaggagaaggcagttgctaagggttcccactattagtgtttctagatgggtcttatcctaccctctcttctgcttagggtgttgctaggaatgatggggatggttataagcacaattagtcttgatgggtgttacatacaagtagggggctctgaagcaaggttgggggccagttctcacccttggcatacctgcttctgttcttcaatccctattacatgtgagtacaggaaacagtgtccatcttccagctcacaccctttgtatctgcctgtctcagacccagagatgcaagtgcaacactcactggctttgccttctagaacccatgggtaatcttgcaaaactgagctgatcttaatgtgcgagcatcctgtgacttctttgcttccaaccttgttctttcctgggtccccagctcgatgggaggagattgagcactgaatggtcactctcttctttgtctcccttaactggggaaggagccccttagttccttttcccagttaaaggagtctgaaagagagtgactgggaaatgtgtagcatgagaatagttgggaaccagctcttttagaataaaatgaaagatggaataattagacctggattatcactcccagggaagtaaaatgaccataaaatatttacatctagtaatttatcatcataatcctaatttttctttaaagaatttcctatttcttaaattgcagtgatagcactgggattaaaaaaaatattagtcttacaagcttactttaaaccaattcctagtggtagtaactgcctttatcttcaaggcagcactgagcatttattaacaaccaacctataggccaagcatttttaaattagtgatcttaagtaatgagatgctagggaaatcttgatgacctgatatttgatattcgagaatgagaagcagacataggcctacttagtgaattcacatgtctgagactccacgtggtggggacatggacgttagtagtagtaattagccttggatgagagaagaacagaaattcacatataaatgggaaacatccggcattggtaggtagagcttgtctagattgggactaatgaactacttttcaatctgaagccttcaggaatagacaggctcctgcttctgcaaataccaaatgaaaagccaacccactgttcttgaatttatagatccaatttacacttgctctttttaaccaatggaactagccggcccctgcatgccaagtttctatggcaatgtgatctcagtgacctctcttctctattgtggaatgtaggtgaaaagaacggaggggagcccgatgacgctgaactagtaaggctcagtaagaggctggtggagaacgcggtgctcaaggctgtccagcagtatctggaggaaacacagaataaaaacaagccgggggaggggagctctgtgaaaaccgaagcagctgatcagaatggcaatgacaatgagaacaacaggaaatgagcccggaacgcaggcccccatgtctctgtgcaaagcctccctgcttccctctgctgagtctagggactgacttgcagcgtgctgtttaagttaagtttctctggtgcaatctgtgaagattgcctaatacttttcatgatcgatgtgttcgcattgctgaaacacaacagaagaaaaatggagtgctgggactggcagaggaaattaattgatgaaagaagaatggcccaagtttcattcgccctcagccacgcacaagggaaagggaactttgggttatgcctcctggacgcaaattaaaggccgagaaagaggccttgccatcaatggaatactgccatttatattgcttagcagggcatttgactactttatctgaggccagaactctcacacacagctatcaagtgctaagtttaaaataatcactgttggaattgtcatctgtacaattagtccataatgtttcatgtttgtcctaagtgtgctgttgctatgcagtgtgatctttatttatagtaaattatgtttcatgtaaatgatatatttttggtgaaatgcaaccttttctataaaatgtgggcaacattttaaagtttttttaaaatcctattttgataagtcagtatgccatatttaatgaaatgttattatataatttttttttcttaggcaagaaacctattggaattcgagacttaattaatgaagctttgcatcgagaaacgatgggtctgaagtccaaagtgaaacagataaaggaacttttattaaagcctgagactcaggccagaattaggagggagctttttgaaggaagacttattaacaacagtaattcagcaaatgacgttgatttcagcacaactttgacataagctctacattgcgattgtgacaacatagcttatgaaatcttttcagcttattaagtagctctttggtaaacaccaaagaagtttctgatagtgtctgcacaacagcaaaccaacatttggtgaggaattagcaatttcttgccaaagaaaattgattctgcccaattattttttgagctacacttgtgttttagaatatctgtttctgtaatattgagagttattttatagaaatgatttcttaattagctgttgtgagatatttctcgggtccttgcagaaaaaaacatacagactgtgaacaaatcattcacaaacagaataaaacagagccaacaacagtattttaagggtcacttgcctcctgttgacacaattgttgctaaatcaaaagaagcgttgtccaggtgtgtctacatctagtgttacttttaatgagaatttgaatgtttattgaacaatagtacttgaatgaacatttataaatgtaattattgcgatcactggttaagaatgttttatatatccttataatatttttcactgatcaaaatgttgttctgctttttcatttcttaaggaatacatgtttgggatttttattttttacgtgtccgaagataagctccaggtcttatcgtatcccttgccatctgaacttgtttgcactgcttctgtttgaaagagcatcttgaaaaacttccccggtatgatgattgttggtaacaactttttctatagtcattgatggagtagatcatgatggaggggaaatcactggagatcaaatatgtaaaatcatttcaaatataaaatccagtttactcatggattttagctattttttcactgggtaaattatactacatttatttacaaatgagtttatgcattttcatggctcttaataaacatattgttttcccttgtt

SEQ ID NO: 148 - DNA, 20255 bp, Homo sapiens
agcgtgagactcgcgccctccggcacggaaaaggccaggcgacaggtgtcgcttgaaaagactgggcttgtccttgctggtgcatgcgtcgtcggcctctgggcagcaggtgggcaaggaaggctggtgtgtgtgtgtgtgtgtgtgcgtgtgtgtgtgtgtatgtgtgcgcgcgcgcgcgcctcccctggtgtaagagatgtgccagcggctggccgaggggcgcttagggctagagcccggggcgctgcagaggttgagagtcagtgggtggggcgcagttatcaaacaccagggcccaaaagcaggctctagataggttccaggtgctcaatttctatttcacgtttggagtgagccagtggaattgtgaagttgtggcattttgattcggttgccaagagttatcactgggcctttgcaggtgccaaataaatttcaggacagagcctaaggcagagctctggcacaggaaggaagtaaaacgtttaatgagcaaatggacgcatgtttccaagcggtggtaggaagacagcagtttttggttgtcttcctggtgatcagcatggaaacctagtagtgctcttactctgatcaatacattgtcgaaggcatgtacctgatgctaacgtaacaataatattaaatattgactttatttgctattatttattgctaacattaagtactgctacctgctatgtgctaggtttgtctctgaagactttacatgtatttttcacgtttaattatcataatcttaagaagcaggtaccataattatctccatttgacaatgaggaaactgaggctcttggagatttacttgtgcaaggtcatgcttctggttaccggactgcttggtattgggcacccccgatgtctgactccaaagcctgatactaatcaatcactgagctgactctgtggtcattaatataaaattgatagaagtactgtggtcactcaggtctcagtcatttacttcttcaacgggaagtcttcgtgtctaccccatataccaagctctgcagatgctatgagtgggagggcaggtacagagatgaaacatattaatagttgccattctaaaagagcttactgtctagcgggaggcagaaagaaaaggcacacttgccctccagtgtcagaaaaatggatgtgctgcatgcccaaagggtagggatgcccaacagccctgggactggggaggttgccttcttggtaggttaaatgaatgagtcagaagaggagaggctggggactgagccaatctgagaaggaaccactagaaatgaaagaagaatcccaagagcttggtatcagagaagcccagggaatgggacatttctaagaggaagtgtgtcccagtgtcagatgcaaacatttccattggttttagcaaaaaagccattggtgttattaacaccgaaagcagttttaagtgatgctgacttaatgagtaaatgggagagggaaaatggagacattaaccatacacacatgtccagtttgcttggctgtgaagagaaggggtgatacagggtagttgctagagtggaaagtgtggttgaaagaggattttttttttttttttttgagacagagtctcactctgtcacccaggctggagtgcagtggtgcagtctcggcttactgcaacctccacctcccgggttcaagcgattctcctgcctcagcctcctgagcagctgggactacaggtgcatgccaccacacccggctaattttttgtattttttttagtagagacggggtttcaccgtgttagccaggatggtctcagtctcctgacctcgtgatccactcgcctcagcctcctgaagtgctgggattacaggcatgagccaccacacccggccgaaagagaattttaaaaatttctttcatttgaaagttgagatagatttaagcatggttatgtgaaaggaaaaaggccagtcgagagtgacaggaatgagagttgaagcaatgaggggatgggattaagaacaagatttctgaggcagtaggacagtgtaggatcccataagggggcaagtctttaactgagacagcaagtaggttgtgagccaaaacggcttggatatgagaacgtgagaaggttcctgctcaatgatgtctcttttctttgagaaacagaaggcaaagtaattgactgaaaatgagatggagtgcagtggagaaatttgaggaaggtgttgaaggtttagaagaggtgcatagggcatgggctagggagctgagcctattgctaagggatggcagaggagtcttaagtgatgctggtcccagtctgcagggttgcatctaggtgttggaaatgattaggacagaggttgaagtgatctagggttgacatcttggcatatttgtgtatatttattgtatagttgttgcctaaatttccacaaatatatgccttgctggagtgcagtggtgtgatcttggcttactgcaaccttcacctcccgggttcaagtgattctcctgcttcagtctcctgagtagctggaaatacaggtgcgtgccaccacgcccgatggtttttttttttggatttttagtagagacagggtttcaccatgttggccagcctggtctcgaactcctgatctcaagttatctgctttccttggcctcccaaagtgctgggattacaggcgtgagccaccacgcctgacctaaagcttctttaggataagatttgtgtaaggggtttgcaaactcaaatggaggtgatataaatgagaaaaactctcagtgtctctctttctctctctctctctttttttgagacagggtcttgctctgtcacccagtttggagtgcagttatgcagtctcacactgcaagctctgcctcatgggctcaagtgaacctcctgcctcagcctctcaagtagctgggaccacaggcaggtgccaccatgtctggctaatttttgagtttctttgtagagatggtgttttgccaagtcacccagtttgaggctggtctcaaacacctgggctcaagcaatccatctacctcagcctcccaaagtgctgggattacaggagtgagccatggcatgaggccttgtggggtgtctcttttaaatgaaagcatactctgtttacgtatttgatatgaaggaatatccttcctttccacaaagacaaaaattatcctatttttctcaaaacatatgtcctttttctctacttttcatttttgttacttttgatggacacatgtgttacattgatttcactttctcataattctgctgtaagaaaaacaatagtgccagttcaatgacaaatagcaacagtctgttattgctagactgttactgttagtggagactaccagaacagtcagtcccagtgtcagggaatcaaagagaacatgttccctctctaaagggcacagctgctgctcagctttagctgattgctgccctgcaggactataggcccagtgttgctagatcttttgatgtttcaagagaagcttggaatctagaatgtgatgggaagtctcttacatttaaacatgttggcaattaatggtaagatttaaaaatactgtggtccaagaaaaaaatggatttggaaactggattaaattcaaatgaggcatgcagattaatctacagcatggtacaatgtgaattttctggtttctttaattgcactgtaattaggtaagatgttagctttggggaagctaagtgcagagtatgcagaaactattatttttgtaagctttctctaagtataaataaatttcaaaataaaaataaaaacttagtaaagaactataatgcaattctatgtaagccaaacataatatgtcttccagtttgaaacctctgggttttattttattttattttatttttgagacagagtcttgctgtgtcacccaggctggagtgtagtggcactatttcggcccactgcaacctccacctcccaggctcacatgattctcctgcctcagcctccggagtagctgggattacaggcgcgtaccaccacacccagctaatttttgtatttttagtagagatggggtttcaccattttggccaggctggttttgaactcctgacctcaagtgatccacttgtcttggcctcccaaaatgctgggattacaggcgtgagccactgcaccaggcagaggcctctgttttttatctctttttggcctctacagtgcctagtaaagcacctgatacatggtaaacgatcagtaattactagtactctattttggagaaaatgattttttaaaaagtcattgtgttccatccatgagtcgtttgagttttaaaactgtctttttgtttgtttttgaacaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaagaaactgaatctgctaattaaaaaaaatatatttcattttatacattttagtgggcaaattatgtgtattcataagttttggtctaaaattaattttaggtaacagtgatgatgtcaaatgcttttgctgtgatggtggactcaggtgttgggaatctggagatgatccatgggttcaacatgccaagtggtttccaaggtaattgttttgaaattctctttgcaaattcttgtgattatcatgagattgcttatatgtgttcacctgaaatcagttgttactttactctgttccaaatatatatttgtgaataagtttaggatggattacttagtaaaatacttacttaaaaagtttcgatggacttaagacaacgaagaaatagatttggggatttttgtttaatttttaaagaaatatatatatatttaaataatacatgctcattataaaaacaaagtcacacattgtagaaaagcacagagaaggaaaattaaaatgtccagaaatcttaccgcctaaggatgagcatggttaccactttagtgaacatccctccagacatatagaaataaatgtatatgatacatatacatatagaaataaatacatatacatatagaaataaatgtacaccattttacataagttaaatattatatctagttttgaagttttttcagtcaacatttgtcttggatatatttccattcattcggtattcaataataattgatcacctattggcaggcattgttctgggtgcataaaatcagttgaacaaaacaaagacccctggtctcctaagtttttattatagcacgagagaacagacaactaataaaaacttgaataagttctatagcatgttggaaaataagtacaatcaataaaaagaacaaagaggagtttagaaatgccaggcaggttacaatattaaattgggtggtcagggtaagtatagactcatctcatctgttttagtcgccacgcagcattttaatgtgatgtgttacccttttgattgtttaactggccacctagtgttctagttaatcctgattagcttgcaagtgtgggtttttatcacgtgggtaagaaacttaatgtactaactaaaatatcagcttcaaaaagttttttacactctcctttttcatctaaatcatgtggcctacaattacattttttcatggtcaaaacttttgctattattcaacccgtttcccatttgccctgagaatactgcactggcaacaagctgcactgttttttttctaaatgggaaatgggttaatatcgattaataaatgtggcatcttaacttattttgattactttttttcctcttttcttttgagatggagcctggctctgttgcccagattggagtgcgatggtgtgatgtcagctcactgcaacctccgcctcttgggttcaggcaattctcatgcctcgagcctcgctagtagctgggattacaggtgcacgctagcatgcccagctaatttttgtatttttgtagagacagggtttcaccatgttgtccaggctggtctcaaactcctgacctcaggactttgaggtgcttgcccggccaacatcagtgtgttttaagaatcttagaagagttgaagagagtagctaagagctctgaggagagatggtcttacttgacctcagtagactgaggggctcctgacccttgtccacttgagccttggtagataactagtaatcaccttcctcttgcttatatcaacctgcctttcactgcaatatctctgaccattccctatatgctaaatgaatagtaaattgattatatgtacatttatactcatttgaaatatttatacttcacaatatattaagagtaaattgattatatgtatgtttatactcacttgaaatagccagtctacaaatggctggattagtcctgcccaaattaagataaacctttagaacttttcaaaattagctgaagtggtcgggtgcagtggctcatgcctgtaatcgcagcactttgggaggctgaggcaggaggatcacttgaggtcaggagttcgagaccagtatggcaacatggtaaagccccatctccactaaaaatgcaaaaattagccggccatggtggcaggcacctgcaagctcagctactcgggaggctgaggcaccagaatcacttgaacctgggaggcagaggttacagtgaactgagatcatcccactgccctccagcctgggtgacagagcgagactctgtctaaaaaaaaaaaaattagcagaagcataatgtatcttggcaaatataaaaatattaattttgtaaaacattcaacctgtatgaaaaatgttgactgtcatgagaagcatcttacaaaacaattaaaaattcacacaaaaaatttgaatcctgtcataggataactatgggttagttttagaaaaaaagttttttttttaaaagcaatacaatagaatcagttcccagtgggctaggatgtatttattcttctaacattaagtttagaataaatgatcttaaatgattctgtgatttgaggcaaacaaccagatttgaaatggaataaacacctagagatgagaaatttatgttattacattttcatttcacttgtataaataatccctcaaattttattttctttacattttaggtgtgagtacttgataagaattaaaggacaggagttcatccgtcaagttcaagccagttaccctcatctacttgaacaggtagggcaagttctttttttaaatattggttgccatcagagaaattgctttctgataattacagagagtgctatttgagtgaaaagacaagagttgttttagaaatacattttctttttcttatcaaacctgacatgattttagaaagtattattctttggagaaaaatagatccataaatggtagtctcctgataatgacacttgtgatgtttttcaaacaagttgcaataaatcaaacttcgagaaaaaatgactgggatagtagtatttaacagtttcactatataaattttccttcaaaagatctgagaaagagaattttattgctttttctaaccttgagaaagcaaataacttacataatagtttgatggtcaaacccatcctagccatgagcaatgaaactgatacagggtccaacttatcccaaaggatgacccagggtaggtaagacctgtggatgaaaggaaaattgattgtcacatggattatggaaaagatatagtccgtttcctgccttaatgaaaatgggttttgttattatatacacacactgaaactctattagtttatggcctagggaataactatcaaatataaatgaaatattgcttttggttaaaaaattattttgccagtaagcaagtggtttgcaacaagttgaataaaatatgtctgttgggtcattttcattgcaatgggtaagataagatttctattttaatttatatatatatatatatatatattttttttttctgcagctgctatccacatcagacagcccaggagatgaaaatgcagagtcatcaagtaagtacaatggataataatgaatgcatttaaatagagtcatttggtactgttaatattgaaagttgataatagtaatgtacctgtatattgatttataatttacgatgaatgcattttcaaatatactgtgttggtatttcccaaacttcagtgcatatcagagttgcctggagaactttaaaaaatatgacagatttccagtttctacttcagacctactgaattaaatctgagtatctaaaggtggggctcaggcatgtatagttttaacaaactacatacatccagcctaacacttgttcttgggccagtgtgggagcagatgtactatgatattagattgctcacatattctttctgtgaaagggaaagaatagaacacgttagtcacctttttaaatagggacgctgaggctcagaaaggttaaatgacttgtacatcaccttacacctaaaatgcaacagagctaatatttgtacaagcccctctactccattatctcatgttcaattcaattcagtatatatttattgtatattgtatatcgcctgttctgaggaaagcatagagaacaggatagagccaacccaaatgtccatcagtgatagactggattaagaaaatgtggcacatacacaccatggaatactatgcagccataaaaaggatgagttcatgtcctttatagggacatggatgaagctggaaaccatcattctgagcaaactatcacaagaacagaaaaccaaacaccgcatgttctcactcatagttgggaattgaacaatgagaacacttggacataggaaggggaacatcacacacagggcctgttgtggggtagggggatgtgggagggatagcattaggagatacacctaatgttaaatgacgagttaacgggtgcagcacaccaacatggcacatgtatacatatgtaacaaacctgcacattatgcacatgtaccctagaacttaaagtaaaataatttaaaaaaaggaaaaaaagaatacagaacaggataaacataactcctggtctcatgtatctactggaaacagacaaatacacagacaggagaaagggatatggcagcaaaagtaaagtgtaatatgagagtgcatataggacaattaacccagacttggagggtcagaaaaggctttccaaaggaagtacttgtcttagcagaaaatccaagggaagagtaggagttaaccgagtgacaaatggaagaaaagagtattccaggcagagggaacagcatatgaaagaccgaagtgacaaaggagaataggcacctttgaagaactgaacaaaattccatatggccagaagtaggagttgctaatagataaatcagggaagcaggccagctgtatgagtggtcagcactacaggcagaattgacactagagccatcagtttgtgacttctgggctagagtgcagaatgtgaatgattcagtggcaagagatgaggctgaagaggtaaacaaggttcagattgtatgagactttgtaagacactttattttggattttatcctaagagcaatggaattgttgatggaatttaagaagtgtgacacatcatatttgtgtttttaaaaagtcactctgattgcactgttgagaatgaattccaaggaagcaatattttataaccatagcctctctgaaaaatatgtgaattattcttgattgaaaactcatttgttcattcaacatagggaaaaataatctcaattctagtgggaggtaatccctgccattctgtttccttctcctgctcacatatgtatatccagttatgacaggtaatgtgtattttgcatctaagtacaatattccaagttgttatttaatgactgaacgtgtatatcattttaaatttaacaatgttcatacaaaataatgcctatacattttgttggttttacatttttaatattataaaacctttcaatttttgatttcatttcaaatttcaatttttaagaaatataaggctatcctaatatgtgttaaattctttgttccatatagttatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaagtatgtagatttattaatacagtctattttcataaggatttgatatcagtctatatgttatgaaaaatatactcatctagcatatctgaaaatatactcaatccagtcaggtttttttcatgtttagtattctgaattcaaatgctgaaaaatttattcatattcaaatatatttgagttgctcataagtcaaaaatgtatgatgtacaaaagtatttttcatgtttttccttaattcatatttttttctctggatagctgacgttgtgtccaattatgcattcatggcacattttttttttcttaacgctttgaaaatggaatccttgttgcatcatggcacatttttaatcccaggctagttgctcactcccctttggagtaaatcagggtgggatcagggacaattattaatttttttttgagacagtcttactctgtcacccatgctggagtgcagtggcatgatctcaactcactgcaacttctgcctcctgggttcaagcaattctcgtgcctccttcccttagctgggattacaggcacctgccaccatgccaggctaatttttgtatttttagtagagaagggatttctccatgttggccacactggtctcaaactcctgacctcaagtgatccgcccgcctcggcctcccaaagtgctgggattacaggcatgagccaccgtgcctggctggatggttattaattttaatgttagcataaaagcatgtcttagcctgtgactatacattaatacacaaattactattaagtcccctacctgtccacacaagaactgagtcttccagagcatccgtcgattatttaggcaagtcctagtatactgtttcacaatctcttaggacaagttgttcatgtccttccatactaaacgtatccactatgttctctattgcccttcacaaaaactcttctgggcacatacattctcatctggctgttttgactgctatcatcattctgtcctagacaaaaagaaatgctgatctctcctttcccaagcatggaccagacctataagtcccttcaacacagctgaaaacagactgcaacttttaacaagctcttactggagacttaaggaaaacggaagggaattatatcacaaatgttgatttacagctgcaactagctgtgacctctcttagtgcccccgggctcatcctcataaatctcccctgcctagcttctggttcatctctgtgtagctttggcaagtttacacaagtcactaggaatgtcccaataatgttttcctttatcaaaattcaggcccccccaatattcataaagctcagaaggagaataaagatttctccttatccttgtgcaaggccatctgggatctatttcttcacaggatgattgacagtcagattgtccacttcatttagggataaatccaaccctgcccatgaagatggatttgttctctgacccaacccagacaaacctatcagaccatagtgatatagcatcatacattcaccaaagtgtgaattactcagtctataaaccactagtgtagcagcaatacagtcacggttaacctttgcccagcctcatcaaattctcttttctctgtgaagattaggcaagcatgtccttcctgtagccttcttagtggtagccatttgtcatcagccaacaattgctcaaagaagagaacacttatctccacaactgttgagagaccccataaaatctaaaactatccacttataaaatatttatatttctttcaaagacaatcagaaaagtctccagaaatgacttcaagtcaacaatatataataatttacattgtgaaaaagagcccttagcgtttctgcctcaccattatatatatatctctactacctagtatcgtgcctgcatatagtctgtgttgtgagtgagtgaatgaaaacacatttaggttaatgattacgttatagtttcccaagaatagtagggatataaataaagaggtaatttaagattttttttttcccagaataaaataataatatggctgagtgtggtggctcacacctgtaatcacagcactttgggaggctgaggcaggcagatcgcttaagcccaggagttcaagaccaggctgggcaacatagcaaaaccctgtctgtataaacaaatataaaaattagcagggtgtggtggcatgtgtctgtagtcccagctctactcaggaggctgaggtgggaggaccacttgagcccagggaggttgaggctgcaatgagctatgatcatatgccactgcattccagcctgggcaacagagtgagacactctctaaaagaaaaaaaaaaaagaaagaaagaaaagcaaaaacaaaattaataatatgcttcaaaggcaactactcaggaggctcaggtacaaaaatagcttgaacctgggaggcagaggttgcagtgagctgagatcgcaccgctgcactccagcctgggtgacagagcaagactctgttttaaaaatgaataaataaataataaaagaaattttatggaagaatgatactttaagaaaaaattgttttaattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaagtatttgtgatggtgtatgcctggtaatcccagctactcaagtcttctgaacttgcaaaccagaatatagtctacaactttgaaatgagactttttctcagttactagcaattaaattttagaaatcttaagaacttcagagaatgcattatattaggttacgtataattacaaaaataaatcttagattgaaaaactagtatacttcaacaccaagtttgtatttttattttctaatatatccctactttgctaatagaaataatttaacaaaatatattaagttctaagtcttctacccctctcaccattacttttcattcctactctttaaattatagaactaaggtttgattgttcatttgttcaacagatatttatggagcattaactttgtgccagacactattctagctcctgacccttttctcatttattctcagagcttccattattttcaaaatatgtctttagccttgtctttttgactaagcatcatctttattttctggttgttgtttttgatttttgctgttttcttttttccattttttattctttcttaaatggttctttttatgagtcctatcacttgacaaagtcagtgtatctaaaatctaacaatcctctctcccaaaacaattcttcagatagctcagcctctgtcattagttattttttagaaacagctttatggattatggtaagctatatgaaaattaataaacttagattcataagttatattccaaagagataataaaactgcagttttaaaatataaaatgttttaccaatggatacaaaatctaggtcttgaaggagaattagatgatatcttgtaggacgagaaggtagtcgttgacaaatagggtttattattcaaaatgctgttactgcctttccctgcttactataaaatatttaggtaatggcaatatgtctaatttctggaaataattaaaatttcaacttaaaatggaattttaaagaaattttatgggccggacataatggctcacacttgtaatcccagcacttttggaggccggagtgggcggatcactcgaggccaggagttcgagaccaggctggccaacatggtgaaacctcatctctactaaaactacaaaaaattagctggatgtagtggcacatgcctgtaatcccaactactcaggaggctcaggcacaaaaatagctttaacctgggaggcagaggttgcagtgagctgagatcgcaccactgcactccagcctgggcgacagagcaagactctgttttaaaaatgaataaataaataataaaagaaattttatggaagaatgacactttaagaaaaaattgttttaattctcttgattttgtctttccccaatttgactagattgaattgaaacgtcaattttaatgggttctaagttccatttggttaaaggcttagcagtattgccaaatgattgaaagcacagtacatgacaccagactacctcagtttgatttttgctagttgtggtgtccttcggcaacttaattgcctcactgcagcttcattttctcatttgttaaatgaggctattaggacctacctcaaagagctgttgtgaagatgaaatgaatcaatacatgtaaagttcttaacacagtgctcactaaatgttagtccttactataagtagcattattattattattattatatttttttaagacagggtattgctatgttgcccagtctggtctctgactccagggctcaagtgatcctcctacctcagcctcccaagtagctggtgctacaggcatgtgccactgcaccctggattataattataataacattattattaagcaaaggagatgagacacccctaaacctagcaatcaacatcaatgccttactgattacgaattaaagatagtttttatcctgctatatatataggactggaaggaagtttgtgagcagagtttgaacatgtttatgcttgttttcttttttataaagatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttggtgagtgatagaaaattatttttaaaaattttctaagtcaattgaaaatacgctcttattaataatttatgactactgaaaataattcaggctgaatgtggtgactcatgcctgtaatcctaacaccttgggaggctgaggcaggtggattgcttgagcccaggagtttgagaccagactggacaacgtggcgagaccccatcactacaaaaaatttttaaaacaaattatttgtgatggtgtatgcctggtaatcccagctactcaagaggatgaggtgggaggatggcttaagcctgagagatagaggctcccatgagctgtgattgtgccactgcactccagcttgggtgacagactctgtctcaaaaaaaaatcaatctaatttatagatattagttacataaaaagattaaagacttctgttgccttgaaatgagtatttggctatagtctaaagtgttcatttttaaaatagattccatagctaaatattaaccttatttgtcatagtaatgctttttctttttctcccttagtgcaacaggacataaaatatattcccacagaagatgtttcaggtaatagtactaatattttaaatcaatagagaacattgtctttattttcttagtttttcactgaagaagcaaactgccttttattaaaaattctttcctctttctagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagc

SEQ ID NO: 149 - DNA, 20323 bp, Homo sapiens
cgcgactccgagctggccaaagaagttcgtcccctttgtgaggcccgggatgggaggtgagttgcttgtggtgatgtctctcgtctcggctcggcctcggcggtagttccccgggtcgttctgtgccgagtcggggctagagtgcgcgtttgttaaaggggcctcgagggcagaccatgagccctgtcccttctcactctggcctgatcctctcctcgggggacgcggttgtgccacgggcggggtggtcgcggggtcctgggccagtgccccgagcgcggcagaatttgtccaaactcctgatgccccagcgtcacctcttccaggcgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggaggtgagaattgcggacgtgttgaacttgtagcgtggaaggacgaaattcctgctcctgaagggaaaacggttggctcaggggaggtggctcttggctggctgtctccattgtcttggggatggatgggctttttaagtgagactgaagagcttggtatgggagcaccgccctttccatggcagctgggcacacagtggacccttcaaagctacccccaaaatgtgagtgaaatgttaacttctatggcaagaattcacctctttggttgtcaaaaatgttttgttttacataggagaaaacaggcgtagtagttaatgactgacttccattctacctgaccagtttcgtgaaggttgtgctgtgacctcctacaccagaattccccctggggtggttgttagatttctggattgtaccccaggctcaactaatgcttattactttgaggtggggtccagcaatctacattataaataagctttcagagtgagaaccaacgagtatagattaagctgggaaatttactgacatattctaatttctagatcagaggatgccatcttacagaatgtgttatgattatagcaactgaattcgagcccagagtagcaatattcccgcatatcccgggaagagggtcctgggaggaggtcggttgttttgggggtaccttcagtctcagtgtttgtaggcagcacatatagtatgttgaagcggtttttagactttaaatctgagtggcacattaagcctaggtctcatcattactgctttcttgtcgttagttctgtcttcccaggattctccccatttccaagagaagagcacagaagagggagaagtggctgctctgcgcctcacggccagatcccaggtgagtgagtctgctgattattggaattacaccttgtttcttagagtacagatgcactcccttctttgtgatgtggagtttctttatccactaaagcccatctgcagagctgagttctaaatctaagagactagtcaggagactaatggactcagaagaaaatgttttctacttataacactggatggatttcttccctatttagtgtttattgtccctcaacagataggtaagcagcatttccctttcttagcctcctatgctcatttctgtgcttggtaatgtgagaaactattttaaatataatgtggcacatacctcttaaaacttgtttctctagaggaaacagcatgtatgtgactttaagtggcaatctaagaaagcacttaaatgctgaagtgattgtaaaaataataaatactcacatagttcaaagaaacactggaaaaggaaagcctatgaaggcgtaatttaaagagttacagttagaatccagccctctgagatgacgaaagctaaggtatgatcatgcctgcaacttacttttatattgttggcccctctctcccaaaaggtaaatatgacaaatattacgaatgtttggctgggcgtggtggctcatgcccgtaattccagcactttgggaggccaaggcaggtagatgactaggtcaggagattgagaccatcctggctaacacggtgaaacctcgtctctactaaaaacacaaaaaattagccaggcatggtggcacgcacctgtagtcccagctagtctggaggctgaggcaggagaatcacttgaacctaggaggtggaggttgcagtaagccgagatcgcaccactgcattccggcctgggcaatgagggaaactctgtctcaaaaaaaaaaaaaagaatttttgaatttaggcggtgattgtactatatcagtgattattgcattcatctttcaacttttgtatgtttgaaacttttattaaaagaagttagggctgggcacggtggctcatgcctgtaatcccagcactttgagaggctaaggcgggcagatcacctgaggtcaggagttcaagaccagcctgaccaacatggtgaaacctcgtctttacttaaaatacaaaaattagctgggcgtggtggcgcgcacttgtaatcccagccactccgtagactgaggcatgagaatcacttgaacccaggaggcagaggttgcagtgagcccagatagggctactgcactccagcctgggtgagagtgaaactgtctcaaaaaaaaaaaaaaaaagttgaggaggaaaaaaggagctttccatgatgtgtgtggcataccacaacccagagattcctcaatcagcctttctctttgcttctgtaatccaaagtgtaaaaagtagatactgcacattcatagtgtttgtaaaagtcacttcctttatgtacttgcctgtctccattggcttctcaactgtcttacattagtcttgaagactttattagtcaagaagctttaagttgcagcggataaaatcaattcaaatgggtctaagtgaaaagaagtaactattgactaacaaactgaaaaatctaggtctggctacatatagggctcaaacaagaatgttaaaacctaattcttcattttactgacctttgctctccatgggttttatggccaaacaagtttttctcctagtgttggcctctaacgagtttaggcttacatcttcctgtgttgaaggccagagaaaaagggcagattctcttctagtcattcttgcagaagtgctgggattgactctaatggggtattaggcccattcctggatgagatattggccaaatttaagtgtaattctttatagaatatacctacacacacacacattcacgtgcacgcacaaacatcccacccgtgagtcagagatggcgtcagtactacctgagctacacagattcaaagtggccaggcatagtagctaggggaaaattagggcactggtaccagaagcgtgaatatatatttcaatactttgatatcagattcaacactgttaacagcatcaaggtgattgaacctattatggaaaatttttaaaactctctttgttctttttgcattttattagatttttaaaatgcaatattggagctttttttcttgttagaatttgcctgggctattttttacctttgatttgttagatttttaaaaatattaaaagttttagttcttcaatgtaataaagtgaacaacacagacatacagaaatgtaaaggtaatgctacttccccctcaaattcagtccctgcctctctctactatgtatattttttcacattttttgttgtacttgcactactgtattcagacatatggtatactatatttccttccatctacccaccagtacccaacccagcaataatattttgttttgatggcctattctgtatataggatgtggctttttaaaaaaacctttttataagggaaatttgctcattcacatataatacatgtgtttcaaacttttcttgccatgtgatttttataattctgtttcctgtgctttattgtttcctcttttgtagttttcctgctgtttgtgcaatggtttgcatttttgttgttctggctttttcttctaatttttgggcacttaatctccactgaatgttgatttagttatgtatatgcagattctaggctaaaggtcatttttcctcataatgtcttttctacttaggggctacttagtgatttttacatattattttatcttaagggaataattctcttctttctttttttttttttttttttttgcttttccaactttatttagaaaaacaaatccaggtctcagtgccccctgtaccctccccgaccccagccataatttaaataacttagagacagagttggagggaggggacaggagaggttggggtcacggtggaaggaggaagagagcccactacagccgccgtagcgcccgcttcttgtccgtctttttcttggccgccagcttcttatcgcgctcgccagcatgcttcttggccatgggaccctcagcccctcccaagccccctggggccccagagtcggtggaggaagctgcagtgccactggccagggcccgcccggctttggccctgccgctgggcccgccggcgcccccgtggatctctgtgagcagacgggcccgagccgcatactcctcgtagttctccaagagcaggcggcccgcctcctcgttgagtgcagactcggggttagggtggatcagcaggcacttgatggtcagcagtacgtgtcggatgcccagctcagccgtccagtccctcttgagcacgttgacgcacatctcgccattggcgcccaagttcgggtggaagatcttggtcaggaagtagcccttgggtggggaggcagggaagtccttccccagcaggagtttcatgcggaacagaccttgtatacatacaagtagacttgttttatcagaggatagatacatactcactgttggtagatagtgccaaagaggtttctagagtcattgtaccaattacattcccagcagcagaatatgtgcgttctagttgttccacatgcttgtcaacacttaatattgcttgttttcattttagccatccttttgaggtgtgtgatatcttttattttttaagaaataaaaatattacatattcagttaaagcccttttattctcagctgggtgtggtgactcacgcctgtaatcccagcactttgggaggccaaggtgggtggatcacctgaggtcagaagtttgagaccagcctggccaacatggtgaaaccccgtctctactacaaatacaaaaaaattagccgggcatggtgacaggcacctgtaatcctagctacttgggaggctgaggcaggagaattgcttgaacccaggaggcagaggttgcagtgagccgagatcatgccattgccctccagcctgggcgacagagggagactgtgtctcaaaaaaaaaaaacaaaaagcaaagaaaagaaacccttttattctctttctcccctagaagtaaccattatatcttgaaattggtgtgaatcatttcggtgtttgtgtatgtgtgtgtatacacagagatatatacatatgtatgtaaaacaatctgtatgttttattgttacactttttcttatgtagtctgattttttaaagttcacattgtattttgatattaatctatgttaatatatatgaattatgtttattcattttaactactgtggagtcataagtccactgtatgaataaactgaacagtttatttttttgccattagtagcagttgcagtgatcatcctttttttgattccttatgttcatcttgagagctggtttagggagataactggaagaagaattagtaggtcttaaatcatcacatgtttagctttactaggaactgccaacagttgagttatcagacttgttaatttttgtcaatctgatggatgcaaaatgatgttttaaaattttcatttctctgagtgataaatacaagtttgagcatttcatgttacttggctattcaagtttcttgtgagttacctgttgataccctttgcctgttttttgagattgggctgtttatatcttttctcttgatttggtggagttcttcatgtattttaggtactaatctatgacagaagtagcattgcaagtcagtgagaagaaattggttcttctaatctttggcttattttattttctggtgtgttaggcatatagaattaaacatttttaataacaaatttttttttaaatattgctttttgtgaattgtctatctactttatcccagtgtcagaaagattattttattccaaaatgttcaattttgttttacaggtatttatttttgtatatgatgaaatgggaaaactaattttgtctttttccgtgctgaaagccaataagtccagcattgttcatggaataattttatgttactgatttgtaatgctacctgtggtaaacccagttcctcagcatacttagttctgtttcttgtctctctggtttacttgtctgtctatgtctaataccagactgttttatttactatacttagtattatatatagctcataaagaaaatccttcctggatattattatttttaaaaaagttatacttttgaatattgaaacagtttaaaagtctttccctgtgattatggatatatctgtttcacctcagagacctatcagtttctgtgacttaccactcaccacccatctcccttttttggggtattgcagttttcatagtgatctgttaagaggtccttatatatgaggtttttaccttttcttatgttacagatattttttgtagtttttgactttcagttttgctatgcattttgatgtacaagtttaattttttataatctttttttttctgccttttcagtgctgcttaaaatgtgtttcattaatccaaggttacatatatatttgcctctgtttactagtgtattctttaattttttctttaggttcttaatccatttggaattacttcttacttctctgagtgtatcttcttagccttcttttttgaacaattaaatattctaattactcaaaatttgattttaatctcccttccttttgtatacctggagtcataaacttgagtacttacatgggccaggaggtaatatcactgagttaagcaagcaaagtggaaactggtgaaccagaggagtacaggcctcaactgaaaggagtagctctagctcaatggctggcaagctttttatgtaaatggctagacagtaaataattacgctttgtgggacatggtgtctctgcagccattcgatcttccacagtagtatgaaagcagccctagaaaatgcatacatgaatgggtatgttccagtaaaaatttatttagcaaagtaggcagcaggctgtagttgccaatccctgctctaaatggtggttgtcgttcagtacacttccagtttttttcaagagagaaaccctaaatttgcatttgtctgtaatctccccccccccttttttttttttttgagatggagtctcgctttgtttcccaggctggagtgcagtggtgcgatcttggctcactgcaagctctgcctcctgggttcacgccattctcctgcctcggcctcctgagtagctgggactacaggtgcccgccaccacacccggctaatttttttgtatttttagtagagatggggtttcaccgtgttagccaggatgatctcgatctcctgacctcgtgatccgccctccttggcctcccaaagtgctgggattacaggcgtgagccactgcgtccagcaataatctccctatttttaactgtgtataactagttttaaaagtttgtataaaaagtgtggcccaaagaaaatgtgtctaaggtctgatttggccaactgatcaactgtttgcagcctctacttactacttcattagtctcatcattcccacaaccagttaccttctatcaagatgagtcccaaattggtatttccatcctagagctctcctcagggctgttctcaacatcttaactatttgattcctttgtttgcttatgtcaacgatacttcaatacaacatgtttaaaactgaatgtctaaaataagtctaaatttcccatctccccaacaacatccttttccagtaattgttttaatggtacttattgtcatcaaattgtacgtggtggaaatctacgcacagtctttacatcaccccctctctcctttatccatcactgtatttacctaattatattctaagtatttcttcactgttaattttccttcatatattttttgttttcctggattactgtgataatctttgtgattccgcctttgccctcatatacttcattctcaacattgtagtgagactgatattttcataatcaaatctcgtcttgtcatcactctgcttggaacatttgaatggcttctcgctgccttcacggtaacagacaaaatcctggaggtctacaaaatcttgtgaaatctggcttttactcattatcccaacctcatttcacaactactcttcttccatctctgtgctctagtgtagcagttctgaatgctttggcatcagaggacctactgtaactataaaaattgttaaagaccctaaagatgtttcatttatgtaggttatatctaccaatagttactatactacaagttaaaacagaaaaatttcaagctattagctaattcatttaaaaataattggccggatgtggtggtccacacttgtaatcccagtgccttgggaggccaaggtgggtgggtcgattgagcccaggagttagagaccagcctgagcaataaagtgagaccccatctcttaaaagaaaaatagaaataaaaaattataaacatgtcatgtgttagcacagtatatttttttattaaaaaacattattttctttaaacaaaaagtgttattaagaagtatggtctcctgttcctgggaggcgggcgcggcaagactgggaggtggcggcagcgggcgaggactcgccgaggacggggctccggccggggataaccaactctccttctctcttctctcgtgcttccccaggcggcggcggcggcggcggcgcccgggagccggagccttcgcggcgtccacgtccctcccccgctgcaccccgccccggcgcgagaggagagcgcgagaaccccagccgcggccgggcgggcggcgaagatggcagaggcaccggcttccccggccccgctttctccgctcgaagtggagctggacccggagttcgagccccagagccgtccgcgatcctgtacgtggcccctgcaaaggccggagctccaagcgagccctgccaagccctcgggggagacggccgccgactccatgatccccgaggaggaggacgatgaagacgacgaggacggcgggggacgggccggctcggccatggcgatcggcggcggcggcgggagccgcacgctggtctccgggctgctccttgaggactcggtccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacagacggctcactctgtcccagatctacgagtggatggtgagttgcgtgccctacttcaaggataagggcaacagcaacagctctgccggctagaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcacagccaagaagaaggcagccctgcagacagcccccgaatcagctgacgacagtccctcccagctctccaagtggtctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgacgatgcgcctctctcgcccatgctctacagcagctcagcgagcctgtcaccttcagtaagcaagccgtgcacggtggaactgctacggctgactgacatggcaggcaccatgaatctgaatgatggggctgactgaaaacctcatggacgacctgctggataacatcacgctcccgccatcccagccatcgcccactgggggactcatgcagcggagttctagcttcccgtataccaccaagggctcgggcctgagctccccaaccagctcctttaacagcacggtgtttggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtgtggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaagcagaccctcaaactgacacaagacctacagagaaaaccctttgccaaatctgctctcagcaagtggacagtgataccgtttacagcttaacacctttgtgaatcccacgccattttcctaacccagcagagactgttaatggccccttaccctgggtgaagcacttacccttggaatagaactctaaaaagtatgcaaaatcttctttgtacagggtggtgagccgcctgccagtggaggacagcacccctcagcaccacccaccctcgttcagagcacaccgtgagccctcttcggccattctgtggtgttttaatattgcgatggtttatgggatgttttaagtgttgttcttgtgtttgttttcctttgactttctgagtttttcacatgcattaacttgcggtatttttctgttaaaatgttaaccgtccttcccctagcaaatttaaaaacagaaagacaatgttgtaccagttaccattccaggtttgagcatcacaagcttttgagcgcatggaactccataaactaacaaattacataaactaaagggggattttctttcttcttttgtttggtagaaaattatccttttctaaaaactgaacaatggcacaattgtttgctatgcgcacccgtccaggactgaaccatgcataggcaaaacgagtggagcacagcgtccagcccagtgtgtttccagttctgagtcagggtgatctgtggacgggaccccagcaccaggtctacgggtgccagatcagtagggcctgtgatctcctgtcagtgtcctcagctaatgtgaacagtgttggtctgctggttagaaactagaataatgatattttcaggaaagaaatcagctcagctctccactcattgccaaatgtcacccaaaaagggtttagttttaaggagaaagaaaaggaaaaaaaaaaaaagtcctgttttgctttgcagaacaaatgaacttacaggtgagcattaagcttgcagtgagaaatgtgcaaagagtaaaaacccaagtcaatgctgaggcagttccaacttcactgttttcctaaatacacatccttgattattttcagccttgctatataatctgatctgctagaagtgtatgagtgagaggcaatagcatataaactgattttttaaatataagcttaggttgtaattgtacaagcgactcaatggaagtacaaaatagggcagttttaacttttttttctgcttctgtggatttcattttgttgtgttttcaaaaagttatggtgctgtataggtgctttctgtttaacctggaaagtgtgattatattcgttaccttctttggtagacggaatagttgggaccacctttggtacatatgaaattggtataacgatgctctgattagcacagcatatgcatacttctccaaagtgatatatgaagactcttttctttgcataaaaagcattaggcgtataaatgtataaatatattttattatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtataattttttaaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgggtggggatgcattgcagaggcagtagtagcatgggggctagagtggggagcgagatggaaaagggtggggggataggagaattctagagtgcttccagcatgagggtcctgagaacttctgtcctgagttcagagaaacatgcaaagtaactaacaaaatcgctacttgcctttgcagttttacagacccagggagctgctttgggagtgagaaaggcaaccctccaatgtgtttcaactttaaaatgttgaattcttttcagacatgtggtatctcatttattctccttttctagcgtttgttgaatttcaggcagaatgtcttacagaatgtcctagaaccagattatcatttaatccgaaacagctgaggaagggacagagaaggtacaagggcaaggcagcataaaacagatcaggagaatgaagagggaatgctttggttttttgttctgttttgttttttctttttcaagtaactaaaacagcatctacatgtagagtgtcgtggagagctgagaccagggtaaagtcaagtgcagcatcagtactgcgagacccaccagcccctggagagggtcagctgagaatctggtagtgaagcctgtgtagggtcccggcaccctcaccctcagccacctgcagagaggccagggccccagagactagcccggttctgaagtgggcaggggtgctgccagagccttccgccccttatattgagaccctgctttcaggacaggccagccgttggccaccatgtcacattctgagtgagtgtcacgggtccctaacaataattttctgatctggagcatatcagcagaatgcttagcctcaaggggcctggcagctgtaatgtttgatttatgatgagaactatccgaggccacacttggcctctaaataagctgctctagggagccgcctactttttggtgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaaatgtgaatgaatctgagcttggtttcctttattgcttcctctgcaatatgattgctgaaacacattttaaaaattcagaagtttgtcactcctgttaatgggaggatcattcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttatacgcagtttaaagatggtggggacagactttgcctctacctagtgaaccccacttaaagaataaggagcatttgaatctcttggaaaaggccatgaagaataaagcagtcaaaaagaagtcctccatgttggtgccaagggcttgcgaggggaaataaaaatgttatccagcctgaccaacatggagaaaccccgtctctattaaaaatacaaaattagcctggcatggtggtgcatgcctgtaatcccagctactctggaggctgaggcaggagaatcgcttgaacccaggaggcggaggtcgcagtgagccgagatcatgccagtgcactccagcctgggtaacaagagtgaaactccgtgtcaaaaaaaaaaaaaaaatgttactcatcctctctcaaagcaaaaaagaaaccctaacagctctgaactctggttttatttttcttgctgtatttgggtgaacattgtacgattaggtataatttaaaaaaaaaaattttttttttggtagaaatgcaatcaccagtaaagaggtacgaaaaagctagcctctctcagagactggggaggcagagtactactagaggaagtgaagttctgatggaatcatgcctgtcaaatgaggtcttgaagcggatgcccaaataaaagagtatattatattttatctaaatcttaagtgggtaacattttatgcagtttaaatgaatggaatattttcctcttctttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaactgtattgtgcattttggcttcacatgtttaactttttttaagaaaaaagttgcatgaatggaaaaaaaatctgtatacagtatctgtaaaaactgtcttatctgtttcaattccttgctcatatcccatataatctagaactaaatatggtgcgtggccatatttaaacacctgagagtcaagcagttcagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttactttccttggtgtttgtagatattgccttgtgtattccacttaaaaccgtaatctagtttgtaaaagagatggtgacgcatgtaaataaagcatcagtgacactctaaaaaaaaaaaaaaaaaaaaaagaagaagtatggcattgttttacacttttgccaatctctttaatgtatgacataatagaaggtagctatattcttacaactgcttctgaatgcaacttgatatgacatgttgttttggttgccatgcatggagaaaatccagtgtcacgcagatataagttgaaaaaggaaggagtattttatagtcttttcaggtaattatggctattcttctttgaaacagctccaaaactgaacaagtgatactttctgaaagattaggtacaatgtagaatctgaaaccacatccataaatttttcatatattgaaatctatcaatcttttggacaatattggttcactaagtgcagatcttctttgttgacactttatattgtgcaatatttttgaatattataacttttagtatcacaactgaccttatcagaaaagcctttaagttttaggaagccatcaagctctcggtggtaaatagaagttttccaaaacttgtaatttctgcctgaaagctcaaattttataaaaaactcatttgttgtccttgatacaacaggttcactttgttcatttttgagaaactgtctgccagatacccaagttagataacatagtttgccattcagtcatcctttcaggtaaaatggtggtctgtgaaacaagtggctggttcagctcacaactcaaatgattgcatggtatatttcctcaagacgaccattgttctttggtataaacagaattgctttgcgaatatttcctatttcattaaccctgaatattaaaaaggcacttcaaggattaaaattcaatgaaattaatgtttatgcttccttagacatttttaaataaaactggcttttttttttttaaaccaagagtacatgatggggaagaatacaaggactactagtaagtttagtatcattgtgttgatttgtgcgaagttgtaagcaattttaccactacttttacgacatcattgaaaatgttgagacaatgaaaaaggcaaataacatctaaatgttattttggaagcagttttgaacttatagtttcccaggggttcatggaccatacttgaggatctttacctctacctacctatacaagccttatgtcaatttatgttttatttatttaacaagcacttaatgtagcacttatgctgtgtcagagttttaaatgcttcatagatatttgcattaatgctcattaaggtagctattgctatcattccttgcaagacggatactgttattgccctctcttacacataaggaaaccgaagtaaagaggttaaataacttatccagtatcacacagctagtaagtggcaaaactgcaattcagattttgctcatgaatgttagattaaattttctcttcctctatatgtatagtgactgttttttcccaagtgactagttcagagcctagcacatggaagatattctataaatatttgttgaataaaatggatagaagatgaatagatagatgaatgaatataatttatttgagtgtatgaaatgagtgactcatctaacttaattttcttctaatagttaatcagttgccatggcatcattggaaaaacaaatctatgttttgttcactgactgaaataccaccttcatattatctttaattcttacatatactttatttctgtatttgctcttctattttactcctgtttatttctttgaactacactgcttaaaatattttctctatataaattaactttatattggatataaaaattctactatatttatattagatatatttagagaggttaagcttccatctctgccctctctcctgtgttctgatgttttccctataggtacaaatttttattggttttccatttatcctttttttatttttttttaaatgtaagcaaacagtataggtatttgtaccccttttttttctttataaaaaagtagcaaactgtgcgtgcttatttatatcttgctttttccttttaaacttaatatatcctggtggtcaccttatagcaatatgtaaagatctttgtcattttttaaggagatggatagtactccattgtttgtatccactatatgttcaatcatttctgtatagtaggatatgtgaaatgttatcagtcttttgctacctgaattagtgcttcaacaaatagccttgtgcatatatcatttcgtatatttgtcattatgcctttgggagatcataggaggtttttgatcagcaaaatgttataaaagcattgttaggaagattaaactggcaatggaatacatatttggatgtgagtaggattggaatagtgaaaatttagaagccataactgtactgtacactaagatggttgtgtgcctagaaatttattacaataagtaggtattctataaaaagttatttcttcccatcctgatctgtgtactcattgtctgctcatccatggatatattgcttcatcggcatctctactcttatattttttgtcatctttctcctcttccgactctcctggataggatgtacttattttctctgcatattctgagcatttgtttccctccctttgtttctctttgcaagtcatctgaaagagtcaaatccacttgctccttgaaggcatgcttttcactttcattaactcttacctattacagaactgcctttttgttgagcacagaaaacgaaggaaatttgcatttccaatgtccttcagacgtggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaagcagcaaggaaatcaggagagacatttgagagaaatgttcactcacatgaattcactctctgaggaaacagaccatgagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctgccattcagtgcatattcaacaccagagagtccatactggagagaaaccctatacctgcaatgaatgtgggaaatcttttagccacagagctaatttaactaaacaccagagaactcatactagaattctctttgaatgccgtgaatgtaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaggccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtagtgaatgtgggaaaaccttcagccagagctccaattttgctaaacatcaaagaattcatattggaaagaaaccgtacaaatgtagtgagtgtggaaaagccttcattcattcatcagctcttattcaacatcagagaactcataccggagagaaaccctttagatgtaatgagtgtgggaaaagctttaagtgcagttcatctctcatcagacatcaaagagttcacactgaagagcaaccctga

SEQ ID NO: 150 - DNA, 960056 bp, Homo sapiens
gctcgctcggtctccggctccggcgccggctcctgctcctcctggccgcccggggccaaggcgacgagaggttgtaaaaatccatgtgggacggccccggggcgagcatcggaaaggtgagacgccgacgccggggccggggccgcctggtgcccggctccctcggggcgcccgtgcccgggcattcctcgtgccgggtccccctcgctcgtggggagctgcaatgcgttatcgtggggagcctaagggtgaaccatccgcctcctacggggctttcttgggcggggggagggatggggcggcctaagggaggctttgccctgatgtataaacccccggattggaacaagtgcacggtttcctccagcgcgcgggcgccgctcgctagccccggctgcccgggccacctcccgcagtccctctccggcagccaccctcactgccatcgcctttcttctctcagatccccctcttctgcctggcgtcccctcttgcctcgaggggtggggtgttcgcggggtcgggggtcttgagcaatcctaagcagaacaaagtggagaaaggtggagcccccgcccgggggtggggtggctggccgcctgggtgggttcagaggggagcatatttttttttaaaaaacccgtgtcagggaaaatgaagccgatttatcggggagggctaggggatggtgtatgaaaaggaatacgatgtgaaattgaactgaacggcatcccttctctcctcctccccatctcctaattatacaaaaaaagggatacttacgaaggtgtacctaattaaaaaaaataccgtacgagcctttgaaagatcgtcttaggacagtgaagattaagagctgctttggttcggggtaataaaatagcgctcgtaaactctccgttcggccctgccttatttattttgtacttaagggtctctgttctccttgccagagagggagggtccgctcttttaggagtggatcgattttaggcggctacctgcctttgctgtatgaaaggcaatttactccccgagcggtgaattgtcggttccctctgtgattgacagccacacctgccacttacgtgggtagaatggggaccggtggaacccaaagaaccaatcaatgctcgggagaggagggcagctcccacttgtcatggttagtttcctggttggctctttaaatcagtgattttacttaaccattggtttccacctggtatggggatacagctgtgagaggcagacaagcgggaagaaaactctttgaaaatggacttttagaagcaagtatatttgacctgtgtttccttgtcctccccatcccttacccaccacccccctgattattagttgtagtagttgcggatgccgaggccactggcttaaaaatgaaaatgaatctgtgtaaagaaggaattgggggagggggtgttagaattgcccacctatttctccagaattgcagtctttataagagacaacatgtaccgttgagctatccgggaaaagggtgtggcactttgtctcctatggtcactcttgtccttgtaaagtcacattgtttctcagtatacagtacttggggcttggctctactggatggatttataaggtatttttggagccggcaaacgttctttatggggagtcacatgaatagaagggattcttttagttctgacagttaactcaacttctggaagtgagggctgccttgttctcttttgcagaatgtcagttcggtggtggtggggtcaagccattttctttccggggagtagtagagtttgcctttttctcatgtaagccatcttgtctgtttgcttctgtgctttaataaaatacttttacagttttggcagggaggggtgtggaaggtgatggtgtcatggttttcaccagcaagactttcacgggtggatgaatcatgggtgaaggaccagatccatctcaactcactactagtgaaagcctgatttttcaacacccttctccctgaattcattagaaaaattactgattgatccaaagagctgtcactttatagaagttgtacctggatgtgaacataattctgtgaattaagcctttcataaacagactgtgagccagaatatactgattagaatggttttcatgtagaagccgggtttgtcaaagcagtattattactattactatcatcatcattgttattgcataggcaagcactttgttgagtactttatatgcattatcttttttaaaccttgtggagcccctgtgaggtaggtactattcttacgcccaaattatagatgagtaactagaaggaattcagtatcttgccacagtttagtatgaaagcaagaacctgagcccgggttcgtcttacccagagcccatgaccttggccgtggccttgacttcaaattttggttgtgtagtctgcatgtgtccagtctgaagtgtgggttctcccagcatacgtagagctaaccattttaagagtccactgtgattctgacagtccttttatcagcctgttttgcctttgcatttgaaggctgtggcatgggccaataggcaaatttagtaactctgtttattatatatttccagtagaaacataataaaatataaaaaatataacacataataaaataaaaattttggctcgataaaaatttggttccaaacttaatgatgatgacttaaaagaaggtaaaacaaaacaaaattcacactcttccatttttcttgacaccttaaatttccaattagagttttaaatagatcttggttgaataaatgctcttaacatccttcagttgtctccccaccaagggattagggttttattttctttgttatttacagagacccttttccattagtgattaggtataatgatatttaaaattattcttttgtaatagcatgaccgtcttgttttattttattttttattgttttttgaaatggagtcttgctctgtcaccaggctggagtgcagtggcgtgatcttggctcactgcaatctctgcctcccgggttcaagtgattctcctgcctcagcctcccaagtagctgggattacaggtgcccgccaccatgcctctctaatttttgtatttttagtacagactgggtttcaccatgttggccaggctggtcttgaactcctgacctcaggtgatcctcctgccttggcctcccaaagtgctggcattacaggtgtgaaccaccatgaccggcccctcttgttttgttatgttggaaaagctacaagatgtaagccttatcagtctcttcccattggtgaaactcagtggtgaaggtttgccaaaacaggtatcctgaaaaataaggtgaatggtattgcagtccacaaatttacctaaagagtctttgactttggttaggttgacttttgtacaatctgcatttgcttgttttactaggacaccctctagcctttttttttttcttttttctttttttaaaatcctctaaccagttaacattttggctggtccgtggggcatctacttgccagccaacagtttcagtttcagcaatgtttacactattcctttatattttattgtgattttcttagtttagaaagataggatgaatggaaagcacagaaaagcaccaatattcatggtaatgtagatctcataaatttaaaatagttgatccaaaggtagaactcactggatgtacaaaacatggagactctacaacctcttcttcttatgtgaagaaaaggaacaaaatgaatgaagatataagacatgctaacatatatcaaatgataagatatattagtcagctttggcagtgtaacaaaactccctgacttacagcaacaggtatttattttcacactcatgggtcttcaggttgaccgtgatttggctggtataggttgggctccttggggtggctgtgtagaggctgtgggttgggttccagtctcctccacatgtgtcctggggcccaggctgaagggatggcagctacctggggcatgcttttctcctggcagatcactggagccaagaggcaaactacacgagcaaatgtcactttcactaataacctgttttggaaaagtactattttggacaacacttgtctgtaaacgtagactctgttcacagtaagggagcgaatatttgatgaactatcatccagcttccaacagcatgtaaaaattatggttagaggattttctaattttttctttttcttggggaatgcaattttcatcccctcactcccattgctagctgcgtgacatataaacctggtccttaacttctgcatttcaggaatattctctgtttgattttagagggctggctataaaacaggtttgtgtatacacatgaattacttaaattattaaggcactatttattagaacctactgtgttccaagagacaatgttcagtgcagtggtgaacacagttttattctgatgtgggtcctgccaccatgaaacttatcattaggaataggtgtaaggaaggacttcttggatgcaatggcattttcctggaccttaaagcagggagagagttggagatgcagatagagcaatggataccataaaaatgtaggggcacacatggatataatgagttattccacttggccagagagtaagaaaggtgaattacaacaacaataataattataacactagtatttatagcttaacttctattgggcagttaactatgtgttaggcactgtgcttagcactttccataagatatttaatattgggtaggcttgctggttgcctacccaacattcattttctcctttccaactaaaagaaccccaattttgtctgagatggaaataagcccacctcaccttcccaagactcccttggacttagagtggccatgagagttgggtctgataatggcataggtggaagtttttgggtggaggctttcctgaaaatgtagtgagtgagacacacgtgggtggtatactccaagaacttttcagctctttaacttcttgctgctgagatcattggtgcaatgcctggaggggcagcagccaactacaacaatgaagataaagccatggtttttgtttttttttgtttgcttttgagacagggcctcactctgtcacccaggctggagtgcagtggcaccgatctcagctcactgcagccttgacttccccggctcaagtgattctcccacctcagtcttcccagtagctggaactacaggtgcgcactaccatgcctggctgatttttgtatacttttgtaaagatgagatttccccatgttgcccaggctggtcttgaactcccgagctcaagtgatctgcctgccttggcctcccaaagtgctgggattagaggtgtgagccaccatgcccagccaaaatcgtgtcttacaaatggcaaagctggagcctggaaggatcttggtcttggtgacatcgttcattcatagtaccagcttagactgccttcccctgtagttcttattgcataaaactaaaaagctctttacttgtaagccactacttattacttgcagccgcacatactcctcactgatacataccttctcaagaaaaccctcaaagtaggtgctatcacctattttgcaggtgagaacattaaaacttagaggggttaaggacttgcccaaccagtaagtagaagcattgggggttcaaaacaacatcattttgactttcaggatcatcatcttgcctctggctgtgcaggacaagtaccatagtggagataatgttggaaaattaggctggattaagatttaggaggcatctggattcctggttgaaatatttgagtttgatttcatgggctagtgagtataaagccattgaaaaagacagagaccagaggttgggagaccactgaggcttgagtgcatgacatacatgctttagtacgagtgaaggtggagggaaaactgggcatgaaacagagctggggacatgagaagataatggaattgagtgaacccaaatcatagttgctgttaacctatgatcatctgagagcaaaatgaaagtctcctgaaggctagtattcacttctactgatggcttcacatttgcccagaagtagggaatgagtaatgtagagaattgctaatgagatatgaatcactatttcatgctgtggggtggggtcttctactcattgtcaataccatttattgagcccttgacgaccttgtattaaatgactttggtctgggtctggctccactgtgccagttaaaggtagcagagatgaagggtaaggtcagaaggtgctgcagtggtacattagattctgtccatggacttatttctgctaaacattctagaccttccttgaggggtagattggggttactttaactgtctgtgtctcctttttttcttctctttactttttaaatttgtaaaataaaggatttggtttacattcatagttttcaaatgtttttcagctgttaaaactttgtttcctaaataaaaatttatctggaccctcagtatatttatagaaagcagagctgttctggaaatttagggtccagatttatgttgtatgaagtgtctttatgttgaggccactgctctaaaatgacacctacacacccttcctggttcatgattatgtgaatcttatagctgttcagatgttttatttgtgcatcatctttaacaaatccctttgttattccacaggttgtgtcttaatatcatctgtggtagagactgttaatgttccccatagccactttttctttccttccaggcatatgttggaggtggcttgcatcacttccatgctagaatatttgatttccagtgtgagagcacccagtgccctcttctactgcaatgattacggaaatgtgtgttgagatggagcccttcatctgcctgggcctttcagtcactaaatgaacacagcttcccgtcaactggagttggacatatagaccaagaagtaaactttggttgttttaagccatgaagagttttgtgatttttggtttctgcagcacttttctgcttatctttactgatacaccatctttgagcacatctgctaaactttatgtaacttactttttgggtgccttctggattaacctgaagcctggccagcttgtccttactttgtagttaggaaaagagtgggctggcatctacatccgctgtccgtgctggtctctgtgctaatagattctttgaattgaaagctttatgctcaataacatttgttttcatgcttaaaaagttcctgaagacatattgtatagtgcacctcactgttctttaaaaaaaaaaaaaaagcctttatgccatcttgctttttttttttttttttgtatttttagtagagacggggtttcaccgtgttagccaggatggtcttgatctcgtgaccccgtgatccgcccgcctcggcctcccaaagtgctaggattacaggcgtgagccaccacgctaggccgccatgttgctttttcaagtatagaatctctgtggcttagagaggaataatgactataagttaccataacaatggctgttattaagtagtgattgatttgtgaagtatttattgagtatctactttgtgttaggcactgggggtacagagatgaacaacagatagttccttactacttggagctaatactccagttggaagtgatggatacgtttgctctgttatatgaagagcaccatttattgagcatttactatgtggtaggcactgtgctaggtgctttatattgctcatttcatattacctatacaggtaaatgtattatcccattttataggtgaggaaactgagactcaaataatttgataagttccataaaggcaggagctttgcctttggctgtatccctagtgcctagatgttctgtaagtatttgtcaaatgactgaaggaacagaaaaacttgctcagagttaatgctgtggcagagccagagtttgaatccacctctgccttactctcaaggctgctaaattatcactagagaaagtagaaacaatgagtggccccacaattacaacagaaacaaccaacaagccttaaccattgtcaatgccaaaagcaccaggagctctaagctgtctcactttcacagccagggccgagccttctttgtgattttctgctcattctttcagctggggaagtccaaggccactacatcactgacttaattgttaatataattggttacccttctcttgggccagttcatctgctactccagcctaatttcttcagcacttggctggccaattcccagggcgtgcctcaaagttctgctcttaacctcttgggcattacttctccacttacatcttccagatttgttgctttgaagttgcatttcctctgttcttgaactcatgttgactctgccaagcagagttcgcttggtcagagcccaggaatctctagttgctggcacctaatcagcactcaacaaaattaaaaagagagagagtgcgtgtgcatggaagaagagaagaaaataaataaaggcaggaagaaccttcaggaaggaactaagtggttattttttcctggaagtcaatggtgagattatagccccactggatgaagagttggaagggcatctgtgagatatacctgaaaaccaaaggccagccgcaatgttcatagacatcttataccagcaacttagttttgctatggtttatttttcagagtctacattttgctcacttaattatcctgtgtgagtgtgtgtgtgtgtgtgtgtgtgtgtgtggtctgatagcattagctctcttttcctgtcttaatactttccacccctaaaggtagttgtcattctgtgatttcagggcatgaatgagttgcaggcagcaaagtgcatttaccctaaatgcattaggagcaaactattaattcaaggcaacttcttagtgggtcagaagacaagagcttgaatgggaattgagcaatgtgactgttctttaagaatatgctcagatccttatgcaaaccgtgaaagatttctgctaaatggtatgactaattgcagtaagaaagagcagggtttcctataagaaattgaacctagttgtgcactgtggttaccagttcttatgtggcatatttctctataataagataggtgtggtcaggagttcatcctctatgggcctgaggtgattgaaggtgggtttggggtctgggagctgctctggcagtgagagttgagcagctctgccagatgtgaggttagggcggtcccatgatcactggttattttctcagtgatactggtgggcatcaaatttctaccaagatgtctttcttgtgcctggcttgaggcagattagccatgctccgttttgtcagccagctccagctgtcatcacctcgaggagcagtcgtggttcaaggggcgggttccgagaggagcagggttgttgactctttttttacattgacatctcaggagaggatttttgatgtcttttctttccttctggtgatgtatgtttttccttcccttctaaggctgtaacattccctcctcccccttctttgtttcgcattttgaccctttattcgtattgttcatgaagcctctccctgacaggaagcaggaggttgggtagtgagtgggataacagcgtggcattcgtatgggcttgttgaaaataggtcctgtttgatgctgggtggatacaaaagcacctgggtcttagtggctgctgttcatcaggcttgtgagcgtggagcagttagtgtgggcacgcaaggggaattcttcaccttttttgttaaagctgagaaataactctctttttatacatgggctttgaatgcattcatgggccaccttgaattcacaacatgaatagttgcttagaataacttcagagcagattcttttggatacagagacatagcactgacctggggtcacaagccctaagttccctttctggctttgccactagctttctccttatttgggatctctgtttctctatcatctagtccaatttgcttcaaaggcactcttctagatctattatatatatatttttacaacagtttcttcatgcaaaggttcaactaagtaattatcattttattagttattttaacctggaaaacaggagtggctggtgttctttcataatagacattagtaacaaagaattaagccattctgttatgtagtcgtcgtaaaagtgtatgcttgctttgtgccagtcttcttctgggaatagggtgtgtacacgtcaagaggaccataatagagcaggtaattttgtaggggagttcagggattgtagtatccagtggagcaccaaacaagtaagcaggcaataatggatgctctttgggggaacatccaggctatcatggaagacttaggagagtcatggatgaagaatgaaggaaggcttcctgaagaaagtagcacctaaagtgtcactgaagggtaaatggaattagccagaggagggaggatttgaaggtacaaataacagggggaatagcatgcactaggtccaaaggtaagcgagagaatgggagattcagggttcacggaggtaaatgtaggtagaactgtagagctggagtttagcttggctcaggatgagggatggtgagaggagccagagagtgtgacagggcataagaccctgtgagccattgaggagatgggactcaagcttaaaacttcaagagatttcaagtaggggacggatacgatcaaggactctgaattctctttattctccttttatttcaccgtcatggcaataattacctacttttgatgcttgtgggagtgtgggacttgacattgggaagagagggtggcaagatgacctgaagaacaatagaaagattgattattatggctttgggactcctagcaatgtccattctgattcattgaccaaacacaatttatacagccttaataattttgaaagaccattttccaggtgaggaaaaatatctgctggtgaaagatctgcagtgggactccacatcacttgttggttttgagactctctcccaatatcacctaggacaaagttcatttcaataaattttaagcagagcacagagagtacacattgtgtttcaaaatctttgtacttaatgggcagaatgaaactgactttgttagattaatcgagggaaatacttgaagtaattcatagtgtacagcttctgaaaggggtctgagaaagttcatgaatggaaatagtttcattattccttgaaatgtacaagattgggagttatgggctagaacactattcaatatcccgtgcatagtgtctgcctcttactttacttcgatatgatttacacttttgtacattatacagtagcactgttaaattgcctttcatacattaatcttctgtgctgtagcttatgaaccaccattctgagctactgtaccatgaccttacctgccgacaagtagttttagttcatcagcatcaccatatttgtacaacagtttgtgcaatcacctgaatatttcttgaattttgtcattaatttataagtggaaaatggaaaactgtaggcaataatacagggagaactatttagctcataatgtaattgagccaaacattgaaaccattaggcatgcccaatatggctagtggttagctttagtcagatgctttgaacttaaattggccaactatttatagttgtgagtgaagttaaaggctatgtatgtatgaaatgttggaaaaaagctttagggattatattaaagagcaagatggaatttgggattttatcatttatttgttttggggaacagagcttccctttttaacatgtaagtcaaggtaagttttgtttgttcagctttttaaaaagtacatattcagaaaggtgttttctacaaaagcaagagacagaaattggatttctcatcagtcttatttatgagtccaccagagtatgtaacctaatcctttggtttgctagtcagaataggtgattattgtgataaaatctctgtgtattttggcaaacaagtaacgagaaatcaaagcaaaataaaatggcatttggcaaaggattcacctcactgggaatttcatgatcccatggtttcatttgttaaaatgatgcactgtggaactagaaaaagactaaatgaattctagtctttgccataaaccttaggagggtacatttgtaaccaaagagagaaagggatacgcataaaatttaccagatcaaagttgtttacaattgaccccacagccctctaattccctaggtcaggagggagtggtggttatctgtctgtcctgggggggtcttcttgctatctggggagcttatctaactttttttgtgggctcagcccacctctaggcaaaagattgagctggatacaaaattccagttctttctaatacctcttgtggttggttgaatgatgagtgctaagtcatgagagatgttatttaaatagaagatgggaaagaattggctcttagatttttttagtctcttcctgaaactgagagacgtagtttatcttctataaaaaaggtggataattgttagaccagaaattcaagaagatcatattaagtatctactatgagtcaggcactgtgctaagtactttgaagaattatctcgtttaatcttcacaataacttcatgatctaagtattatttttattgataaggaaagtaatgtttagagaaattaagaaacttgccttggtgtcttagttgactttcccacagaagcagaccctgagacaaatagttacttgggacttacagggggtcactagtgagtgaatgaggatatgagacagggaagtgaaggcagccaatagatggtgcattgttaagcgagttgtgcaatggcaactagtgtttaatcccataaggaaattgtagagatagtgtaaaacacctgccttagggtatttttacacaaaggctaggagagtagggatgtctcaccactagttcatgtcagttgtttttttttcttttcttttttttaaatttattttaattatttttatttttttactgtggtaaaatatacataacataaaatttaccattgtaaccattttaaagtgcacagtttggtgtactaagtatatttgcaatgttgtacagccatcaccaccatcaatctccagagctttctcatcatcccatactgaaactaggtactaattaaacaataactccacattcccccagcccctggaaaccaccattatactttctgtctctatgaatttgactattctaggtacctcatataaatgatatcagacaatatttgagcttttgtggctggtttatttcacttagcataatgttttcaaagttcatgttgtagcacgtatcagaatttcatttcctttttttttttttttttttctgagacagagtctcactctgttgcccaagtgggagtgcagtgacagagtcttggctcgctgcaacctctcaacctctgcctcccgggttcacgtgatcctcgtgcctcagcctcccaagtagctaggactacaggtgcatgccaacatgcccggctaatttttgtattttttagtaaagatggggttttgccatgttggccatgctggtcttgaactcctggcctcatataatccacccaccttggcctcctcatttcttttttaaggatgaataatattccattttatgtgtatacttcattttctttatgcattcaacatcagtggacatttcggttgttttcaccttttggctatcatgaataatgcggttgtgaacactgttgtataaatagctgtcagatttttttttaagggtggttaaccctgggacttctacaccctgcaagggaagactagcttatccaggtttaaaagatactctcaggcagagattctgatattggcagtgcctttggggcactctaaaatgttcaggtcagagggacatcgataggcacttagagcatctgcttgcaagatcttaacctaagtaagtggagaaactggaatttggactcttcagagcccatgctttaaactgctctacattgagttgccttttaattgcaagtgtaaactagtgctgagatatgaagatgaagaagacatagttcttgcctttaaggaaggtacagggttgaatcatctgttttgcaaaaggttcaagtgaagacagggtcatcagttggtgcaatctgtaagtcacacagccattataagatggaatcacgatagcaggaggtgggtgcatgtgttgcctttcttttggtgtggaggcatgcttgggtcagttacagctggattcttcctagggctgtgctccaggacaggcactcacatgtgtactgatcatacgaggtccagcccacgcccattgatgctcgctggcattcactatttggattgtttgtacaactatgtcacctcctagcaggatttatcctcctttcggcttttccagtgattgccttcatctcgatgtccaagcaccaggagcagctatttgtcagtaaagaaatcagtggtcaggaatgataaagagaatacatttggaggcaattaaaatagttggttgtatgcatctgtatctgaaaataaattatttacaaatgatttgcatctatctggagacctaacagaagatattctgtcatggaatggatgatatttcctagtttggtaatctgcagaggaagagagaaatgagagataaatcagtgagaaagcactgtcctatattttaatctaaatgttacatatttggttttagcactgtgtttgtggtagctgggtttattagtcagatattgctaggttgtgctgggctaacaaaggacctccaaatctcagtggcttctttctctcaggggttgtctgtgattctgctccatgttatctttattctgggacacaggctgaaggagcctttcttggacagcctatcttcatggtagagaagaaaaaagaatgttttacccacaagagggctctgatagctactgtttggttatggcatttgttacttctgctcacatttcattggccaaaacaagtcatacggccaagccagatgtcattggagcaggaaagattatcttcccacaggaaggagactgtagggatgggcaggctagggggatggtgaatatgttgaacacatgatgcaatttaatgcatgggctaaagttttacttgcatgtgcaaagtttttttttggcaacctttttaatcaactactttttttagacccattgcaagatgtttaacgctgttatttctattttactcatgaggaagaaagggtctaatgtaagaaaacaacacaatgagcctgtggtcaatattgatgatgatgaggattgtactgagtatttactaagcctcaggcactgtgctaagtacttctgccttctctgatttaatcattattcaccttatttttgtgaagtagccattgttacacttgaggccattgttactcagatacttactgaggctcagagaggtttgctaacttgctcaaggttaaacagataataaatgtgagattcaggtctcaaatccagtgtatgcttaatcacttaaccaaggtttctcagacttagatgatatcttttttaatgaaaataatttctcgtagaaccccagggttggcttaaattattattatgtaatgatactttaaattgtataaacataaagctggtgagttttattttaaagctcttacacctttttaaaacctaaatcaatttagaaatagagtatatgtcatatgacattactaattcaaattcataacattaatttaactgcattaactaaattgctgcttataattagaatgtgatgctgactattctggacaggttctttggcatcatctggtctaccctgctgtgcactgggtgatgattcaattttcccaccatattcatcatagtcaacttctgtgaaactttcattctttctgaggaacttgacaatccttacctttcacccagtgagaacacatcctttagatccccaagaccatcttatttcctttcacattgactcagtgattccttagggtacagcttgatattcaaagtcaatgggcatggtgctgtgctgatcaagaatatccttacattatttgttttcagatttctgaaataaaaacaagccttaaattctcatgagatttgcagattctttaatatgcataactatggatctgacttccctccttagttcttgtccaggttaaaaaactggattttccctgtctgttactacactcttttttccataggactctctccatctgagaccacactctatcactcccagaaaggccctcatctgtttctggtgttcacagcaactggcagccttgcacaacaattagagttgttaatgtgaacctgagtaaagaggctgtgacccccttttaaatggaaggctttggacctctatcatgtcagaaaccacattacagatttgttctccagaagtatttgttgaatagatccgaattatgtcctgtaatttccctttttatttatttttatgttagataagcctaccattatccattcatagacaagagatttgactcaattacttgatttacttactgcacttactgactctcatttactctaatttccattgttaagggggtttctgtataccattcagcaccctgaacttgatccttgttaaagcctccaatgtgactctttcatggttatcagtcatatttttgagagacctcagatttaggatgtaacgtttattctttctcttctttccagaatacatagatgaatgcttgtctccataatttgcccattggagccattcctcatccctcattgattgtggtcttttttttttaatagcttacaatctttgctaaaatttttcctcacgtatgtgattatgcctatattcttttctagtaaaaagctatttacacgtaatccttatgccattataaatgtagcaaaattttgtgtgattggatttttagggccaagggggcagagtttttattctatctctctatcattttctcagaaacgtctgttagttgacagatagaagattttttagtgtaagacccaataattcctgaatattctttttttaagtatactataactgaagctttgccaattgacattttacatttgcagatgaaaggaaatgcatagatgtttaaaaaacgaatctgaaaaccttatttattctttcagtgcaactacttaatttgttctatttatgagactttatggggcgatgaataatgttgttataatcagcatattttattaaacgtcacttattttaattttatttaacatctcaaattatttcttaattttactgtttattgtttgggattttgccatttttaaaatttatttatttttttagagataaggtctctctgtgtcacccaggctggagcgcaacggcgtgatcatagctccctgctgccttgaactcctggactcaagctactctcctgcctcagcctcccaagtagctaggactacaactgcacaccaccacacctgactaatttatttttgaattttttgtagagatggggtgtcgtcatgttgcccaggctggtctcaaactcctggcctgaagtgatcctcccaccttggtctcccaaaatgctgagattataggcatgagcttaccacacctggctgttttgctatatttttaacttgtggatttagctgtgtactagataatagtttattactttaacaaaatttttaggggtttcagatccttaatttaacactttgaaataaattgatggagtctgaaatttaaataatggaaatggttaatggaaagaacagttaactaatatttgggcatgcagagcccttgccttgtagtatggaagacagtcagcctcttgactcaagtaccttgccataaaacatgagccaaggcagctgaacatgtaatcatgctaaatctacacatggaaaacagtaattataaaatgagtttgggggaactaaaggagagagtactgatgtgtggataggcgtgtttgagtttcatagagctttttggagaatgatgggaaagcaattttgaaaatctctgctgtattaagctggactttccccttactgattcacatcatggcattcacagatgaaatggtttattactgggactttgaataactatggatgcataatattgtagcctgcagatcatgggggaaggcaatgtccatttttctctctagttttagagaactggggttgatgtcttcagcacttttgaacagcagattgagtttgactccaaagtgtctgacagggctaagtttagtgaactgggagaattctatggcaactttgaggctgaaagccactgtgttatattctggtagctttgggcttgtcaaggttaacttctgttgatcattagctgtgtgctaggtattgtgctaagtactttcttatatcatctcatttaatctttcccaaatctatacgaaaagtctgatatccccattttacagatgagaaaagtgaggatgagagaagtaaaatactttgttcaagattgcgtatccagaagacagaaatatgactccagccaaatctgattttgaggctcctcttttcctttttaaaacactatgtctctcctctctggctacaattacagaattgtcctataactgccatggaagtgattttagtgatatgatgaaaatgtcatgatattaaagtgccagcatcatcctttcaattatttcaaagttgttttgcatagctcccgtgttcccttactcttgggcgagagggcctactctggttctcctctgactgcaccgtccactggaggaagagtccaagggaccaatgcaggtgcccacctggagcctgtgcctggcattctagagtccgctctgggtacctacaggcctgtgacctccttgcctaaatgaccctgagttgtcttccagaatctgcctggaaattttttcctagtacatcttcttgggggtaagccaggctaccactgtgcacatcctaggcttagggttgtggaggggcacatatgtgtgacgttacagatcaggtgtcagcaaactactacctgtgggccaaatccaactaccacttttttttttttttttttgagatggagtctcgctctgttgcccaggctggagtgcagtggcacaatctcggctgactgcaagctctgcctcctgggttcacgccattctcctgcctcagcctcccgagtagctgggactacaggcgcctgccaccacgcctggctaatgttttgtattttttgtagagatggggtttcaccgtgttaatcaggatggtctcgatctcctgaccttgtgatccacctgccttggcctcccaaagtgctggaattacaggtgtgagccaccgcgcccggccaactaccacttgtttttataaataaaattttactggaacacagccatgcctatttggtttcaaattgtctacggctgcttttgggctgaaatggcagagttgagtagttatgacagagatcaagtggcccacaaaacctaaaatgtgtactgtttggccttttacagagaaagcctgtggacccctggtatagctggagcaagcctagcttgcatgctgcagagttcatgtgtatgaggcccgtggggtatggttgggccagaggtggggagaaagggtgttggcggaggtgtggggggcaggccttcctccggccacaatgttttggtggaattctgaggagtctaagtattctaagttcaaaattcagatctcaccttccccatctctgtattcaaggtaggaaggtagaatgtattttgtttaccagtttgttagctcagtttataactttaaatgtataggcacatggtatctgggcatccatttgtactcttgccatgggctctaagagtgttagcaccaatgtaaaaacctgggttgcagtgtaggggtttataataggagggaagagagaccccaacaaggaattgcacatattaatatgaaattctaaggtatggaagtgcttttgggtcatatacggattactggacatgagagaggctttggggatgctgataatgttctaagtcttggtctagacagtggtaacacaggtgtgctcactatataaaaattaaccggtgcaggctgggcatagtggctcacacctgtaatcctagcactttgggaggccgaggcgggtggatcacttgaggtcaggagttcgagaccagcctgaacaaaatgtcaaagccccatctgtactaaaaatacaaaaattccctgggcttggtggtgggcacctgtaatcgcagctactcgagaggctgaggcaggagaatcgcttgaactcaggaggcagaggttgcagtgagccgagatcacaccactgcactccagcctgggtggcagagcgagactctgtctcaaaaaaaaaaatcaattaacgtgtgcaattaaggtctaccttcatcatgtatatgttctgctttaataaagtttataaaaataaatgaaaagagaatatattaaaattaaatattaaatgtaaataatataatctctatattttataaatattgtaacagatatactaagattagtatattacaatatattgcaaataaacaacccttgctcccagtttcatttgtccaaattaaatccaaaatgctggaacccatgtgccagtttagctggaagttccgaatctctccactagaccgccttcccaaccttccccacttctcgtctccctctctttcctctcctccccgctgcttcgggcttacacagccccagagcgagcgggatatggatataaatcccacatccaaatctggaaatcaatctgtccgaccagcccatcacatgattacatcttgatgccacaaggtgtcgctgttgaggctgttctccctcggactgaaagatgctgtgcgtgccctctgtggtccccactctgtggtcctgcaagggaaggccaacccagtcccccgtggccaagctcagacacagtgtgccatgtgggggtgtagcggatgctattggtgccccacccgcatctcctcagcactcatggcctgtatgggaacatgagggctttctctttggcttcacttgggagtgccagggagcatccctcagcccatgatggagtttcttgcccttccggaggcgcacctatgaggccggttctccactgtttctcgaagctctttccagttgcttgcagcagaaaccttcttgaaaatgcactctcggccgggtgtggtggctcacgcctgtaatcccagcactttgggaggctgaggccggaggatcacttgaggtcaggagttcgagaccagcctggctaacatggtgaaactctgtccctaccccaaaatacaaaaattagccgggtgtggtgatgcgcgcctgtaatcccagctactcgggaggctgaggcaggagaatggcgtgaacctgggagttggagggtgcagtgagccgagattgtgccagtgccctccagtctgggagtcagagggagaccccgtctcaaaaaaaaaaaaaagaaagaaaaaaaaaaaaagaagaaaatgcgccctctattgacttccttgacttccttgttttagttccaaattgtcctctcagtactttctgggaataccttataaatgaacctcctacacccacatccttgtctcagcatctgccggtggggaaccccaactaggacatatagccttcctcatgagttacaaccctgtgcacagttttgtgccccactgtacaggctccatacagcatgcgaggtctccagaagcttctagccttacccacacactttgtcaataggggcttctccatggctactgggtcacatgtcctgagtcccaatcaccagcctggacttctatcttgaagtaattatttaatttctgggaactctaagtctggtggagctatgctaattccttcccatagatctcacttactctgaatcctgggcacctaagactggggtgtcagtgacttccctccgtgaatgttcccggatcattgtgcataaagacacctacaagatttcacattttccaaaccagggatctgaggagggacagcctcagttgggttatgaagggtttccttacaccttcaccagaggattcaggctacctagtctaactctactttaacctaaacaagagggccattgagatgacccttggccagtcagcttctcttataaaaagaaaaaagatagcatgtctttcacatcatgaaaaaaaaaaagcattacgctttgagagaatgtaactgagagacctgatttgaatgggatagatcttgtagagggtatgctattgaaactatcatgtaagtgatggaataggaaataataggaattagccctgcaaagagaacagcaggagtgaaggctctgagacaggaagggacttgatgcattggagcagcaggaagaagaccctgtcagagtctttgaaggagagagtggcaagaggggaggcgggggctgttggctgtactcagatcctgcagggcctcaggccatgggaagcgttttggttttgtccacagagcaataggaagctttaaaagggttttaagtgggtaaggggagatattttataatcgtaattgtatcttaaaacagtttagctgatattttggaaataagagtagaggacgataagaggagaagctttaggaggtatgaagtagcttatgcaagagtcacattggttcaagaggagtggaaacaacggagaagattcaagagcaattttggaggtagaattaataagatttggtaaagaacttgaagtgggtggtaaaagaatgaattgtaaaagaatgaattgtttaagaccttatatgtgagtagagtggtaaaaaatgtaaatacctattgggggaagcaggcaggaaaggaatcagactgaatataagataatgggagtggaggagactgtggcaaactggagggtacatgtcctctcttgaaggggcagctgctggttgctccaaccagttattgccatgtagaaaggtgagcctgacattgtcagattttcagatttttaaggaagcatcagaatctggattttaatatgaactgtctatctttctatgttggcaactattaatagaaattctaaacaacactgtgctagctatacacagcacatctgcaggtaacatctggctcctgggtggccactgcttgtttgagatctgttttccattgtgtcttcctttagaaaggtttttagaattagtagtctgtgacacagaattttggaaaagttagggatgctgattagaaaaaaaaggatattttaagttggcaaaatcttgggagatactgatgatctcagctcacacggtctgtcagcaggcctcaggtgatgggctgaggcggagatctgtggaaataaacttaacctaatttagagcagatagcaggaagtgcttttgtcttaaaatagactgttccagaccatgatagtctgagatacttgagttagacaggaatcaaggttctcccctgctttttcccttctgagcttatagttcaagagtccttaagccttttaagagagtgagtggatgactgtatatcttatttatgaattcctatgcaattagagaaagcattcttataggttcataaagccatcttttattttattttgtttgagccataagcggaacttacccttggactttgaattttattcatgagtttcttttaaagtgaagggtgttgcgcaactaatttttttggtgttataattttttttgatgtcagcaacatttatttgtttctgtacacagtttgacctaattaataatttacccttcttacagttgcacatcacaaacatataagattggcaggtattggcggggcgtggtggctcacgcctgtaatcccagcactttgggaagccaaggccagcagatcacgaggtcaggagatcgagaccatcctggctaacacggtgaaaccccgtctctactaaaactaaaaaaaaaaaaaaaaaattagccaggtgtggtggtgggcgccttggtcccagctactggggaggctgagtcaggagaatggcgtgaacccgggaggcggagcttgcagtgagccaagatcaggccactgctctccagcctgggcgacacagtgagactccatctcaaccaaaaaaaaaaaaaaaaaattgtaggtatttttaaagagttcacaaaaaagtccaatgactgaacctgtcttggcttcataataagtatttaaaactgtaagatcttaactgctaccttttttcctaaaacccatttataggtgggtggaaaagcttaaaaatagttttaagtcagtaatgggcaatggaagacatgattgcattattgattgctcaataaagttgatctttttgctctttctcagagatttattttatagaattagaaacaaatcaggatagatgagaaattaggagacaacaaccaaaaaaaaaaagcccaagtgtcaaaacaagctccttaaaatatatcgggaaatgaaacacagctgggtggggcatgggggagggtgcgagtgactcaacagaacaagtaggaattatgaggcttaggggaacatgacagccatggggacctgcctttgctttatgttgtcaactgattctttccttcttccatgacattggtatcactctatgtgctgcagccgggggtgaaatggtcccaggaaaccacccctgctctttataaattttgtgggagaaactaattcccaaatagtggtgagcctacgtcgctaactaaaatttattgttaagaagcagatgtacagtggtgaagacattacccttttaccattttgatggtctgtgaatttcctgtttgatttgataagttcagtggaattgaacataatctcttgcccattgtgatcttggtgttgtaagcaacaacgtgtttccacagcctcttactgcagcctgtcaatggctgacttgtattccttttaacaatctggcttctttgtcgaggtgtgaaaaataaatacagaattatatttatttcctggcctagtagggctgaaacttcaactagtcattattttgatcttctatcttttcctgttagaggtcaattctgattggggttgatttcatgtacctgcccttaaagcagtgcctagtcctgtaatcaccttcctctcaaatcctgttatatctgaggtgaagaaagctcttatggagaaagtccattccagggagcaaacttcccatagtcagaacctgcgtctgtctcaatcactgccttatccccctcattcaacagtgggagttaagctgatgcttaaaaagtatttattgcatgagtaaattcaagtgttcagtgaaatgttttcaggtattctgaagggaagaggattcggttgtcaaatcaattttggaaaagctatattgtatacttaattttgggacagtcccaatacatatgagtgtcctaaaagtctctgagacatcttgggttaaaacgaaaaccccagtagccttgtttatctgaacatttgtcagactgttcaggaagtactggtctaaagccgagctggagtagcacaatgttggtacttaataaatacttcttggctgggcacggtggttcacgcctgtaatcccagcactttgggaggctgaggtgggtggatcacttgagcttaggagttgaagatcaagcctgggcaacatgacaaaaccccgtttcttcaaaaattacaaaaatttgccaggcgagggggtgtgcgcttgtggtccagctgctcaggaggctgaggcacgagaatcacttgagcctgggagacagagattgcagtgaggcgagttcgctccactgcactccagcctgggtgacaatagtgatactctgccttaaaaataaataaaaaaatacttctttaggtgtatttactgaatgtatagtgctgaaatcctgagtttcgtaattcgggattttttttgtagcctcaagaggagatggtggcttttgggatatgttgagagtagagtagaagctgtgaaggaaagagagtcaagagtaaggatgtgagtataaattgtttcattttgattttttaaaaattaactaattaattaattttatagagatgagttctcactttgttgcccaggctggacttgaactcctgggctgaagctttccttctgccttagcctcgcaagcagtgggactacaggcacacgccactgtatccagctgtttcatttttattttataattcttttaaaatttatcccagggaaggctggggatggtggctcacgccggtaatcccagaactttgggaggccgaggcgtgtggatcacttgaggttaggagtttgagaccagcctagccaacatggtgaaattctgtctccactaaatataccaaaattagccacttgaacccgggaggcggaggttgcagtgagccgagattatgccactgcactccagtctgggagacagagcaacagtctgtctcaacaacaacaaaaagaatttatcctagggaagtaagagctttatcaatctgaatattgctcaaacggaacattgaaaagctttatcaatcaaaatattataaagctttatcaatcacaatattaattatgatatttccattttaaaaataattacctaagtgtttcagttcttttgctgtgtaacaaaaatctgtaaaacttggagtggggctttaaataataatttcttacttcccacctgattcagtgggttgattggtggtcttgttacatatagtgatggctgttattcatgcagctgattaaagacggtggctgggctgggctggaagctccaacatggcttgtctcactggattggtgttttggtgctgactcttggctgggtgctttggttctccttcacgtggcctctctctgtatgtggtatttcatcttccagggccgttctgtgtggctcctaattttagcaagatagcttggacttctttgcatcatggcagctgagttttaagagagcaaaaccagaaactgtcaagcctctttagggttagactcagagctggaacagtgtctcctctactgcatttgttggtctaagcaggtcacaaggccagtccagattcaaggacaaaggaaatagaatcaatttcttgatggaactaatggaactacagacaattctgtataggaaggagaggacttttgatggccatctttggaggctcatagtatctgtcaaaaatcttgtgttataaaaatactttgtggcatctatgttaagtgggaaatggagatgatgttaagataaaacatggagaaaaaggaaaatacaagacttatatatagtctttatatagtttgatttacatagtctttatattgtctggctttgtctaaaactgcacacacacacatacacacttaaaaggaattggaagtaacataatacatactggctagttttgaactgctgtcctcaagcaatcctcctgcctcagcctcctgagtagctgggattacagcaggagtcaacatgccctgccaagcccattcttttttttttttttttttgagacagagtcttgcactgttgcccaggctggagttcagtggcgtgatcttggctcactgcaagctccgcctcctgggtccatgccattctcctgcctcagcctcccgagtagctgggactacatgcgcccaccaccacgcctggctaattttttgtactttactattagtagagatggggtttcaccgtgttagccaggatggtctcgatctcctgacctcgtgatccacccgcctcggcctcccaaagtgctgggattacaggcgtgagccacctcgcccggccgcattcagttttatgtgtgtgttctacgaaacatttcaggaatagggaagactggtattatgctagcttgttaatagaggttatctatgagtgacaggattgagagtgttttcattttctgctttatgcatatttgtattttctaaattttctataataatctattagttggtttaataattaagaaaaactaataagccaattagaaagtcttgacaaatttcaaagattggaaaatatatatgttacattttatgatcccaatgctatacaatttgaactagaaagtttaccataaaatttctatccactttgacatttaaatatattattctcaataattcctgggatagaaaaatttcaaaataaaaacagcaaggtatttacaaatgccaataagagttttatacatagaattctggaatatgcagccatgtgtataatcttatatgcattcattaggaaatgtgattaaagagaaatgaacattcaatgcaaaagggcaaaaaaaaaccataaaggaagtagaaattttattaaagataaagagatatcaatgaaatggaaaataagatgcagtaaaatatattaataaaaccaaaagctatatcatttaaaaaattttaaagaaaagttatacaaagcaatgccaataagactggaaaatctacacggaatagactgtttgtgaagggacgttttaatgataattgacacaaaataggtagcaaacccaaatagacaagtaaacatagtgaaaaagtgaaaagataataaacaactaggcccattctgtgttttttgcttttttaaagagactgggtctctccctctgtcacccaggctggagtgcagtggtgcagttatagctcactgtagcctcgaactcctgggctcaagtgatcctcctgcttcactctccccaagtagctgggactgcaggcacatgacaccacactgggctaatttaaaaattttttttagagacagagtcttgctatattgcccagactggtcttgaacttctgtcctcaagcaatcctcctgcctcagcctcctcagtagctagcattacagcaggagtcaacattccctgccaagcccattcagttttatgtgtgtgttctacaaaatatttcaggaatagggaagactggtattatgctaactgttccagaacatatgaaaaatggaaagcttctcaatctatctatgatactagcatacatctgttattaaacctagaaaaggagaacccaagaaatctatgggccagtggcaacatatattactttttaaataaggaaacaatatttcaaacatgataatacatcttttcatgttgtatgttatatgtgtgtgtgtttccaaagggaacaaactaactttgtttgttggttattgggattctccaaagccttggccaggtaggcaggtaaattcactgaggattaaatctgtgtgcgtgtaaattttatgacattccgggacctcaagcctagccacagacctcagaaatgtgtatctctagatacaaagggagcagacagaggaagacaagttagatttcatcactttttctaggaagacatctctataagtggtggcccagttagaacccagacatctagattgtaagcacagaaaagatacattcatttaactgttggaaccatagaaagaaaatcatttttttaatgaaaaaagtatatatcattattatgttaccaaaacaccagaggttcagtccaggtcctgctgcttgctgcacagaaggccaatcactgagacaagtattgccagagaagaaggttttaatcaggtgctgcagctgaggagatgggagatcagtttcaaatccatctccttgaccaactaacgtaagggtttatatagcagggaagaaatgtaatcatgagtggaaaaacaggaattagggagggataaggaagaggagttggttaaaaggaagcagatagggcaaggcaattatgacagatgaagggtctgacatctcattgcccaaatgcagtaatctggcgagtttgagctccttgacactatctgggaggcctgatggttggtttccttagaaaggaactcagataagacaaatgcaactttctcaagttttaaaactgggaggtcaatttctatgttttttcaaagaaaccactgacatcagctctatgggacaattgagtcagtttcaattgtagaaaatttagagtatgcaaataaaaagaagaaaatgaaaacctcttggaattccaccactggtaacactttgatgtgtgtcattccagccttctttgctggtgaaagggtgtatgtgtatttgtgtgttttacaacagtgtgagtaaatcacaaaattgttttgtcgtctgctccccctgccaccagtatgtcatgaacatctttctgtcttattaaatattcatgtaactgcctgttccactattccattatctgtctctcttatcatttatgtcaccgaattcttatgttagaactattgatcccctcttttttacactacagattattcatgtaaaaatcttagatacaaaatggtttttgtgtatttccaagaaaaacaaaattaagccctgagcaacataaacatttgaaatgaagttctttagttagaaacaggtgtataattttttaagacctcttgagggaaaggggaaacctttatagaaaacattttttcatactgtatgtgtcactatctgtgacagaaatctcatctagaattgaatgtagcaaaaaggaaatttatagacaaatgcatcagttacccattgatcctgtaatgtggcaaaacagtccaccacaaaacatcagtgacatactaagaagcatttatcaagtgcataagtgtggtgtttagctgatctcagctgggctcgctcatgccccgctgggcagtggctggttggctaggcagttctgctgactttggctgggcttgctcacacatcttggggcggcttgcctgttggctaggacaacttggttctattttatatttctcatcttgcatcaggctagattgggaatattctaattactatggtagaggaaaatgagcaagagagtaaacacatgtgttgcttaaggcgtctgcttacttcacatttgttatcaccttactggacaaataaagtcacatgactgaacctagcatcacattgggaaaacactgccaagacatatataaaaaaaggagtaaaggattgagacctttaatgcaatcagtcacctggcatatgtaactaaaatggccagggaacagatgtatagatgatagatgatggtaacttctatgattcctggatctggagtatgaagtgatgtcacctggtttggtttcacactctttgaagtttagctgtggttccctttgtattgtctccaccctcagggaggccctttccacattgaagtactcacagctctatcttgaaagtaaggaattccagctgaagaagagcttatctttcccagctgttccaactagagtcctagtatggagtcttgttggaccaatgtgggtcacatgcccatcactaaactagctaccatgtctggaggatacaatatggtggttggccaggcgtgggtcatgttctcaccccttgcaccatccaggatggtggagtgaagggagtcaaccttatctaaacccagtgaactgtgagtagggggttgggaacaatttctctaaggaaaatagtgacagtataatcagaaagtgtgtatttgggagagggggaagggatgaatgataggcaggtgaaaataaaagatacccatgtatactgctattaatgtacttatctcattgagacacttaccttcaaaatctatttattgactatttggtactaggcacaaaactaggtgttttataaacctcatcttactatttcttacaatactatgagttagatggtactacctgcattttgttgattgcagagtggaagctcataacaagttaaataatttgtctaaggttactcagctggttagtattagcatggacatttgaacctgtttgcctttctcaaatctgttcttttattgttgtaaagctgaaggaaaagaaaatacagtaaagactttctaagaggaagaacaggaggccataatgtgccccattaaggccatatgggtgctaaaattgaagggatactcacaatgctgtagccccagctacataaaatcttcactagtatacttcagtaaccgtgatgggaacttcttctcctttgccatttctgtacagacatgaagtggttaatatgaatattaaggtcaaccaaaatgggaaataattctcaagaggccagcctgaaagatgtgtgtgaaagggaaaagagacaggactgttgttttctctggtaatatcattgaggatctggctatgtgtttaggcatcccattggttgagctacctctttttcttctatctccaggatagccagtaggtttgaattcatgtgttaataccagttgattggtggtaagccatctagagtgttgtgttgagaagaattctgaacctagtggaaaagaagactgtgatggattagtgatgtctgtaatgagtacaggaggggaaggtaacaacatgaatgccaaatatttgacatcccaggaatcagcagcttctcagagtcactttcaagtcacatgcatataggggttatgccccaaaggaggggcctttttatagctaaggtctccatgatgggcaattccatggggaattttctagaggttctaactctaaccttagcacaaaccaatatagagagcttcattttcttaaagaatagagcttatttttcactttgagaatttttatcttgcttaggggcagggtggggggaatttgtaaaactttcacctgtagtagtaaagttctagagttgcttttctttataaatcaacattatgggtgtggctctttctatctgtctattattaatcacctatctacataggtacatctatcattatctttatatatttaaaaatacaatgcagttagagttctaaagaaatttgtttttaattattctttttttcactttgtagatctctgagtggagttattttctggtacggactgtgaaaagaatgcggtgaaaattctggacaatcgtggaaatattagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcaggtaggtcatgactcatctcagtatttttcagccttggcttctcactgagtagttgatgctttgcagatggtaccacgacctgtgcagaagaaagtttggcatcatcaagaaggttatggcttagtatgtgtttgacttagacactatgagagagcataggaaatataccattacagcttgtaatttccttattttccgataaccttttcacatggttgcagatggggagaggggtggggtggggaggatcacttgtcattgcctaacttttgtacttggttaattttgttttctttttcagcagttgcaacagctgttcagatgtacctccttctgaatagaagaagaaaatgttaatttctgtaagaataaagactttaagagcaacatttagtgggccacatttgactggtgaattgatttttattttgaagcaccagcaccattatttcccactagaatgagtgaagttgttctctaagtagcagattgaacaatatgaaatggaattggatcaaatgggtttgttatgttagagatacacaataaatttttaacttggtgtttttgccttcatccattcagcattaattaactatctactatatgtaagtcaccttcatactcttctttgatccatccttcatgccacaggaaaaacaggttcctggtgtctacctgcagttatgctattttcctgctttaaagccctcagtgattactcattgcctccagaataaagtctaccttcttgactgagcccatagcacttctactagaaggcctgggccaacatttccagccttatcttgtgctgcctccctccacatctgtgctttctgtaccactgcctggtaattcctgcacacacccaaggttttgcactgccatgcccttgctcttgctgctcccttccactggtggccttctcagcacctgcttttcctgccacctccctttaaatctcagccagtcttcatttccaaatcccacctattctgtgaggcctgttttatatgctgctattttcttttcttttcttttttaatgcctactttatttcctaaaatgctgctatttttataagcgctttggaatcagacatacctgggtttaaattccagcttcatctcttgctctctctctctctctctctctttttttttttttttaagagacagggtcttgctgttgctcaggctggagtgtagtgacgttgatcatagctcactgcagccttgacttcccggctcaaatgatcctccacacctcagctttctgagtagctgggactacgggcacatatcaccacagcctgccgattaaaattatttttttttgtagagacaaggtcttgctattttgccaaggccggtcttgaactcctggcttcaaggagtaattccaaagttctaggattgcacacctggccccagcttcatctctaattggtgcttatagaagtgctaagagctggggcatagggaatgtgataccacgtggctcaaaaattcccagatattatttaactttctgaaggaaattgagataactctaagttgactgaacaagtgattttccaataactggctttgatgttggtctaacgaagtgctctgcctttcttggagtcacctgctgaccctcctaactgtttccctggctaccactcctttggagtttaagcgcctgtagaagcatttgtgatctataggaaaatctgccttttgttttcattctatgtgtagaaaacaatcaccttatccttttgattatctaacagagccaaagctagttttcagacgtagaaatgtgattttgtagttggaaccgaaaggtttgttcttcactctaaaatgatgctcttcggtatcatttctgcttctttctgattttgctggttcatgaagtctttatgaacctgtttgtacaatgcacatttccccccagttttatactggttttctcttcattttaattttttggaaaatggttaaagcagtttaggaatggtgcaagcagggacaaaaagtttgaaagctcttctttaaactgttagctccaaagtgacttatctcatgcttctttcattaagtttatctttgagcacagaccccaattatacatgtatatttatttataaattacaggatgcattacactgccagtgtattatgtgtcttttatgacatccacgaagaattaaatgtggatgagatagagcaaaataatacattgagatacattttagtgacatataaaaccttttccacttttattaaaaacatttcgaaccatttgtccatttcatgagggttagttcagtttagaataggtgatatccataattccacttaaccgtctcaggttgccataagccaggagtgtgtgaatgcttgagggcacttccattatcccttccttgttctggtcttactgtgatcacaggataccttggtatcataggtgaaatgtgactgtgtgacatatgactcagtgaaagctctagtattaatctgtatatttaatacaagtaaaatgcaattttctcttttagattaaaaagtgtaaaatgaggaagaagcgcagagattttgaaaagtcaatttacttgcaatatgatgtcttacaaagtaaaaaatataaagattgacaaaaaacaagctattaaaaaaactgtcttctctttttggaagtatattaggatcccttttagaagtataggagtacctgttggtcaggatagggtaagttttgctgcagtaactaacaaacttcaaatctcagtggattaacatatttgagatttatttctaatttgcttaaagtaagaagcaggtcaggtgactctgtgggacgggtcttttccatgcagtgactcaggatccaggatttctgcatcctgatgcatggcttcaaacgttgccacagcaggggaggagagtgactggagatggcacattggttctttaattccttgaactgaaagtgacataattgaagggagtgtgaggtggagtcctctcttctgtccaggaaagggaggagagacacatatatggtggattactaccagtggggtttttatgtttttccaaaaatggagctaggtgaaataaagtttggggagcaatcttctgctattgctgttgtttctattatactgctagtgctaccagtagacatttgttgagggccaactgtgtgctaggcattgtgcttagtgctttgtgtacattatcttatttagtgatttcatcagtcatctgaggtaggtgctagaacttttcttattttacagatgaagcataaatgtagagagaataagcaacttatccaagttcacacagttggtaagcagcatagctaggtcttaaggcattggtctatttcatgccaaagtctaagatcttaactttatgatcactacctccttaaaagatcactgagctgtgatttagtattataggaagatcctacttcatacatgctagatgaaaaaatgactagttttgataagatgattaagaatgtgatttattatcattattgttattattttgagacagggtttcactctgtcacctaggctggagtgcagtggtgcgatactggctcactgcagccttgacctcctgggctcaatcgctcctcccacctcagcctccctagtagctgggactacaggtgtgtgtcaccatgtctggctaatttttgtacttttttgtagagatggagtctccctatattgcccaggctggtcttgaactcctaggctcaagtgatcctcccacctcagcctcccaaagtgcagtgttatcttggtactgtcacttgtgcttttgcctcatgatgtgttttcttaaaatggaggacagtggggcaagggattatggacatctaactctttggagtggcatgattacaggcgtgagccactgtacctggccagaatttgtattcttaactaggaatttatttctttttcctagagatggtttttgtgctgtttagggttttcaccatttaccataacttaatttccttttaaaggaaaaatcatggaaactttttctatatggaagaaagaaatacaaaagggataagggacatttgattgtggtttcttatccacaataatcagagattgcatctatcaaggtaattctttcaggggtatttagatatttagaatttcactaacctaagttctaatgatctaaaacaatttgaactgttctgtgtgaagagaaattggaagcaggtccattacagggtagaggtaaggagattgaaatgctcttgtataggaagttcatagttttataaatataatgctaactaacccagccctttccttcttatatgcagcgttgtcgagggctcctgctcatcagtttcttggcagtagattttgaagtcctcatggttctgtctaagggagctgaacccaactccagatctaagggaggatgctgaactccctctctgtgttacagggagtgcaggactatttggaaccttggagctaatgagtaggtggccgtgaccaaatttcttatgtgcaaagggttgacactcagtttcttggatggatatgccaccccttcctccattcccacttctcctccacccagttccctccaaggccctacttctcagccacgcggctctacatgaatataaatacatttgctctactactaagagttgcagcactgaaatttagaatcatgtgcttgtttgtataaaccagagtgcacggatgcagtgttatcttggtgtataaaccagggtgcacagatgcagtgttatcttggtgctgtcacttgtgcttttgcttcatgatatattttcttaaattggaggagagtggggcaagggattatggacagctgattctttggaatgccatgaacccatagcccatgctctcaatgtcacacctgtagaacagttgggggagggatgaggagaaagtattgagaaaggatgttctgctgccatactacactgttacgcgaggtagccccttattatttttagtggcctgtgctgttgggataggtgttatggggggcagggctgatgagagggtggatacaactgttgggaagtaaagtgaacctattttctctaaaagaatataggtttatcttttctttatatctttattctattgtgttacggagatcaaagagaggaaacataggagtgaatacatctttttaaggtttataaaaacttctgtgttgtagtttggtacataagagttactgacttttcatattcctcggtattttgtgcaattgttaacgttgtatttctaacggatttcttccaaattaggtacacataaagcaatttttagacattttcctaggttgtgcatggctagccaaggctctgcatgaatataaatagcaccacacactcggagattgtactagatctaatatttacccatcttgcgtgtgcagaagtgggacaaggtcattgggaaacgtaacccaagaagtgtaagtaaacctgtctggggaatgttacagcttttaaacaatggttatgtgatcatttctatttttggcttaacacattaggaaagaatctactctaaatcaatattaatatgagtttttgatccagtttcaacataggatttattgattcttattttgaacatgaaatttgaaaagatcgagatggatcacatttctgtgtttcctttattattactgctttgttttatttgtataactgcaaataattcttttctcccctccctccctccctcccttccttccttcctttctgccttctttctttttttgagactgagtctcactctgctgcccaggctggagtgcagtggtgtaatctcggttcactgcaacctctacctcctgggttcagggaatcctcctgcctcagcctcccgagtagctgggactacaggtgtgtaccagcacgcgcggctgatttttgtatttttagtagagatgtgatttcaccatgttggccaggctggtcatgaactcctgacctcaggtgatccgcccgcctcagcctccaaaagtcctgggattacaggcgtgagccaccgcccccagcctgcagggccatttcaacagggtcattcaactatgttctattaaaatactaacttcattgtgagtgtccagatatgatgagttgtgccaattggaagtgagtgatagaatttcatcaggtttgtgggtggaactcagatgtactcactcctcagacttaccttcttccaggctcctttttttctaccactataagtctaagaaaccatggatccttcaaagccagtatttccaaagtgtgtgcagggagataacacttttcaaaacggattttctggtcagtccatggtaacacccaacatattggatatgcttatcctggaaattcataatgcatacgttttgtgggggttgaattgtatatcccccacaaaaagatatgttggagtctgagtgatgtgaacagcagacatttactgtctcagagttctggagggaagaaatccaagatcaaggtgtcagcaggttgcttccttctgagggctgtgagggaagggtctgttccaggcctctctccttggctagtgcttgatcatcttctccctgtgtgtcctcacataatctgccctctgtgggtggctgtgtctgcatccaaatttctccttttcataaggacaccaatcatattggattagagtctaccctaatgacttcatttatgatctctgtaaagaccctatctccagagaaggttacattctgaggtactggtatttttttgagggtagggatacacaattcgacccacaacataagcagactactacaacatatcaccacatgaaatgctctctttcagttaaaaatgtttactaggctgggtgcagtggctcaagcctgtaatcccaatactttgggaggccaaggcaggaggattgcttgagtccaggagtttgagaccagctggggctatagcaagaccctgcctctacaaaaccaaccaaccaatcaaccaactaaccaaccaaccaaccaaccaaacaaaaaatccctgaaaaacaaaaatatgtattaaagttgcttaactcaccaattttctaatcttactccactgtgaaactttctttttttttttttctgagacaggatctcactgtgtgacccaggctggagtgcagtggcatgatcacagctcactgcaacctttacctccctggggttaagtgatcctcctgcctcaaccccccagtactgggaccacaccaccacatccagctaatttttttttttttttttttttttttagagatgaggttttgccatgtttcccaagctggtcttgaactcctgggctcaagcaatccacctgcctcagcctcccaaagtgctaggattacaggggtgagccactgcgctctgccaaaacttaaactaagcacctacgtattaggcagctactgctgcaataatgctgtgtaacaagccatctcaaaacctatggcttaaaaagacaagcgtttatctctctccctcacatatctgcaggttggctacaacttagttgggttaaactggaggttgggtttaggtacgttccatgtctccaccttctcctcagaacagcagctattcagggcttcatcttctcatggtggatcacagatgccaaatgtacaactaaaccccacaaacatggttaaagccttggctttcatcattttcaccaacattctgttggctaaagcatgtgatgtaaccaagcccaaagtcagtcatgtagaggaaatttactccctgccaaggcagagggggagtggaatgaatatacatacatatgtttaacaacagtcccatctgttacaaattataaatattcctagaaataagggtataaggccacactttgggaaaggctgctctgcttcaggagcatctcgaagtgagaccttaaaggagatctgtgaaggtggatgagcactttctatgtggttccttccacgtctgggccttccaaagtgtcctgatggtgccagcgactcagatgtactcacttctcagacctgtcttatcccttaccttctctcaggctcccttctttccactagtataagtctgagaaatcctggctcagcttcaggctcctcctcctcttcctcaagtatctggccaatgaaacccaagtggaaatctgggagattctaggaaatctttttctttcctgataaaggaacaaatatcaccagcagttctccttcccaaattctttctgtcttgacggttgatgtgatgggtggagctgtgtcagccacattataaccatgaaagaaaggccaaagaaagaaagcaatagacaagtccagagacgtgtgagctgccatctctgagaaattgcaccaacagcagcaatgacctgcctctagatgtctagtcatgtgagaaaataaacccagagttgtctaagtcactgttgtttggtcattctattacttgcagctcaccaattgataaaacatcagaaaccgttaattgataactgttattcatagtaattgccagtcctgataacctccccccaccccaacaagccatggcatgtttcagggaggttcaatgaaatcttaaaggaccttacacattcaaatgaagaaacttccttactaattaatttgggcaagactccaaagtagtgacacaaatgctgctcaaagcctgcataagccaaaaaaaaaaaaaaaaaaaagaaaaagggtcggggtggagttggttagttcttgtaacaaaattgcagaaaggatcaagtgtggagtttggggttactgcatccagggccttaaactgtagcaggactttgtctctcaccattgcttcatctctggttctcaatgtctgcctctgtctatgtgtgaccctcattttttcctctgtgtggtgggcggtcttggttgccagtaccctagggtcacaattgaaaggtcaagagagccttacatcttcacttcctacttggaaagttcatggagggactctgttcctgctttggtcatatcctccctccaggacttggtgagtgtgtatgtgtgtgtgtgttttgtggggagatggttggggcagttatgtgagaagaggtttctgtgattggtgaccctattagaactgcaggtgttgagagaggagcagttctctaaaggaagtgggatgaagggcgaccagatgctccaagacaaaaacagatgtcaattgccttgacttgagctgtccttactcacctctgctctccaaatgttttaagggcttatcagtcatagtggggcctgagaacttaagaagtcaatcatatgttgcgtctgtgtgtaaggtgtttcattttaattccgagttgaagtgtgagtgcttgtgtgtgttttccccaatgttacataaacacacgtatttagaactggataatatagtttagcaccacaacataccttggaatgctgaatctcagaaggacaaaaaaatgagtccatcttctcatcttgaaacagtcttccttagctcttcagagaactgtagcttttgtctacttttccagagagctggaaaaattttggtccagacttagatgatgacctacttagatggaaactacaattttaaatgcctttcagagatgagtgaaaacttcttttggttttgaagatagatgagatggcacagagccaagagctggtttctttgtttgctagaaggtaggataatgatttgaagtgaactatacatctttgtcacagatgtcagctggttttggcctcagtaatctcttgcagtcggccctagaatcagccatgtgtaccacattagtggccttacagatttttattcccaggttttcttctgaaagacttggctaatggtagggaaataaacattcttgtgtgctggaccttgggagacctaaatgatttccatcttccatttttctctctggatcactttatttgggtgacgggattgcagcagcacataagccaccaaaaaaaaaaaatcagggtatttcaatgaatagattattttagtctcacttgcgccaagggtacttattgaaaccaagctccaagagggaaaggcaggaggagtggtcactcccaaaacattcacccccaaaatattcactgttgttcgctatcgacagcatcctcagagaattttaagagtcaagtctatgttgacagcagaaaagtaacagagtgattttacaggccaaagcagatggggtgggttctgaatgtggcctattctggccagaacacaatttcagtttctataattagttgcaggtggagctcttgtgttgttgtttcggagtccattgacatctgtgtgcaaattcccaccacccccagttggcatttggactcaataagtggtttggcctcgcaggaacatagaaaattgtaaatctatttcacagacacacagataaagctgttgtaaaggtcaggttctgaaagctgtggaaagcatttcaaaagtttgggaagtaggtttttaggtagagcgtgggagtgcagccaagagctggggcagtctaacaaccgaattctggcacgtgcaatttcttctgtttctctgtgaagccagtgcttgattgtgccttggaagcaacgtgtagccattttgtttttcagtaggaaagatctggtgagaagtaaagactgaggcagctacttttcatcttacaaacccatggctgggcgtgagctgtctcgtttgtctccatacgttgataaagttaacttggtagttctcaactgtgggcagttttttctccaggggacatttggcagtgtctgaagacatttttgactgttacaacttgggggatggtagctactggcatttagtgagtagagagcaggggtgctgctaaacatgctacagtgcacgggacagcccctgacgttgtctagctcagaatgccagtagatacaaggttgagaaactgagttaactagatgattactataacttcattttgcatatcatgctttgccttcactcagtgctttactttcactttgtgaactgatgatcaaaatgcatgtatttttgtaaaaatgatgatataaaaactaaaacatgattcatcattgtgtgggaaagaatgaattgtcaatgatgtctttttaaaaatgtattcttccaattatggattggtaatcatgaatcttcaaatatcttgaattcttttagaagtagacatttggtaaataggtgtcaatcttgtaaggaaatggacaactcataaaggaaataaacctattttataaaactataatttctttacactttcactgactttatggtggttttcgtccatgtctgacaaaaggggaggggaagtaagcatttttgagcaccttctatgtgccaagaatttgctagtttctttccatgtgtgagctcaacagccctgcaagacacatggcatctctattttatgcaagagaaacaggtcacagagaaattgagtgacttgcctgaggcctcaccaatagagctgcgatttgatctcaggtatgcttagctctaaaattgtgctctttccactgtcttgaagggaaaaacatcaaacttgcttgaaaaccaaggaatctggggctgaaatggaagctctaagatagagtggagtaagcaatgtgttgcctgacagcatcttcagcatgctgtcaaagaggtatacagaaaggacagagagcaagaacgaagaaggaagcaaggaacaggcgaggagggagggccagcaggaggtagcaaacacattcttgtcaagtaaatgagcagaggagaatgccaaaggaacactcctgtcttggaaacccatccagaaggatgggaggaagcaactccaggactggctggaaaattaaaaccacaggtggcaaaggaatgagggagattatctctcaggatgctcattaaaggcctggcagaccctttcaggtggttgtgactttgacaaattccctgaatctacaagagcagagtttcagggacagggcagctctttactttgggttattggacttcaatgaggatggtctcattaatcatttagaattcctcctgtccttgcctctatcttcaggaatttcagagtacctcgctggcctcctagtccagggggccttcaacaggcacctctcagcttcctcctcagttggtttctgacctcactggggtgatacactatgcaggctttgtcttttgttccacatcttgtgtctcaaaatcagatcttcctctcttgggtcccagccttcctgatttctgcctctgccagcaactttcccctgtgaaatatcttttttgttctttttgagaatccagaccatttatttactaagttatccactctccctcatttaagggagaatatggttgcaagtagcagaaacccattcaagtttaagaaaaaaaaagtggggaggagggatttactgggagcacataatgatacctactagacattaagggtaagtagggcagccaggtgtcacatggagcgggaatcggggtcagttggaagatgatgaggaatatcaacaaagccagtctccatctctgtctctgctctgtctctcctatacacacatacacatctctatcactcttattttctctcttaatatctatttttatatatctcttatgaaaaagcggcactcaaggaaagcatgtgtatcttcttcattcaagtgctcaccagggacagcctagagttgcgctgttgcgacttcaaattcagagaaccaataatccaattgacctagcttgggtctagtctcttctaggtccagtcagctgtggccaagggaatgagtcacacatccacgccccctcagcagagctatggaaaaggtctttctgagaaaggggcatgatgagtagattctctagcaagggagtgtgtgggtaaggtggtgaggaggaaaggacagccattgctgggaaatatgcttgtgcaacacatagttagaagcttgccttagttctagtattaggaggaccaagacgaatccagaagacttttatagtctgaatagttagcttctgttaacctctgtctataactagttaacttctgtctataactagccatttcaataacaacttcagtagcctcctggaatctctaacctccacactcacctcttcactccctacctacattgtgccccctagagaaattctggaagttatattgaccaacaccaggatcaattcatgttattttaccatagtggacccacatggcgcttttatatactatcagagtgcatccttgatggaattaaaacagtctccactttctataaaatcccttagtttctttctttctttctttctttttttttttttgagacggagtcttgctctgtcgcccaggctggagtgcggtggggcgatctcagctcactgcaaactctgcctcctgggttcatgccattctcctcctgcatcagcctcccgagtagccaggactacaggcacccaccaccacacccagataatttttttttttttttgtatttttagtagagacggggtttcaccgtgttagccaggttggtctcgatctcctgacctcgtgatctgcctgtcttggcctcccaaagtgctgggattacaggagtgagccaccacacccggcccccaaattcccttagtttcattggagactttggtctccaaagtggatgggaaaatgatactaattaggatctgtaaacttttagaagtaagtaataatttgatggttttcgttgtaagtataattgggccaggcatggtggcttatgcctgtaatcctagcactttgtgagacagaagtgggaggatcacttgagcccaggaatttgagaccagcctgggcaacatggcaagatcctgtctttactaaaaaattagccaggtatggtggtgtgtgcctgtggtcccagctacttgtgaggctgaggtgggaggatcacttgaacctaggaggtcatgcctgcagtgagctgtgttcattctactgcactccagcctgagtgacagagtaatactctgtctccaaaaaaaaaaaaaaaaaaaaaaaagtataaccacttaagttctaaaaacgattggctcgtgagtacatattatctgagaaggaatggaaagaaattaaaactcaccgattcatcccttggaaaatctttctaaaatatccatgtgaaataatataaaagtttccaaggaatcctaagaccaatagaaatcaataagcctatgagatggagagttggacagtgcacatgatggccagatttagaacttgcttaaatttagaaatgtaccaaataataaataaaattgccttctcaaaaattttaaatttctcttcggggtttttacctttgggaagccatgtacactttgagagctgatgaaaatgtcataattttccctagaaaggtgtgcataatctggattgtgcacaaatttcacttcctcatccctactgcaaactcgaagggcatctcaggatatttagatcaagatcctctgtctagatattaccacttcataaaatattgcacatgtgttgggagtaaatagttcccagtgattagtgaaatgaatgagcttttggtaatatgagacatgtcttcatttcactgctattcagtttgtgctgagaaatagggggcatgtgccaggattttggtgataaagggtatgtacattggtaagatggaaacttgctgatggactgtactgcattcactaagtgtattcagatacaatatactggaggtggtggattttagtctaccttcaggaataagttaccttgaaagagtttgcatagcattaggtgtcacatagtaaaagcacatctttaaatattttcattaaggactttccattcattatgcttgtctctgggtacgaaaattccaagtttacctctggcaattctatatcacttatttgtaattgtaactcaaatctcatactacaaatgcagttatgctgtaggcatttgtgataagagcaaggaacgaatgattttgttgaattatcaagtgagggttaattacgtacctatcatgttcccagttatatgccaagggctgaagaagacactaaagaagtgtaaagtgcactttctgtcccattaccatcttgtgaaaatccttagaggttcatttcctttttctatgtagactgtgaataaggaatgaagcagtgatatatcttgttggttatgggtagttgactctaccttggaacttgacctgagcatgaagtttggtctagggaagaaagcttcttgcctagtttatttacctttctggaagagccattgatgtgacctctctctgtcttctgtagaagcctagccagagtctaagagtgggcacagtatcctcctaacatccagccagtgtagggcttctggaagtgtttgggatgggggagttggggaaggcctgagcccctgcctttctcaggccagcatgtaaagtctgtgaatcacttcactttcccatttagtgtacccacctaactacaatatgttcccctggtaagtaagaataataaacaatcagtgtggtttgtaaagtacttccctaaatgaaataaagccaaaggccacatatatggtatctcatttaatccacataatgaccctatgaagtaggtactgttattattatatgtatttatttttatgtgagcaaagcaagcctcagaggagaggtcacttgtcaaaaagttacatttagcaagtggcaaagctagggttgaacccaggcagactaactccaaagtcagtctccagtgtcaggattgactgtagtatggagtgagtagctctgtgtacacaagaggatcttaggacaggtgaggactctgaattaaacaactttgaagcccatgtaaaaggaagtcatcccctttccgaatcctttttttttttttttttttgagacaggatctcgctccatcacccaggctggggtgcagtggcaatcatagcttactgcatccttgatctccagggctcaagcaatcctccttcctcatcctcctgagtagccaggactacaggcatgtaccaacatgctcacctaatatttttattaaacaatttttttttgtagagacagggtctcgctatgttggccaggctggtcttgaactcctggcctcaaatgatcctcctgccttggccttccaaaggactgggattacagacatgagccactgccccggcccctttccaaatcttatttcagtacttctgatgaacctaaatgggatagtctcaacttggtgctaatcttgaaccctacttaacacttatcagatgtttcctaccctcattgtaggacatgtagtgacattactacatgatgcttacattgtaatcctagtagccctagtttttgcctttgcatctgatatgctgcctgttcaaagagtttctgtgagcagaactggcaacatggtgttagtggagcctgcctctgggttcctgctttgttttctatgatggtggtcgagagcaccagctttggagatggattacctaggttcctttctagctgtgagaatttggttaactttatctctctgcacttgtttccttacctgtaaaatagatgtggtaatagtttaagttatcctattgttctttaccctttatagagtcagtggaattagaataccctactcttgaaaccaagttcagatgagctgcttaggaatggctaggagagttttcttgacataggtattgactcccataactggatccaagccagtttgtgttaattttcagatggctgccctggacaattctgagccacagctaggcttttcttgtgcaaaaaataaaaaaaaaggaaagactcacattacatttttctggtatgctacattgaaatatgtcccacggcatgagatggaaacgataaattcactatcattgtagggagtaatagaaaaaaagatgagggtgatttcccagtaaacactattatctgaatcctcagaaaaggcagacgcttatgttgcccaaagaaagatcacatggtttccagatctagcaagctatatatattaatccaaccagctagaaacataggactcagaggagatgtttgattgattggtttttataaactttggcctattttgctcatctcagtctacagaatccatctgctgcataatatctggccagctaagactcttataatgacacttcaatagtttgtaccaaagaaatgatccccccagtcaagttctctaacttagatctctgcaccggcctttagatatgtctacctactttctactggcaaggtcactggtgccaccccagaaggtcaaacaatatgatgactgaatgactgaaatggattaagtcaataaacatggaaccatgtgctgagctaggtgcagaggttagagtaatagaaaaaaacttcctgcctgtatggagctttcattcttgtgggtgtactaaaaggagtcttgagccactggggaagaccaagggtaaaacagtttcagtttagagagagagatcaggagttttttttttttttttttttttaatcatgttttgttgttggcaaagcgtcatttatccaagtggtgttgttgagtagggaggtgggtttggtggaatttgcgttcttgtggtctctgccagaacatcatcatggcatggttagggtggatttggggctgcagtggcttggaagtgttaatgttgctttttatactcttctcacaaggaggttagctttgaagggtggtaactgaacaagatgcatagtttggggaatctctccctgccttctttgtgtgacatagttgaccatatttttaacttgtagggaatgggccagtatgaagaggggtttttcatggaaccaagcctggaagagtagggagacagatcagctttgggcaggaggtgagatttctattcttcaaacctcaggaggaggtggtcagagaaggtccagataaagagacattagtaggtgtggagtagaagtaaattttaacctaaaaagactgcttggtacatcaaaaagagaaagcccctactaggaattaagttagacttggctttgatgccaaattagatgtgatgttggccaaatcacgtcttttccctggacctcagtttcccctgctgcatcatcatactgaatacaattgtttccaaggctcaacttggttaaaacgtgtcatggctccaagccactcaaaaattttcaggaaaattaagagtgctttggtgacaaaagaaagtcaatgctgttatgactcatgagtgcgatttgatgagggcatggggccagggtgaggcagatgtagttgaagcaggcaaaagtatttgtgttggctgtcctatttgttgtgctggtggttctattcaagcgctgctgatggggtgatttgcttgcaatgggatgacacagcaagcccattaccatgcttggtggagacaggagctaccagcatttccccaggagaaaattttacaagtaaaggctaattttacttttgctgttgatggcatttctcagctatactaattaccatccctatagaaatgctacagaaatataccctatcctcccaagagtgcagaggggaaaagaggttgttcttaaataatccaagaaaaggttttacctgtggattccaaagctacagtgcttccttactcatggctttcttaaatggcagatgccctggcttaaatacaatttctatatttcccttactttcagcattcggactgtgtgatctattccctattcagagtcaattacaaataaaattattttaggaagaaaaatgatagttatagagttaatgttttgtctcagtttttaaaaaatattttgtaaatttggaaattatattttactttctcccttcattccttaataaatattagggtgtgtacccatctgtctatctatccatccatccatccactcattaaaataacattcctgaatatagcagttttttagtatacagttgttgaatgaaaggtacaaatatatacagagctaaggcctcttgagctcatgaggccaggatgcctaggtccaattctggctctgctacaagttggctgtgtgacctggggaattagttgttaagattgaaaactggaggacttcatgtaaaaacctgcatttcttcatttccctgaataccagaaagatgtggtagccctgagcccagtgagctggagctaagcattgctgcttaccttacgtaggacattgtctctccgtgttcctctggtccaccccttggttgacagatgtacatttttagtttaaaggtgaaatgaagaacatttttaaattcgaaatgttggtaaaatatggatgttgtttggtctcacagagtcctgagtgaaaactctgtacctggggggagagacagagagggagagagagagagtggaagggacatctttttcttttccttttcttttcttttttttttttttgagacagagtctcgctctgtcgccctgggtggagcgtagtggcatgatctcagctcactgcaacctccgccacccaggttcaagcaattcttctgcctcagcctcccaagtacctgggactacaggcacgtgccactacacccggctaatttttttgtatttttagtagagtctaaataattcaccatgttagccaggatggtctcgatctcctgacctcgtgatccacctacctcggcctcccaaagtgcggggattacaggtgtgagccaccgtgcccaaccagaagggacatcttaataattctcttgacttcaaggaatttaagagctacccccacagaaccagaaaatgggaaagggccttgttttggatatctagggaaggagaaaagagtaaggtgtagcaggcattggttaattctcaaaagtcagagagttgacatgattatggataatgatgaaagtctggtgcctggcctcgagtggaacaaaaggaaaggcagaaaagttcccagtagattaaggtgccaccactactttatgctaagaaggcagatgcagaggcccttccagggaacatgctttgcgggggaggagctgcctttgtttgcttttctgatgacttggatttctacagctgcccatggttcttgaacttccttgaaaaagtacaggcagaattgtgatgaaatcagcatcccaaccctgcctttcctaaggacactgttaattccagtagtatttatcttcattccagcaactaccttggatttttatattggggtagaagtgatcagacaagggctgtggtttctatgggtgcacatgtgtgcataggcccagtgctattattaaagcggagtaacaacaacaacagattggtggttatttggtttgggggagaaatttcccgaggtgtttcatgttcttgttattcttcaaacctgcaatatcattcagaagagtgttaggaaattcaataagtcagaaggcactgtgcaatgagcattattctttgaaaaaatatagcttatcatacacattttccatcagaaggtaatataaatttgttaggagtttgggtggggttttggtgtctgaatgccactgttctttttcctctccccagtgtctgaccaaggggactatgcacttagagaccagtagtcaaatggaagacggaggatgagtttattaattctgaggatgggctcagtgtccttccatgcagggattttttgattaggtaaggaagcttgctactccctccattcccaggacccaagatggccatacctgctgtgcgctgaccccaagcagccaccatgctcagggggagatcaggttagcaagagaggaggctgtagtgtgcttaccacatggatgcccagaagtgaaagaataaaggtgacttggcaaggccctgtcctgagaggctggaaaactgggtggatggcagtgctgcctggggaagcagtgtttccaggagtggtcaccatgccagagcatgaaagtgggaggcttggggctggcttgccttgttcgggtccgcagcttggagtgaggggcacagctgtgggccttttgcactacagtgaccctgtccaccagcacagcatgtcctagtcaatgtcctggtctctggctagtcatattaggcactcctttttccatcagggccagtaaggactggctaagaggtgtaagttgagggtgatagatattacctcttgatgtccaacccccacataagaaattagttaatagcatttgtcacaaatgtgcacccgtaaagataaatcctgttaatatgtctatccatttttttctaggcactgccatattcctgactttatagtttaacctttatctataattaagtagatattagaataaaataatagtaatagctaacatttattgagagcttactgcataccaggcacatgtattgacttacttgctccttataatgacactgtgatgtaggtgtcatttttgttcctgttttacagatgagaaatttgaggtatacagctcacaaatcgtgccaaacatggaagccaacccaggtggttggactctaaagtgcccgtctgtgaacactgcatgattatgtctctcaaagtggtagatatgagatactgaagaaggggctagtccagatgtccgaagacccagtatgtagcctagagcctggcttggctctgccacaaaccccttgtgtgcttgacagcgtgccaatgaagtcctcactctgagcctcagtttcctgatctgtagagtggggatgtggatttctgctgaaggattttgatccatgactcattatattagtttcatagcattgccataacaaactaccactaacttggtggcttgaaacaatagaaatttcttctctcacagtttgtggaggccagaagtctgaaatcaaggtgttggcatggttggttccttctgaaggctctgagggagaatacattccatacctctctccttttggtggctgccagcagcccttggcttgttgacgcagcattgtagtctctgcctctgtcttcacatcaccttctcctttgtgtgtatcagtgtgtcaaatctccctctacctttctcctataaggacacccatcactggacttagggcttgtcctaaatccagggtgatctcatcctgagatctttaacttcgattatatctgcaatgactctttttaaaaataaggtcacattcaaaggttcagggagttaggccttggacatatgctttttggggccagtattcaatcaaccacactcaccctccagctttttttctgttgcagtatgacaaccagggatcttggagaagaaaggattaagctagttagtggctgaagccccctgggcagtttggtgcagtggttaagaatatagtatctggagttcatagctctggtttcaagtcctggctctgctactcaccagccctgtgactttggaaaagtcaccaaacccttctgggcctcagttttctaccctataaaatggtgctaaaaagagtagtgtcataaggtgattaaatgaatcactgtatatagagtgctgagaacaatgctatgtaagtgttagctgctattgttgttgttacttccatttagaagtgaagtttatgcatatgactttaacagaggaatgaattttgtgagggatgcatttaaactatagcaaggaacagcctgcaagtatgctattttccaccatattttaaattagggtatctaaatgtgtctgaaatgtgaggattatactttccggcgtgctgaaacaatttttggcccagtctttttagacatccaagagaagctgaaagcagagtggggctgtgctcacgttgggtgaggcaggcaagcagatggaaggtggcagagggagcattttgatgtgctcatggaggaggcgttaatatttcgacatctttcttgttatttacagataatttttatgagagattttcagagatctcagttttttttctctttcctctgagtggcacagaattgtcacaaatcaatctgttaataagaaggtaaaaactcaacagtcttctgcttgggaattgattgtagtttgagttttgtaactaaattgaggttaagctttctggattctgttttttttttttttttctgagataattcatcaccttgcaaaattcacccaatagtcttgattcaacaggaatgattattggtctaagtcttgtgttactaatagatcagctagttgattcatataaatatcatattcctactgtatcctgggcaaggagggacaagtgaaaaggagaggatgtaaatactttgaaattgggaacatagtggaagacagactttcagataatctatcacaacatagtatgatatctgctgtaatcaagatacttggagtagttaagagcaaggcctctagaggcagacatacctgtgtttaaaacttgcctctactgcagtgagccatgatggcatcactgcactccagcctgggtgacagagggagaccctatctcaaaaccaaacaaacaccaaaaccaaagcagacagacaaacaaaaaactgcctctaaaaacaacccccccagaaaactcaaaattcttgacatcactaaccagctatttggtcttttcgagtttctgtttccacatctgtaaactggcgttattttactgtttctcccatggtgaggtttaaatgacatactataagcagagtgcttagcacgtcatttggcacatagtaagtgctcagtaaatgttagttattattacaggaatatcgtgctgtgggaagagctctctatagagtaattttgttaatttattcatatggcttgatatttatgtatcatattgtgtggtacatttaatgaatacatgctttattgcttgtgtttaaatctttcaccaaagttcacttactaaatttatgttttatatcacagggacataaattaagatcagtttgctctctatatatatcccaaaatttgacattttggatacagctttgcatataatttttaagaaagccatcgctttttaattactggcactaatacttagacactgaaaaagataactctgtttcaggttataaggaaaaaagcctcacccaggccaactggggtaatgaggcttcattttaagaaaataggaacagcacagacttttgcagtctcaggtctgcccacaacagcttatgactatgggtaagccaacttcttagagatgcttcttcagctgtaaaaatggggatagtgattcttgcctcagcactttctagtgaagactacatgagatagcgtggaaagcccacagcacagagcacagagtacgtgttcaacagatgccattattacacaaatggtattaagagggctggaatcttctagaaatctgataataggaaccaaggtatagctgggggtcagggagttgaagatacacggggtcactaggggctgtagtggtaagagttttagatctttattcaagagtcagttattaaaatatcctagctatgattttttctctccctgtctacttttctccctatctccaactgccttattcttatatttctggtaaaattcctgagagaatctgatcagttcatttaaatatcaccagccctttgtgagcagaggttttttttttttttttttctgtctagctttagtttggtataattggtatgcaaacaaacaatgcaatggtttttttcccagttaaagcataaattttaattttagcattttaaagtcattgtttccccacacagtcatgattttcctaaaattgaaatagtctaatacaggaacgctaaccttgggactctatatattcccaggaggatgactgacttggctggcaattagtttgattatatttttttaaatataaaacaaacaaacaaaaacaaaaccctgcacataattaatgcatacaatttggtgagcctggacacatgcatacacgcatacactctgagcagagtgttgatacaatgcgaagccctaggttgccgggaggatgggctactttgaggtcacgtgccgcctctggcccagtgagcgagcaggcatggtgcctcacgggagccgcaggcctccaggaacacaggagcgtgtgtgagatgactggtaggtgttttggtcactggattgatgacaacatgggtagaagagatcctggatatggagatgtgatttgatccttgcccgtcacacctgctttgtcttgaccactcccaactcctggccacgccagcctcgtgcgttcctcaggcgcgcgtgcagagctgtgccttagggcctttgcaactgccctgcctgcgttgctgctgctcctgggggacagcgggcttactgccctctcaggctttagccagatggcacccactcggggagcccttctctcctgacgctgtctgaaggagcctgccagcccttaccttaccacctcgtttagttctttcgccacacttattgcaatgtctttgcttattcgtctgttgtctgtctaataatagataagtaaatatctattactcatatatttctagaatgtccctcttataccagggactgttcagtacatttattttgaatggatgagtgatggctctccaggcattgtgaccattacgaagcgtaattgtgtgtgtcagggaagggggatgtgagcgtatatggggtgtgtgtgtgtgtgtttgggggagggagtccccagggaatctctgtagtcccacattatgcctatctcccttacttaacccagattgcttgggttcaaatcctgcttcctccactggcaaccttcagctctgtgtccttgggcaagcaactgtctgtgcttcagtttctcatccataaaatagggataacaattgtgcctacctcaggattatgtgaggattactttgtaaagtgctgagagaagagcccagcacggaggaaggcaactccacacgtttgtctttactattatgaagtgctgggaagctgctggggttacagtgctgagttgagggctatcctctgactgaaggtatcccgagtctcacaagggctggtggggtgaggtggacattatttcttcactgacacaaaaatacatcattataaaatgtgtgacgctttgaaggatgttcaaggtgctataagccatatacatgcagggacctcctttggctttgtgctagggacactggttgagaaggcttccctgtggaggtgacatttgagctgcagcatgaagacagagtaggacttagcaaggccaagggagtagctggtggtgggggaatagtgtgtgcatctgaagtgacgggcagtatgatgggagtacagggaaacaggtttagggtgtatctacctgctgtcgtgttccaggggggtccctgggcccatcatcagagattctgattcaattgctaggacctgttctgggcatcaggatttttacaagctccccatgtgactctaatgtgcagtcagggtggaaattactgctcttggcttgttagaaatgcagactctcacccctccacctagacttagtgaatcagacctgcattttcacaacatccccaggtgatgtgtgtgtgtacaataagtgtgagaagttctggtttgtggatagactcacccaaagttggtcaaaagaataggtttctgattcttgtcccagaaatgctgatgcagaaggtccagtgtggggtctagaaatcagcattcataagaaataccctctgtggttctgaagtggttgattgagaccagacttaagagcatgttctcaagaatgtcagaatggaaattagagaggacgtgagaaggaagtggacttggacttaaacctcagaatgcttctgacctgatgaagtctggggcctccctcctgtgaatccatctgcagaattctaatactttttgatcttctaagctttaaataaaacttggaaaaaggacagtgttcacaataggaatactaatagtctattaaatttgggggtgggtgaaagttgttgggagtagcgagattagcggtttgggttcctctggaatagtctttaccagctcttgagacgagttgttttatgtggctcagaataataaaaagacacttatcctgtctgtcttaattttccagatggcctccaggaaaatttccaagcagaaattacatttattaagttcaagaatccactgggaagatgatatagaaaagcctgattctcattgactttgaacttagtgtttttctgaattattgtctgtctggatttttaaaactttttttagtttgttctttccatgcctcctctgcaactttctgacttctaattaatctaacttttctcttggtctgtataacaaaattaagagtttttgcatttattgagattgagtttgatttttttccctctctctttcctataaacacaataatactgttcaagttagagaaagttttgaatgtctcttatgtgcatcatgctctcctaggcactgtagggtgtgagcaggactggctacattatttgcaagactcagtgtaaaatgaaaatacagggcccttgttcaaaaattattaggaattacaagatggtgatagcagagccttattaaagcaaacacagagctcttctaagtctgggccctgtgtgctccacaggccatgcccatgaagccagcctaatgagtgtgaggagtcaccacaattacaacaagggggtgaaatttattctacctcgacccctttgtgtacatccctggggactgtagcccctccctactctggtctgactcctcacaccactggagaaggaggtatagtgttcagaatcccaccttctttcggtgagatggacacagccacgtaggataaacaaacccacatactgatgttggaggtataaatgggtacttactacccggaatgaaattggcaaatgtatatcaaaagtcttaaaaatgttcatatcgtggctgggcatagtggcttacgcctgtaatcccagtactttgggaagctgatgtgggcagatcacttgaggccaggagttcacgacaagcctggccgacatggcacaaccacgtctctactgaaaatacaaaaattagctgagcatggtggcacgcgcttgtagtctcagccactagggtggctgagacacgagactcgcttgaacctgggaggtggaggttgcagtgagccgagattgtgccactgtactccagcctgggtgacagagtgagactctatctcaaaaaaaaaaaaaaaaaaaaaaagaaaaaaaagttcatatcctttgacccagttcctcttctagcaattacatgttcacagagtaaaaggatgttcatcacaattgttctatgttaaatattgataaaagatgggaactaacctaaatatccaatagtggaggagatctgtattatcatattatgagatagcatccagacatttaaatttaaaacacatttaatctatttcttcatctatctatctatctgtctatctatctatctgtctatgtatctatctatctccatccatctatccatctatctatgctatgtatctatgtgtcttatggtatatattatgaatgaacattcattgattcttttcctttcctttcagtcaaccctaataatagacaggcttagatactgtgtgaacattgactttgatcagggctactgcccagtctgggtccatcccttctttttttttttccttttttgagatggattcttgctctgtcactcaggctggaatgcagtggcacaattttggctcaccgcaacctctgcctcccaggctcaagcctcccgagtagctgggattataggcacccaccgccatgcccggctaatttttgtatttttagtagagataaggttgcactatgttgaccaggctggtctcaaactcctgacctcaagtgatctgcctgtctcagcctcccaaggtgctgggattacaggcatgagccaacgtgcctggcctccatccattcttttttcttttcatcatcaaatgtatccaacctttgtgctttggccctttctgcctagtttctccccacacatcctttactttggccaaagtcaacctatttgtatttgcatctcccttgcttgtacgttcgcttggtctgccaggactattctcccaaaccttcccacccacatgttgaagtcctatccatccatcaaaccagtacaaatgctacttcctctgagaagttttttccccttctaattatcccagccagaaattgggtgcttcttcatctgaattttttacagcatgttgattgtatcacttatatagcacgtgctgtatattgttgttataattatttgtgtgaaaacttcttttttccactggattattagacccttaaaaaggagatcttgtcttgcatatctttttttttttaaattaaaaaaaatttttatgggtacatagtaggtgtatatgtttatgggatacatggcatgttttgctacaggcatgcaatgcataataatcacgtgtaaaatggggtattcattccctcaagtatttatcctttgtgttacaatctaattatactcttagctattttaaaatgtacaattattattgactataatcaccctgttgtgttatcatatactgggtcttattcatttttttctattttttgtacccactaatgccctgcatatcttcgatttacccaagttgccttttttgtaggagtcattcgacatatattttcctagtgcatttgtacatttatccacactgaataattaatatgcatgatgagggcaatacgaatagggaatttctagggatgagacagaaaagataaagcaaaatgagaaaaggataagaatgactgcaaaaatttaatatcattagaattaatttagaagaataaaaataatattaattgatttacaaaacaagagagaatcttacagatgttgtcataggtctaatacttttcttcactgtttacgtgattcagtcatttacatggaatatatttgagaacattgtaaaacttaaagacccccagtcattgggtgcaaaagtctgtggtacttgtgaccatgaagttccatgaagaaggcccaaggaacctgctgatcacaagtttattatgcacctctggtgcgatgtggccgatgggaaattatcaaatgtagacaaaactaatgcacactgaggctgtattgaaagcagcatggtatccagcttaaagaaagtgatggtctcactttcagacctttcctgaagcacagccttcccttctgtccttttatagactggaagatgatagagaacagtgaagaattgggttgatggggatttggaatccagatcatatgatgacaggctgaggatgtttagtctggagaaatatggacttctagaatgagtgaacatttgataagtgacctcagatgtttgggtctttcggtactgtgcttctcaaactttaggatgcacactaattacctggggatctcgttaaaataaagattcggatttaataggtctgttgaggcctgggattctttatttctaagaagtttttagatgatgccgatactgccggtccgtggaccacactgtgagtggcaaggctccagaggagctctgtccaatggaacactgcagggatgggaatattctatatctgcattgtcccatgtggtaaccacctgccgcttctggctattgagcactggaaaggtgtctagtgtgactgataaaccaagtttttgattttatttaatttcatttaaatttaaatagttacatgtggctagtgtctactgtattggacaatgcaattctagaggatacaactgaaactattggaacttaaaagagtttagacttcactttcattgtatgagttttgaaacagttatagctgtttggtactgagaaggcatctagaaaattagaatagtatttaagtcaatgaccatctataaggaatacagaagaagggcacttctactgagtggggaggtggatccaagaggaggtagcatgtaattggaacggagggttaatctacttaacacagtggttcttagctagggacagttttgcttccccaaggacaagtggcaatgtctggagacatttttggttaccacagttgggaggagcgccactggcatttaacgggtcgaggccagggatgctgctaaatatcccacagtgctgagaagagtcccttgcaacaaagaattatccagcccaaaatgtcaatagtgctgaggtagaggaaccctgccttaacttatacagagcttttataaatcaataataaaagattaaaaatagagtagaaaaattagtgaaaacaagcatagacaattcccagaaaaaaaatacaaccaaccaaacaaaatttagggaatgatgctcaaccttactgctaataaaatatgtgtaggttaaaacaatgagattatatttagctatcatattgccgaagtttcagctatcatatgcaaagcttaatacacagtggtgggaggagaagtgagatggaccctaatcactgttagtggggttgtaagttgcactagccctcctagggggcaggttgctgttataatcaatacttaagtgcacacaccctttgagataggaggcgggacttgactttggagatggggatttgaactcaggaccagatagaagactagctgaaacagggaagagatgaaagcatctctccataagacatgcccatctgtgccatgtcagttttccattaccatggcaacaaagggaggttaccactcctttccatggcaatgacctgaagacctagaagttactacccattttctagaaatttctgcataatctgccccttaatttgcatgtaattaaaagtgcattataaatatagctgcagaactgcccctgagctgccactctgggcacactgcctgatatggtttggctctgtccccacccaaatctcaccttgaattttaataatccctacgtatcaagggctggtccaggtgaagataattgaatcatgggggtggttcccctatactgttcttgtggtagtgaattagtgaataagtcttatgagatctgatggttttataaatgggagttcccctgcacaagctctcttgcttgctgccatgtaagacatgtcttgcttcccctttgccttctgccatgattgtgaggcttcccagccatgtggaactgtgggtcaattaaacctctttcctttataaattacccagtctcgggtatgtatgtattagcagtgtgagaacagaaaaatacactgcctatggggtggccctgcttctgctgctgctgtacactgctgcttcaataaaagttgcagtctaacaccactaggttgcccttgaaatctttcctgggtgaaggcaagaaccctcctgggctaagctccagttttgcatcacctttgcccagcagctattctacttctaagaatttattctggagaataaattctgcagaataaatggtacagattcatgtagatatatatacctgcaaatttatgataacatcattgaaatttggaatgaaactatgcaacttcaaagattggcacatttctgctgtggaatattctgcagctatctgcatgataaagtaggctttgatgtatggaaggatgttgatgatagaaataaatattgattgggttacagagcataatttacatacaaaaagatttatacatgaccatatgtttacatgtggggagatggattaatattgggactagtttttagggaatttgggtttaagtcaaccactcttttactctttcttgaaaaatctgttaattcagaatctcagttgattaatttgtaaagtaagagtaactaactcctgtgtagtctacttacttcacaagatgcctagaccaaacaatgtttattggtaaaaaggcagtatgcattttatacctccaggtagtggtagcactggcctaattgaaaattattcgagcttttgtgatacataggttcaagtagagctagaaaagttcacagactgtttccctaggcattgtttagattgtacagtcttgggactttcctgcttttcccttttcatgcaattgctagtgggaaaaaacaaaccagagagggtgttacaagaataaagtagctttttttgcaagatcgtggttaataaagctgatacaaattgtttcacagtatgggtgttggggtttctctcattggcatccctttttaaaaagaagtttggaacatagatttcttagcatacgtcagactaaatttttcttctcttttgatatttgattgatgttccacttacgtatcagactaaaatctgggccacagagtaatgaacatagtaaaaacaggtattagcaaagtcattcattagagttttgtttacagtttattggtggaaaatagtaattggtttttagaaaaaaggtcttgatattgcagatttgtaggaaaattaaatgtgcttgaagtaaccttagcatgtaatacttttcctccttttaattcattacagtcaagtcagacccttccttctgaaaaatattcagcacacagggttttggattaatgcattgttcacagtaggatatgaaatagtgaaattgcttaaattattttcttctgatatagtattactatatttcagatatttataactatactgctcagattttagtttaattttttggcatgtactagaaaaattttatggaaaattttggacatggagaaatataaacagaatagtgtttctatttctgtgaccccctcagcccccataaccatcacctttccttaatccatcaacctgtggtcacttctacaccatccaaaccccaactaccagctcctcatctaatattttgaagcagatttcagatatcctatcagttcctccataaatgttttagtctctatctataaaagataaggacctttaaaaaagttctaaatataatactgttatcacatgccctggaaaattagcaatatttctttaataccaccaaatattcaggcagtgttcaatttccagttgtctcataagtgctatagttttttttttttgaaatttgcttaaatcagaattcaaataaggaccacacattgtgttggttaatattttaaaaggctcacttacttttttccatttgttatttagttattgaagagaccagattgtttgtcctatagtttccctccagcctggattttgttgattgcatccctgcagagagtttaaattgttactctgttctttgtgtttcctggaaatttctggttgaatctagaggctgaataaaaaccaagttcctttttttttcatgggagaggtttgtgctaaattttggaaagttatttcttcagggtagttctcttttagggaaataatatacattatttggaataaaaaatgtgcttagaactaaggttcttgatttctttgttgtaaaatgtacctgtaaaatcttgttatatgaaacattctgcagtactctttatctagtcttggtatatttataatcatgaagaagggatatgggaaggttctaatttattagtgaagttttaattttttaagctatatatagagaatgtaatgaaataatttattgatgtaattgagattttcagcttggttccccatgccgacattgacattatcaactactatgaagtgactgtgaatttcaaaggtgttttgagtgcttagcatatctatagtccatgcttgcatccttccctgcatgtgtaataagccagaactctggaaggacttgcctactttcagcctctgtgagtctgcattaatgtaaggctaatgttattttgaatagaagtacgcaggctctaatggttttggattgaagcatttactgtaacctctgtagagtggctggtttgttacccatgtatctatgacagaaaaattcaattcattaagcatatggcatgaatagcatgatgtttgagccctgcggtaggaaggtattttgtttgcctggggatttgtagtatgctttgttggctccacctcatttattacctgtgcccacttgacatggccatcttgtacagaggaagaactgggactaaacatcagcagatttaagttctaaacctggttctgctgtaaagttggcagatctagcaaataaaaatacaggatgcagccatgcatggtggctcatgcctataatcccagctctttgggaggctgaaatgggaggattgcctgaggctaagagttcaaggctagcctgggcagcatagcaagatcctgtctcaaataaattacaaaattattcgagtgtggtggtatatgcctgcagtcctagctgtttaggaggctgaggtgaggggattgcttgagcacaggagttacagtgaactatgatcataccgctactgcactacagcctggccaacagaatgagagcctgtctctaaaaaaacaaacaaactatatatatacacaaacacatatatgtatatatatgtatatgtatgtgtatatatgacatatatatgtatatatacacacatttatatgatactcagtaaatttgaatttcagaaaaacaagggatacttttctagtataagtatgtctcaaatgttacctgtgacatacttacattaaaaattatttgttgtttatctgaaattctaatatcgttgggtgttctgtattttatctggcaaccctacttttctgggagctattgtttgactttggcaagttactttacccctttcggtcttaaacctcatttgtaaaatgaaataattggaataggttttctaaagctgcttatattcctcttgtagaaagttgtccaaaaatactctcacataagtgtacaaaagcagatacataggaatgttctttgttgctttgattaaatttcacagcattggaagtaacttatgagagactgtattatttccaattctattttcccccacatactctagcaacatatataaactcaatttatggtgggcacatagctgtctggagtaaagactacatttcccagccttctttgtgacaaagtatgcccatataactcagatagggccaatgggatgtaagtatgcgtagtatacaccttctgggaattacagttaaagggaaaggcatgtcttctcttttgtccccccttcttctgctgcctggaatgtggacactgggagggagttggagcagctgtctgggaccatgggtgaacttgggaatgaggccatgcatggcggagtaacaagacatgggcatttgatactgtaaagtaccagagcaactttataatatcaaattgtaaaaaagtactatctatttccacagatttttgtgatagagaaagacaattttgtttaagccgctgttatcttgagtacagctggaccttatcctaaataatacacaaacttgatatctgtggggtgagactggctaagttatggtgtatccataagatgcaacattggaaagcatttaagaaaataataaggtgttgttaactatgtttgtatgtaccaatatgaaacagttgcatcattatgtaagtggaaaaaagcaagctacagaacagagtgcatgctacaatttacataaggaaaaggggccacaggaatgcatgcatttgtgtagacctgtctgaaagaatagccaagacactggtcattgatgggctactgggaactgagaattcttcttcttctttttttttttttttttaagacagatatgtgctctgttgcccaggctggagtgcagtggtgcaatcatggcccactgcagccttagcctactgggctcaactgattctcttgcctcagcctcccaagtagctgggactacaggtgcatgccactgtgcccggcccattttttaactgtatctttttgtactctttgaattttaaaacaaaaaccatttaaaaacttttaaaacaaaaactgtttcttaaaagccccgacatgctgctgaaactctctagaacattgtgtacagacattgtcctttgggctgtggagataacctaggcagagtcctttgtcttctaggagcttgtgccctaacagggtaaaggcaggggaactgattactcttcagtggcttgaggtagggagtcgttaagtttgagagtagagaaaggaagggctgtgggagatgagaaaagtggggcagagactttttatggtggaaggtaggaagcagccactattcctagttattggaaacagttgtaatttctatctcctgtccaccctcctccccatgcttcagtgaaccacacaaagggaagggaccgttctcctttgaaaaaaaatctttcctttctgtgcttgtgaaactaatgcatattgtttgtaaaaacaaaaacaaaaacaaaacaaaacaaaaaaaccctaaaacttgaaagatatgtgtaatttagaaaatggaaatcccatcactctaagatatgtcattaaactgagaatacattccttggtatttttcctatgaatgtattaacattgtgagcacatactactaaatcctaacttgccttttttgttgaacaatacatcttggccacctttctatgtgagcacatgtcaaaccacctcattgtttgtttgtttttgtttttaaagacagaatcttgctttgttgcccaggctgaacttgaactcctgggctcaagtgattcttgtgcctcagccttccaagccactccaccatgcctggctccattcattattttaacaaccatcagatattctattgagtggacaaactgtatttttatttaaccaatcttttattattacatctggtttgtttccagttttttagtattacaaatacccaattgagcaagaatgtctgaagaataaactcctagaagagaatttctaagtaaaaggatatgaacatgaaaatttttaatagctattgccaaattgccttccaaatggttgtacaaatttctgtttcctggagcagtgcatgtgaattccctcattaaccacaaattttccaatcctggtctttttatcagtattgtaagccaaaaagattgaatttcattttaacttgcatttctttaattttttgcaagctttttagcttagcatccacttggagttcctctctggtgaaccgtctgttcacgtaaaaagggagatactaacccactggtggaagtgttttcctggacatctcattcaaggtatagcagtcttcaattgcataatttcttaagccacaagaaactccagtttcccttttaacattttgtctgaggccgttcttgcattgctataaagaaatacctgagactgggtaatttataaagaaaagagtttctgcaggcttcacaggaaacatggtgctggcatctgctcagattctggtgaagcctcagggaactttcaatcattgcagagggccaacaggaaaaggggcacatcacatggcgaaagcaggagcaatggagtgagagaatggggaggaggtgccacacacttttaaatgaccagatcttgcaagaactcactattgcgaagacagcaccatgctttgagggatccaaacaccttccatcagaccccacctccagcattggggtttacaaattcaacatgagaattggatggggacaaatttccaaactacattacaatcgaagaccaaattcaaagacaatgttaaagtatttaagattggagataaggtacctaaagaccctggcactttggttttaacagcttagagtctgaaattttaaaatagctttatgaaatgtaattcacatatcaaggaattcaatcatttacagtgtacaattcagtgatttttaaagtataattaaagagataaccaactatcactataattagtttgagacatattatcacctaaaaaagaaactcacccattagcagtcattctctatttctcccagatccccctggcctaggcaatcactcctatttaatttcatataaataggagtatataatataaatttttttgcaacttttttttttttacttagtgtgatgtttttaagattcatccatgttagagcatgtatctgttctttattccttttgttgccagataatattccgttgtatggatataccacattttgtgtatccatttatcagttgatggacatttgtgttgtttccactttttggctaatatgaataatgctgctgttaatatactagatttggaattgctgggtcatataaatttatgtttaacctttttaggactattagactgttttccaaaggggctgcacccttttacatttccaccagcagtgtaaaagggttctagtttttcagcatccttgccatcacctgctattatctgactttttgattatagccgtactagggggtattaagtggtatctcattgtgattttagtttgcatttcccttatagctgatgatgttgaacatctttttatgtggttattggccctttgtatgtcttccttggagaaatgcttattcagatcttttgcccatttttaaattggattatttgtcttttaattgttcatttgtatgaagagttctttatatattctagattatattgatttttatagcttggagaaagttaaaaagtcagacaggtcagaattagctaagaatatattgtgcagtgatttcatcatcctgtagttgtaaagtagcttttatgttactggagttacctataaaacagtttcactaaaagttttatttgaaatattaataatatttggagtttatgttgaattttcaacaagaaaattaattaatttcatctccatagtttgagattctcattaaagttttattctggataatttagagttaaacatgcttattttgcctacagtaaggttctttctcacaacatgatagttttcacttctgctttggtaaataagaaaccttgccatgggcatgttggctgaccttggacaagcaagttcatctcatgagaatgcctcccttatgccttttagctagtagagaaaattctctacttatcaaaggcagtgagctggagaccaggtcagaggccactggatggagtaaaattgcaggggagcaaaagagaattccttttttttttttggctgtagcttatcccaggccttgtaggagacataaaagtagtgtccaggtgatcagggggtcaagagatggctcccttagctttgtgctatgaagcttctttgatcttcactgaggcttatggcagtgtagctgatggtttgctaatcctggctttcagtcagctggctcatgtttgatttgggaaaaagaattaaaggagaaaatttcttggtttgagaatttttgagttcttcaattcagtttattcattcattcattccataaatttattaggatctcagtatgtgccagaaactgtcctaatataaatacagaagtgacaatgacagatttaatctttggtttcaagagctaattgtctagcatgatagttcctaaatagacagctacacaaacaatgaattacaattgtgttacatggtttggaaggaggtgtttgggaatctatcagaacatgtaatggggccataactaggaaccttacctgtgtaggatacagtgaaggcttccctaaggtaatgacatttcattttattttattttttgagaaggagtctctctctgttgcccaggtggagtatagaggtatgatctcggctaactacaacttctgcctcccaggttcaagtgattctcctacttcatcctcctgagtagctaggattacaggcatgcaccaccatgcctggctaatttttgtatttttagtagagatggggttttggcatgttggccaggcaggtctcaaactcctgacctcaggtgatccacctgccttggcctcccaaagtgctgggattataggcatgagccactgtgcctggccaggaatggcattttagctgtgatataaaggatgactggagctgatgagatggggaagggtgggagtacaaaacattctaggctaagggaatagcagatgtgaagaccctagggaggaggtgttgagtgggaggcaccagaaaggacttgtgggcaagaaggagctgaagggaggcagtttcaggtgagatcatggagggtggtcgtggccgtatcaggtggaacttcctgcctgtggcacccagtgtggactttatttgcctgctgtagcttttgagtgtccagtgaggaggatgaagaagagggttagaactatgaggtccttgtttcctgagatcctttaccacaaccaccattgtctttactagaagccattttatttttaactttgtataaaagtcatgtctcgaggtaacaatttaaaataaatattcaaggactttttatttattttaaccctatatagagctagttgacttttccccaatctgagaatttgccctggaagaggacattttgctggggcacattctagtataatggtcaaaggagggagtagatagagttaatgagttccagtacctttagacaaaatgcatctcagtgtgggagtcaatgtgaatcttttttatctccctatagaaacagatatatttgagtcaccgtgcacatgcccacctcttcctttctaaattgtcctatataaagccccaacaagaaagatagaggatacttttggtggtagcaaataccataatgaaataaacagtccatgaagttgacttggttcagaatggagaaccaaagatatatgtgacagacttctgttactaaggaccagaaaaccattttaaagaaaatgaaactgttgtggtggcattaaatgttatatgagcattcacgtacaaacacatagaaatgtttgcctggataaatctacatgcatctcaataattttgatatttgaaacatttctttaaaatcatttctttgaaatagcttgtctctctgaagtgcctcttcacctttcagcaaaggatagcatctttgctattatttacactacaggattctaatatgtttacttgaatacattgcatagtgtgtcatctgctataccatgctttgtacacattaggtgtatggtaagtatttgatttgacttaaaattgaatagcatggaaaaattaatctcccgtcagatatgatctgggatattatgatgcctcggggacagagaaggttatttttaatgttttccctaaagcccataggtattttgtaattaatttggcaaataaaaattatctgattacaggcacatttttctccccccaagagagatgttccccataatcgcattagtaacccattcctgtgcacgattgccttatcagtatactctcccatctttgaatatccttaatttctacctctataattaaaactcatttttctctgatcccttcctaagtggtagcagtgaacccaggattgtcatttgattgtcacagttcacctacttatttgagttgctaatactcatcttaaacgtagacatgacatggtatttagaataaggctggagccttcttcctgcctcccattccttaaccccttaaccatttctctttctcactcttcttattcctaaaatggaaatggtggtaatacctcatagttgatgtgagagtcttctcagagtgaatgattgataaactataaagttctaggcagaagttaatcacaggtatcattttgttcttatcccttccctgatgaggaggatgtagtcaatggtgcacattggaagttgtgaccaggcaacttagatggagtgacacagtgatctcattccagggcacagcaggaaattcagcctcctccttcttatgacagtctttcagtggagaataatttgaagtgttggtatggggaacctcgttcagcatttatttttggaacatctcccatgagtgagactgaagttgttgaaggtatgttgtggtctgattgcttcacttaagttctcattttaatccccaacacatcctttgagatgagtgcaagagctgttgttcccattaaactgacgaagaaactaaagctcagggatcagtctgacatggtatgagtcacatttagaaattgaagcaggtgcttcagttagtgcattttcttcacaacacatttgctcacagctctattaggctgtcacagtccacccttaagtggatggtctcttccaccctgggaggggtccttatgagtagtgcttcctgttaatcttggatgtgacctcagctcaaagcattgggtaatattctgtggcatgataatccaaccccttcattaggccaggtagtgaactcttgtttatgttgcatatgaaccagctaactcttaaaaacaaaaccaaagataacttaagaatcttcttgctactgaaaatgcacctcaattattttctgtatatccagctattgtatttatagatagccccaatgacaaatattgtactgccattctccattttggttctgatggcagacatcactaatcgtgagacttcccctctaaacctagttttggctttagaatcctcctaaacccagtgtacaaggtagccaatcactctcctttgccgcccttttttgcttttcactgttagatcgcttataacattctcatcactcaaccatttaggtaaggggcaggggagaatgacctagtgttagtttagtttgaaaagcaagctaggagaagaaagtcgtgaaattctatttttggtatagaaataagagcattattggaaacccagtgttgagttggttgtaattttttccattgaaactcagtggggggatttctaagaagttgagtgatgggtattttatgcagtgtaaaatatagtggatggaaaagctgatggaaaagctaattaaagaatggtttctaatagggcattttgtgctgttgagagaggttttcagaaaaggatttttttttcattgtaagaacatattattccattcctgagttcaacatggtcatttattttgttggccgtcactggtttagaatggaaaaaggaattattaactaaatgatttttcattgttaaaatttcagccctatttaaggctccctttcacagtcagctgtagatttaactaccaaaatttagcaacctttgtgaagttagatttatatagctgttgcctgttcttggactccatctagatgggcctacccttcctagttaaaggcagggcagattcctgccgggttcttcaaggtttgaacatctgtttactcagagaatgacatctatgggttctcagcctgggtttcttgatttctgggaattccttccaagcagcagaatcaaagggtagatgggttgagataatgggaccagacagttacatgatttattaactccactgactctagctgaagtcctctggggaagcagcaggccagctcccttgagatcacaggcttgacctaatgtctggtctcctccctggttctgcagcacaactcctgaaatggcactaacaagaccatgtgtggccctctcctgctgttgcaggtgggatggtctcatttcatttgcaggtggcctttctcattctcatgccactgtcatgagctggggtttccctggcagggaaacagtatttcgcatgtaactctggaaatcgtaggcactgctttgtcatgttctttctgtgacactgactcttgtggttaaaagactgcagatcattccatagtgagtctggcttttctctgcattttacactatttctctgtgaagtctgactcatgcctcaaggtctggttgactagcacgatttctccagcatttgttaattaaactccttgatatatttccctcctcccatgcaatagagtcccccaatgatcaatactttcaacctaacagctattgcttaactggcttatattttttgctttttcccatttatctacaatgtatttagatgggaaagtgagctattctttgttcatcatttcaggaagagttctataaaatatgcattacaatttttgtactctttttttttggtactcctaatactctgaatgctttgctccataattttcataaatttctctttctgtctgtaatttctctttagaattgaaaatataattaatgttgattttaaaggttgatacattcctgctcccttgtgtgttttattgagttgataattttttggggcgtgccacctataagcaaggtattgaatgctgagttgctgttagggttcaaaaatgaatgagggcctacactttttgtggatcgacagaggagattagatatatatgtgattgccgtacaaagtagaaaatgatacagaccaaaagtacagtgtgggtagagtattgtgacaacgtagagtaaggaaaggaatcatggaaggcctctgagaagaggtgtaatttgaagtaaccattggaagtctagacttcaagcctcatgagggcaaggtctgtggactctcttggatgccatttgtgttagtctgcattgctgtaaagaaacacctgagactgggtaatttataaagaaaatacatttattttggctcattgttccacgggttgtacaagaagtgtgatgctggcatctgcttctggtgagggcctcaggaagcttgcaaccatggctgaaagtgaaggggagccagcatgtcacatagcaagagcaggaggaagggggagaggaggaagttccaggttattttaaacaaccagatctagcacgaactcacagagtgagaactcattcattacccggagaatggcaccaagacattcatgagggatctgtccccatgatccaagcacctcccaccagggcctacgtccaacactgaggaatacattttgatgtgagctttggaggggtcaaacatccaaactgtatcaccattgtatgctcagtgctgaacatagtccttagcccatgttggtgctgcataaatatttattatgaaaatgatgagttaggatttgtatatgtaaatatgatattggaaaggtcttaaagggaatggaatgatcatggggagaaatagaatggaagatgaaaacaggaattatctttgagaattatctctctctacaaatgtgtaataagaagatatttatctgttaattttaactttccctaacacaccacattattctagtcacaggcagggagtcattgttgaaaatgagagttagagatggtaaagggggacttgctctgtctccttatccaatcatgtctctttagcattgatggctgggtcatacgcatcttgcaaggacactcttggaaaagaaagaggtgaaagaagggcaatgatattcttctttgaaatggaatttgattacccttgtctctgttcaggtggtgagaagagctcaactagagaggttataaaatctccttgtcattttcgaaggcagtccaagggcttggatgcattagcaaaggcgacagtgttgtcatggtgaacgaatattgtcctgcatctgcctgacctaatcccgggttttatagacacaaatggcagagaatctgaatagtcaaataaacaagagagaacaaacagcagggagttaatatttagtatggtccactgcccattttattagtgtgttcattttagaaaattaaaaaaatcactttgcattgtacaggttaaagagaagccaagaacacccacaatgtgatgagaatccttgaggattatgcagaattagacagagaccaaactgatgaattttgtaacagaggttttggggctctataacaataataacaaattggttaaacactttcatagtaattataaataatttcagctcatagcatttttgtgtttttaaagttgatgtgacattctctaatgcctatatttatttattatatagccaaaatttgaacatagtttaatacacatattaaattcttatagattagtgcacttcacatagatgctatttcactatagcacattttaaaatattaggttggtgccaaaataatcacagtttttgccattgaaagtaatggcaccacccaggtgaaaaccacgcaggtccctctcacaggtagttctaggcaactccttgttgccaacaaaaggcttcaggccctgttgcaaccacttttatatgctgttcatatggaatgaaagagtttctgctgtacctattattttacctgcccaaaagtcttacatatggtgttatatctggcatttgctgtataattagcattatattggatacagttctccatgtttctatgtgacctagcagtttatcattttcagtagcagtagtgtctcccaatgtcactggtgctctcttcatttgcagagccaattactaaggtctttccagcgaggaaaaccagtagaggtatggggtctggaccagcaggtcccaagccctgcttataatcagaatgacttggggaaattttaaaaaacagaaacaaaaatacaaaagaaaaacaaaaacaaccccataagacaacaaaatccaactgcagagatactgatttagagtgtctagtgtggagcccatattttcaaaagttctccagagggtttggaggatcgcccaggttgggaagctttggggataattccatgatccagttctttccatcaaaataaactaaaagaaaagtgtaatcagaactgatctccataaccatcataggaacgaaagtcaaagaaatctgggatgcttggagtgtttcactgtgacttaattattactgttaatatttattttaatgtagaatacactgaagttgacatcttgttttttgctgtcactgagttttgagtctttcttgactttgtcctaccaagtgatctgtggctttgcagtgtaggtacaaagctttgcttaagtgttttcctaatccttgccactggatctctaatttttatagagctgaatttactcttgagaggtaatttggggtcatctgttttattcatactgaaccaaccctttccattctgtctttacttgttcaaaactgagatgactttgaagccatatgtctatcagtagttcataatgctttccttttggcaaagatccaagtttacagtggatgccctaagaaccaaattacatctcatactctactctgcaattcaggccatttagctgcaaatactgttcttactcattttatagctgtcccattcatggtagttctccagccttggtgtctttagagagtcttcttaaagggacccaaatgagctaataacatagctgaagaaagcaaaccatttaaaaagaatatgtatgtttatggattgtcttaatagccaaagttttaaataaatggaattagtttcctctaaaattagtgagttccccattagtggaggaggtgccttaacatagatcaaatggccatgtggatatttttatgtagagatttcaatattacataaatgattgtgctactagaacattaaggcatttaagaaacacatatcatgttccgttttcacccactagttgctcaaatctggtatatggtgtatggtgtccatgtgttggttggggaaatcattaatgctggccatacttagggtggtggagaaaggactttggctgtattttccatccactcaccaccaatgtggtggtgtcaggagatggggcctttgggaagtgattggattatgacagcagagccctcatgaatggaattagtgcccctatagaagaggcaccagattgctgcttggcctcttctacaatatgaggacacagtaagaagtcaccatgtatgaaccaaaaggtaacccctcagcagacatcaaatctgctggcaccttgatcttggacttcccagcttccagaactataagaaataaattttctattgctaataatctacctagtttatggtattttgttacagtaaccaagacaaaataagatacatccttactggtggaatctattcatttcacatttttgggaatggaggttggagagcttagaagacttactcaaagaaacaagggcccagaaataaactgtcacatatatgatccagtaatttttgacagaggtgctaagaccattcattagggaaaggaccatcatttcaacaactgttgttggaaaaactggatactgggacatgtaaaataatgaggttggacccttaccttatatcatatatgaaaattaaaatagatcaaagtcctaaacacaagagttgaaaccataaaacatttacaagaaaatttatgacattagatttggaagtgatatcttaggtaggacaccaaaagcacaggtgacaaaagaaaaaatagttaaattgaactacatcaaaatttaaaatcatacatcaaaaacactatcaaggtgaaaaagcagtccacagaatgggagaaaatatttgcaaatcatatatctgttaagggattaatatctagaataattaaagaacttctataacttgacaacatcaaagaaaaccaaacaacctgatggaaaaatgggcaaaaggacttgaatagatatttctacaaagaagacatacagatggccaacaagcatatgaaaaaatactgaacatactagtcattagaaaaatgcgaatcaaaaccatagtaagatactactttatacccattaagatggctattacaaaaaacaaaatagcaagtgttggtgagtaaatagagaaatggaaacttttgtgcattgatggagggaatagaaaatgattcagctgctacagaaaacagtatggcagttcctcaagaaattagaaatggaattactatatgatccagcaattccacttctggatatatacccaaaataatttaatgcagggactcaaacagatatttgtacacccatgttcatagcagcattattcaccatggccaaaagatagaagcaatccaaatatatgtccctcagtggatgaatggataaataaaataatattctattgtgtgtttatatatataaagtcttataaaaaggaaactctgacacatactatgacatggatgaaccttgaggacattatgctaaatgaaataaaccagtcacaagaaggcaaatattgcttgattgcacttaaatgtgacacctagagtagtcaaattcatagagacacaaagcagaatggtggttgccaggggctggagggagaaaggaatggggagatattgttcaatgttcaatgggtgtggagcttcagtttgggaagatgaaaaatgttctggagatggatggtggtgatgattgtgtcataatgcgaatgtacttgatgccactgaactgtacacttgagatggttaaaatggtaaatttcaggttatgtgtatcttatcacaattaaaaaaagagtaaggccataatgacagggatgagattaaatccctagttcttagatgtgatttgatgcttttctgactctcagagttccattcattcattcattcagcacattttgttgagtatccactatgtgccaggcactgtgatagatgttgggaatatataaatgaatgaaacaaacaaaaattctctcatcctggagcttatatgctagtggagcatacagacaataattatagcagtgacagcaacaaagtgtagtatgtgggatgtgagatggtgattagtagtatcagaagtctgaaacaggattagaaggaaaggcaccggatcatggaaggatttgttgtccattttagcgacctgggttttgctctttgtgaaattccagtggggggttttttgaatagaagggcgatgggatgttttaacaggattcctctggctgttgtgttgagaataagcatgggaaggtaatggtagaagcaggaagactggagacaaatgctcagtacaggtgaaggaggttggtgacttgcaccaggataggagcagtgcaggtggtgagaagtggtcagattatggcagtatttgatgataaagctgggtagatttactgatggattgattgtgggatgggaaaaaaaacataattaagaatgattttaaggtgtggggcctgggcaactggtaggatgcagttgtcatttactgatgggaaagtacaaggaagcagatttggagggtaaacccagggatttggttttgggcatctgaaccttggggtatctattagacatccaagtgaagatgattaattagttggctttgcagtttcgagtccagggatgagatagcaagcctaacggtataaatttgggactgattagcagaaagattgcatccagtcatgaaaaaggtgagtataatatagaatataatcatatatagagaaaaaaaggtggccagagaatgaacactgcgatattgcaacattaagaggttgagtagatgagttggaatgaaacaagagagtgtggtatccttaaggtcaaatgaagaaaagtgtttcaacaagggagggcatgatcatttgtttcaaatactttagatagatcaggaaatatgaaaactgaaaattgaccattggatttattcaggtcactaatgacatcaatattgctaagagctattttggggaaatggtggggggaaagtttgattctgattggaggccataaacctggacacctttttctaaaagttttgctataaagaatggagagaaataggatggtaggtggagaaagaagtagaggtcaagagaaggcctttttgagatgagagacatgatgatatatttgtctgctgataggatctgacctggtagaaaatgcactgctgcagtggtatccatgagcaggggggtgggatgggatctagtacacaagaggaggggctactatgggtaggcacacgtgttggggcacccagagttacaggagggatggcagaggatctgggcagagatgcaagtccgtgagttgatggggtgctgcaggtaaaggaaattctcttctgtggtttccatttctgggtgaaaagggaaggaaggccaatagttaaaagtgagtatggggaaagaggtgctgaagctttgaaggagaaggtatgaagtacttgccaacaagggtggaaaggtgaatggattaagtcaggaaagggaagctatcattttcgaagaggttgagggtataggagatctttgttcttgaggaccctgagttccagaatgcacagtgaagggattttgagaatttcagattctgggatatacagagctatagggagatcagagtctctcatgagccatcagagatcactttgcctggtttttttccacccccccctttttttctttttccaccttactttttttctattttttttcttttcctttctctctctttccttccttccttctttgtctctttgtttctgttcccctccctctctgctttgctttccctccttttggtctttctccttaagttgatctttgagacactaagaagaatctgctattgaatctattctctgcaactggctaacatatttttttttaaaagtaaattacaactgacccttgaactacatgggtttgaactgtgaggatccacttacacgtggatttttttttcagctgaatgcagattgagaatacagtattcacaggatgcaaaacctgccaatacggagggttaactttttgtacgtgcagattctatacagctcactgcaggacctgagtgtgcgtgaattttgttatgcatagggggtcttggaaccaatcccctaagtatacccaggaatgattgtaatacgaaaacaaatgcccttttccttcattgggatgggcttaaaggcattaaacaaatcatataatactttaaaaatattgacaatgaagttataagaagaaattccccatttttttctttaaaaagtagacttcctcatgaccaatatcggaataatgaatttatgagaattataaggtttttcttggcataatcaaataatgcaaagtcctaaagtgcttccttattaatcagttgtgcttaagcttttctgattttgcagccttggagactgatggatgaaaaacaaagacattgacgcaaatggaagtgtttttcttttcttctgcagttgtcccagtttctaggcaatttcagagggattgtaggtgtaaattggcctagtttgatggtcaattatcatttaaaataattttgaattgtttaacaggcagattataagtaattttcacatacaaaaataggacaaaataattagcttctgtttcccatgtgtttgatatttcaagaacaaatttacaacttgtagcaatttgaactttacctccatttttagtcatatctcactttatatcaaagatgatatggtgatagcttaattttcttataaaaacatatttgtggcttttaattgcagttggttggatgtttgtattgagtttgaggactcgttctccataagtatgtattcaggctttaaagatttatctgttcattcataccatgcctatttcctgaaaggctattagccaagaaaacgtgggtccaaatagagcgaagagacacaaggtggaaaggagacacaaaaggtgattgtggcaggagaacttctcggtgaggagtgtccagcagtgttttgtttctgttcatctctagcatcagcccagggagtgggaaagcacacaaatccctgtatgaattggagatgagacgagaacttgtactgggggctagcagtaaaaatatactttagaatcagacaaatttggatttgtctagctctttcacttattagcgacaggacctcaggtcagctgcccaaccacaccttcagttttctgatctataaagcaatcatgtctccccagacgtctgctgtcaagaataagtgagataatgtatatgaaacactcagattgagggttttcaacagggggcaattttgcttcccaggggaatatttgacaatggccagagacatttttgattgtttgctaattgagagtagagtgctgttccttatatttagtgagggggcccggggtgctgttcaacatcctgcaatgcacaggacagctcctacaatcattactcagccctaacgttcataatgctgaggctgagaaactgactttagaacaatgcgtgacccagagcaaaggctccaaatatgttagttcttatcatcatcatcattgtcgtcatcagttgttgacacaaaattttagttagttcttaattctatttttcctgttgaacatatttcattcccttcccttccttaccttgtaggtgaatttatctctgtatctcaagcctagatttctgtcgcaggctttcaaatactttcttgattcttttctgatatgcacactcatgtcagactaagatttcttaaccgtgcatttcatatccttcttttactccctcttgttgagtatgtgcagtgggtagagtgtgcagtgtagagtcagactgctcgagttgaaatccaagcatcaccacctgcttgaagtgtgaccttagggaaattaactttctatgcctcagtttcatcataagtaaatggggattacagttgtaccttctcttagggttgctgtgagcattaaatggagtgagctatgtaaagcccttggctcagtgcctggcacagagaaggtgttcagtatatattatttcaccagtgaatagaagctacaccaggttattttggttttttttcatctctatatggttggctttgacttaaattcatgagagatgagctatcttcataagtaataacacaagaaggtctctcctgagtagtcagataggataagtgcatttaccctgaactgtccagtatggtatacttaatagccaatatggtatactcaatactcagtagccacctgtagctattgagtatttgaactgtgggctatctgaattgaccgctttaagtatgacatacacatgggatttaaaagatttaatacaacaaaaaagaatgtaaagtatcagtgatttttaatattcattacatgttgcgaaaacactgtttttggtatattgggttaaataaaatacgttattgaaatggatttcacctatttgtttttatatttttaaaatgtggctactagaaaatataaaattgcacatgtggcttgcattacacttccattggactgtgcagggctaacttaagaggccagggttctcgaatggaggtacatctgccaaatcacagtgcctctgttgcagtggaggtgtcccttaactgtttctggcacactgctggtatagtcatgacaaggcaggaatgggagcctgtctctgaactcaattcatctggcttatttggtgacattctaaacttgggacatatgaatgattttgggctcttttgggaacttggaattatatggaaaaaatgttttctatctgtataaatctagagcacaatcttgagaaccagtttcagattgctgcctttgtttttttttttttttattatactttaagttttagggtacatgtgcacattgtgcaggttagttacatatgtatacatgtgccatgctggtgcgctgcacccaccaactcgtcatgtagcattaggtatatctcccgatgatatccctcccccctccccccaccccacaacagtccccagagtgtgatattccccttcctgtgtccatgtgatctcattgttcaattcccacctatgagtgagaatatgcagtgtttggttttttattcttgcaatagtttactgagaatgatgatttccaatttcatccatgtccctacaaaagacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggttcccaaatggaaggtattgagcttctgggcgggcgatctgctcccttcaagaagattgagcttgctggttttgtgatctggtgactcaggataaaaatgtgaaattcacatacatgcatgcaaaatcttccacttaattgattgcattttggggcaatattgcttgctaggttggatgctccgatactttttttgttttgtttttgttttttgtttttttttttggagatagggtttctctatgttgcctaggctgaattggaactactgggctcaagtggttctcctgccacagcttcccgagtagctgagagtataggtatgaatcactgcacccgaattccagagtattttgaagtttggtgagagctgtgctaccgcacaatccaaagaatctcacatggttatttttaatacgatatgatctcccatttgttatcttttttggggggcctaatgtgtgaaatgattaattttacatctttatgcataatattgctctgcaggtgttgatatcttaacttatatttgaaagtttctacatggtgcttaagaactcagttttcaggttgacaaattgacaagtgagatgataatctactataaatgtctttgagtttggaaatttatggcaacaatcttaatattataaaattatgaaagtaaactctgtaggacccaaaagatctgtcttatggcatcctcaggcatttctttctctgcattatagacattgcacagacaagtctatgtgcagacaaaatggagacacgtatatcaaggaaaaggatcatactcttccatctagtagaagattgtttatgttttcatgtgttcctttctggtctttttcctatgcatattttttgtcacaaaactggtatattttactcacttgacaagtatatactgaattcttactgtgtggcaggcactgtactagacactaggatacagtggtaattgatattaacattgggcctctaatcggagaaacaggacagtaaacagttcattgagttaagcatgttaagggatcgtgatggggggaggtgcatcaggatactgtgggagcactgaaggaccattataattacatgtgcttcttacccttgaaaaaccgaatctgggtaagtcagttcatctgttgcctcccaaatgatattttagaaatagcctcccatgtattgcgacttctttaattactgtacttttctctgttctggttctactagactcctcttaatctgccccactcttagctcattgccaaaagagggactttcttctttcacctcatttttttttttttttgagacagagtcttgctctgttgtccaggctggagtgcagtggtgcaatcttggctcactgcaacctccgcctcccggattcaagcggttctcctgcctcagcctcctgagtagctgggattacaggtttgtgctaccatgcctggctaatttttgtatttttagtagaaacagggtttcaccatgttggtcaggctggtctcaaactcttgactttctgatctgcccacctcggcctcccaaagtgctaggattacaggcatgagccactgtgcccggccaactcacctctttttttttttttgggagcaattaagattctttgtctcacagctggagccagctcagcctcacccattgagagggatggtttccatttgcaacatcaatctcaatgttaccaatgttatcagagattctgggccttgttagtaaatgctctataatctgtttctcttgtgagaaacagggtaagtctgagagagtttggtagatattttctgggcaacctggattggaatctgtattagtttattgctttataacaaatcccctcaaaacttactgactttaaacaacaatatttattatctcacagtttctgtgggccagcaatctgaggacagcttagctgcatcctctagctcagggtttcacacaagttgcaatcaatgtgccacctggggctgcagtctcatctgaaagcttgactggggaagaatctgcttctaagctcatccatgcggttgttggaaggattcagttccttgtgggctattggactgagggcatcagtttctcatgggctgttacctggaggtcttccttagttccttgccacttcagcctctccatagggcagtttacagtgcaacagctgacttccctcagagtgattgagcaagagagagcaagaaagagaggatgtaagctggcagaaatcatggtttttaataacttcctactttctgttcaatggatgcaagttgctagatcgaggccacaatcaagtagagggaattacacaagagcatgcataccaggaggtggagagtattaggaacaatttacgaagctgcctaacacagcacccttaatgattctctccctctagtatttctataagatttagtgtttcatcgttgtatgttcctctacctttattattactattggattgccttccatcaacagcctataaacccaatgagggcaggaaccatgcctgtcttgttgactgctgtatccccaaggcctagagttgtggcacaaagtgatattcgtacaaatttgttgaaggaatgaatgaggcaataggctcaacctcaacaaaaattctctcttctctagccaccagtgtcttcctcctactgggcctaccctgtttgcctgacccaaactggggacccttgactttagatttggttcttgactctcttcccacctattcagaactgatgttttgggagcccctttgggctagggttcactgtatctaatttcccttggcatcttcatccctttcccgctctcccatgcttagccctggctccaggattctggcctcctgattctaggaagagaagtttggagactttttcctagagggaaggattttggggagagattactatgtaaattctcccttgtggtggacaaatgcaacctggtaattttgggagcatcctgggtcccctcccttgatgcaagcactgaggaagaatacagggatggctgctctcatccatctcaaagaagtataaactaggaagacactgaatagatgttcagttagattttagtccctcatgcttagtagtttattattgaattgaaatattattgcattgaaactggcagtattcaccattaaataaaagactgagataatcaggattagtcatttttcaaaagaaatgtaaaaatatgagctttctgtattgtgttggtggttgtagcctttgctctgttgatgtctcctgctggctattcttcaaataacaagcatcctggttgatttttactcttctttcctgccttctgtcccacagaagcgctttgaggatgacataatagtgggtactgataacaggggctgtggagtcaaacttcttagccctaccacttactggtttcatgaccttcaggaagttacttaacctctcttaggctcagttttctcatctgtaaatggagataatgatggaacccatctttaaggtctaggggaggaataaattaaatggtatactcaaagcatttcacacatagcctggcatagagtaagtacatcacaagtactaagtgtaataagtaatacatatgtaaaaagtgttggctatatttattgtttaaaaacaaacactgggccaggcgctgtggctcttgcctgtaattacagcactttgggaggctgaggtgggcagatcacgaggtcaggagatcgagaccatcctggctaacacgctgaaaccccgtctctactaaaaatacaaaaaaattagctgggcgtggtggcaggcgcctgtagtcccagctattcaggaggctgaggcaggagaatggcgtgaacctggaaggtggaggttacagtgagctgagatctcgcctctgcactccagcctcggcgacagagcgagactcagtctcaaaaacaaacaaacaaacaaacaaaaacactggatggcctctgtgcataggggtgggcatgcaaggtgtgaacttgattgaagatgatattataaaggaaaactgggacaactcctctttagaccagcagtcagccaacgaggatcaaaggtccaagttagtcccaccttttgtttttgtatagcccacgagcaagaatgaatttgacttttttaaatggggtttaaaaaaacccacaaaagaatgcatttcagagcacacaagaattacatgaaatacgcatgtccatgtccataaataaaatttataaaataaacacatgaatacataacatttaggaaataaaaaataattaaagttcatacagtagtcatactcattcattttattgtctctggctgcttttgtgctacaatggcagagttgagtagttacaacagagacggtcttggctagcaaagactaaaatatttactgtttggccctttgcagaaaaatttgctgactcttgctttacaccaatgtgctgctgtctgtttccagcatgaaattgggaggggtgaggatggtgagatgggaaagccaagaagctctccaactaatcccctgttgagccttaagtatgcttttgtgatacagtgatgtcccaggttgttcatatcctgtattcaaatttaggaagtaacacatcctaagattgaatagacaactgactttcaaattcctccttctttttagcttatagaaattgactatgtataaaagtagcaagttactgaacctacttcttctgaaataacacacaaatggtagtgtgatttctagatttttttggtgaatatcggcctggctttcatgtgattttataggatcattgtgatttacatatattagttaaattctcattaatatgagactgaaaaatgctgataaaatgctgtcttggtgtgtaaaatagacttatatgaaattagtggttatctcaaataatttggaagacaattgctgatgcaaagttaattcaaaagccacagtaaattgaagcactaaaagaatttacattctgtatttgtcaaagtacaacacaagtatctaattagaattgatacagtattaacagctgacttgatataaattagaatttactttttagttgctgaataatgatacatttcttctttcttgtatgtatttgttattattcatattacgccatcctgcctgagttgcttagttaggtggtcagtcaaatatgggttttaagtagcattgtgaattagcggttatagctcagagtatgaagtctaacagattagagctcagttctagctcctgttctgctgtatgaccttgctctaattttcttttcttttctttcttttttttcaaggcagagtgtctctctgtcacccaggctggtgtgcagtggtgtgatctcagcttactgcaacctccacctcctggattcaagtgatcctcccacctcagcctcctgagtagcgggggacaacaggcacgcgataccacacctggcttattttgtagtttttgtagagatggggttttgccatgttgcccaagctggtcttgtactcctgggctcaagcgatctgcctgcctcagcctcccaaagtgttggaattataggtgtgagccaccacacctggccaccttgttataattttcttagcttcagtttcctaatctttacaaagcgttcattaatagtgtctgcattctcaggctgttgtgaggattaagtgattaaaaaaatgtgaagtatttagaaattgtgcctggaatatagtgagagttcatttaatgttaggtgatgtattgttataataattagccttagcaatatgatttaatgttgctaatgttaatcaatataatttaccatcagtgggaatgtgagaatataagggctctccctgtttggactcacattgcagcttgtacagttctcagaatttgaaagcatgaaataccttctaaccacagactctttagctcattttcttgtggggcaactctctttcccatcaagcaacatatgcctctcatttgggcattttgttgaagccctatagactcatacaaattccttcccagggcagaggctaaaacacagcatgagagatcccagggctgggtggcacagaggctccttagtgctttcctaggcttctcaaacaatagcgtatacagaagatggtaatatttgtatgtcagtctggggtgagcatatgaggatgagcctggctagagatgcttgctgagggtgatggcatgggagtcatactggtaacccatttgtggctatgccctgacataggtctgagcaaagcctgggtacagtggtgggatgacaggctagccaagggaggggatattaataggtggtagcagctgaacctgagcccttgggaggtggggtagagaggtgagaatgtactgcctcactgaaaagtggccctctttatatggctgctgggatttctagtatcttgcacaaggccctgccatttttaactgtgtgtgcatgcatgtggttgggtgtagtgtggaaatacatgaagattacccaaatgagaacagaggttattgattcagagcttgccataacaagagaggaagcttacattacttgtcgtgtttgacacaggcaggtggtagagtgagaaagctttacaatccaaaaaggggagccttcaggtatatatatccttttgattggaggttgctggcttggggaagctgcagatgggctaattaaaagtgcagtatttggcttccttttctaggccctgagttggaagtaggggcacagaatagagaaactggcagtcattgactaaatcctggctcttgctgctggttgctgcagaggttttgagacagtgttctattgtcttgtatagtctggctatgttcttttgcctatttggtctttcagtcctttcttttcttcgttctctggcttgtgagtggctgaccaattctggaaaagccagaatctgaatcttcacttctcagaaattatccagatgtctccgtagtaaactatatttcaatcatggcagtcatttgataagagactggttgtgcagaagcatttaaggctccatatagaacacaataagtaacattatgaccactgtggcaaaaatgagaacaattaatagtctctgtaagctgctttagaaccagggaagcaaggctgggcgcagtgcctcatgcctgcaatcccaacactttgggaggccaaggcaggcagatcacctgacgtcaggagtttgagaccagcctgccaacatggtgaaaccccttctctactaaacatacaaaaattagctgggtgtggtggtgcatgcctgtaatcccagctactcaggaggctaaggcaggagaattgcttgaacctgggaggcggaggttgcagtgagccaagatcacgccactgcactacagcctgggtgacaaagcaagactctgtctcaaaaaaaaaaaaaaaaacaaaaaaacccccaccaaaacccaaaaaacaaacaaacaaacaaacaaatcaggaacacaaattgtttaaccaaggccaagagaacaaatcccataggccatgaggatcaaccttagaaagccaagtaactgtttccttcaggcagtgtttagtctgttctgtctttcctacttccttgatcccagtccaaaaggcagtattagcaatgacacacatgccaccacgaccagccaacaagaaatccggagcaatgcaattgtccatcactatctgtgccaatgaattgggaatgatctgtattccatccagggcagaggtagtattattaataacttttgccagagttagcaataggtttcttcctgatgtttctaagatttccatcattgggaacactgctctgattgtttgcataaagaatgagtcattaatttccccaggtggagtgcctgaataatcaagggtggccttattttggagttgacatacagccttagcaatttatagacttacagtccctgtgcctggacaagtcttggaatatgattcctaaagtgcatgaggtattagtctgaggcaagcgggattaggcttcttggccataaaagaagtagtatccaggccgggcgtggtggctcatgcctataatcccagctctttgggaggccaaggcaggtggatcatgaggtcaagagatcgagaccatcctggccaaaatggtgaaaccccgtctctactaaaaatacaaaaattagccgggcgtgatggcgtgcacctgtagtcccagatactcaggaggctgaggcaggagaattgcttgaatccgggaggcagaggttgcagtgagctgagattgtgccactgcactccagcctggcaaaagagcgagactccgtctcaaaaaaaaaaaaaaagtagtatccagtaggtgctcatggagatacaggacaaaaagatttatttatttatgacacaaagttacaaccggagcatctggttagctgggttacatcttcgaatctctaagagtctcctctaggtagcaagtatctgtactatcactgtaggaaatgtgttgaattcaaatgtgggactagagtctgaataatagattgtaataattagtccttttttgtggcagagagggagagtagcaaagtcataggttgatttgtttaaggtcatttgttcctataggtgtaaatggagatgccattgactgtattttcctatggtcttattgcatgagactggaattgcctggaggattttatcatggggatccagtgatagacagtgtgttcagaaatcagtaagatcaaaggagtgggtactgtttgggataatctaagaatgagtattttctgaaccaaaaattataaagaagaggaaagaacagagaaaaagttccattatgagtggacaacaactaggactctacagaagatgagaagaatgatcacgtggaggtggatgaaaaacaaaaccagaattagacagggttcttggcccgctgccttgggtagaagctgtcccctatgtgaggtcatcagctgtgtgcttctgaaagctggcgacttctagaggatctctgagaatcctcccttgaggtcctattatggagtagccttccagttctgtggaattctgcattgcttctgtagttgtgaacccaggaattgactccttagaatttcactgctatatttattgctaacagtaccggataaggtctcttccaacaagattcaaaaacaggttttttttttctgattttttttttctcaatagacaagaagattataaagatgctatttaggacgatgttgtgggaagggggccttaacctgtttttgacaagctgggcatagtacatgattccgttgtaatattttgccacatctgtgtgcagcaggacagaactactagaattcgagatgaaatccctgaacacatgggccttccaattacccattcataggaggatagccaatgtgtccttgagggagtggattgcatggccataaggactaatggtagtacttttggccaagatgaaagagctgctgttagatcagcacctttaactcttgcatgttgttgaaggttatcttctcgtctagcctgaaatctcctacagtttaatcttttgtctgttggtatgactgtattatggtcaagtctattttaaaaaacatctggggtggctttattttatatccttccaataaatggggctaaatgttttcccaattaagagctaccaatgatctctgaaaaaccatgaaaagaggtggcaaatagtctgagtgaatattcctgaacttttacccaatagaaattgataattaatatcccatgatgtatgaccgatcttagctggtctacatttgctttttttttttttttaaaaaaaaaagaataatttcaacttttattgtagattcaaggggtacatgtgcaggtttgttacatgggtatattgagtgatacacaggtttggagtatgattgatcccgtcacccaggtactgagcatagtacccagtagatagtttttggtcaagtctacttttattggaaatgttttgggtatgacttttagaaaaatttgtcctaccttttacactttttttttttttttttttttaaagagagatggagtctctcctgggctcaagcaatactcctacctcaacctctttttttgtttttgtttttgtttttaactcctgggctcaaacagtcctcccatctcagctcttgattttttttaattgtgaaaagagaaattccatagatctttttctgggatagtccaattagcttttgctattcaggatttagattccaatcaatgtttgcagcttgataaagtttggtaaccctgagtcaaatgcactcaaaagaattatagattcttctataaatagtggctggtcttgtctaggattcttctataaatagttgctagctcttcattcagctcaagaccaaggtttaaattccacagtggtctgaatgcctggcccatgggtgggatggatctttaaatgcaagtggcatcttggggccttaggagagttgttgggaaaaggaagggagttttgacaaagagaagagttgagagaggtgcagaaggagatagatcaggataagggggaagagggcactgggtatagagaggcaactaaaagacaaggcgggggagaatttactagggaaatgaatctagtttgtgttatttaagattgttcaaataatcttttgtgaaccattttgaatcagaatgctgtttggaggcttctgcatgctaataaaaaaaaaaaaatgctgcccattgggcctgagcaatcttattccctttttcccctaagcccctttcaaataagcagttttgtttaaggctcatgttgcttagagtatccactgaagatgacattgatgaaatgaggtatgataggcacaataattaggattgtagtgacagtacatataagaagcaagagtttttttctggagaagaattagacttacatataatcccatgagaggtcccagcagttggtgaaagtgatgcttgtttgcttagtgtctcagagcccccacctcacaagtggatgccttcaaatgctgacctggcaatctgcgccctcccaacaagaaaaccagagaatgttctctctggattagagccaagctctcaggacagaaaatagagatggaaggagaatcctatccagttttattggtgagtcacagaaacgtttgtccaagtggatgctgatctggtgagaaccacagaattatcagtctgtaaagccggcttagacaacaggcttatagggcctgtgcctgtgttctaccctgtgattgtcttcatggcaaacaacacggagacagcacaatgcaaaatagaaggacaaaagggagcaaacatggatgaaaaggaatggcttgattcctccaaacaaatgggagccaataacaaaacctggtattaccaagaggaaaataaacagccaaagaactcaatgcccagagaatggaatcagacacagtgctaacttaccacgttgtcacagacctgacagcctgtgagagcctgcaaacagcaaggcacaaggggcctcatgggtgccactcctggttaagactagagtccatggtgataggcagtgtagattgtatctttggggggtgtccgggttaactggaaataaacaaagaccacccaaaggagaccaaacagatgctatttattcagagtttgctattgcaagagaggctgctgccatccttagtgtttggcagagactcaaaggcaggcagtggaatgggaaagctttttggacttcttacagtgaaaaagagaaggtttcggatacatgtgctgtgatcagaggttgctggcatgaggaagctggaggcgggctaactagaagcagagtatcttacatgattggtttggggagaatatttggttggaggaagggacaaaaagtaaggaagctggcagtcactgactaaaccctgatcattctgggcagattgctgcagaggttgtggcctggcttcccaggctggttgctgcagaggttgtaggtcagagttctgttatacatggtctggccatgtccatttgtatatttagtctctcagtaaatatgaactccaatctaatctaaccatgaattaactctaaatgaacaagagctggtctttactttcagaatttattccccagcaagtaagttctgtcaaggggcggataatgaacattttaggctttgcaggctagacaggctttgtcccaagtgcatgaaagcagacataggtaatacataaataaataggagtgtctgtgttccaattaaactttattattaacactggaatttgaattttatataatttctgtgtgtcatgaaataacatactattgtgttttttccaagcatttaaaaatttaaaaacattcttagcttgtggaccatacaaaacaggtgatgggttggatttggccctttggccatggtttgccaatccctgctctggtagaggatagataacaaatgcagccatgcatcacttaatgactggatatattctgagaaacgtgttgttagctgattttgtcattgtgcaaacgttgtcgagtgtacttacacaaacctagttggtagagccttctacacacctaggctatatgagataacctattgctcctaggctacaaacctgtatagcaggttactgtactgaatactgtaggcaattgtaacgtagtgattagtatttaagtgtctgaacatatcaaaatatagataagatataggaaaaatacagtctataatctgatgagaccattgtcttatatacagtcactgattaaaatgtcattatgcagcacatgactgtactcacatcagtgtaatagagcaacagcagcagtaaaaataatagccgccaatcattgatgaaacacttaggtcagaatactgggtatcagacattgttttaaacacttcatgtaaattatctcatttacttttttgataaccttatgaagtaaataacattattatcccattgttccgatgaggaaacataggctatgagaggtacttggtgagtggtggaactccagcagtcttcctgcagagtccctggttgcatcattaagctctttgggccaccagcatcataagcacagacattcatgtggccagaggctcacccagcgaagaagaatgcaggcagtactgagtgcccagggtcccttctggcattccaccaccatgtgttatgagccccaacgggagaagattaaggcttatatcttatttttatcttgcttaaagttttaacattttaaaaatggcaattattcttctcttatggatacaaaagtagcacaaagcaaagttctaataaaaatttgggaaatgtaggaaagctcagaaaacaggatcccctgcatcttgccatccagaggtaatctctgttagcagttaggagaatcttcctctgcctttctcctacattagtattgtatgtacatattgtacatttgtaacagcttatttaaatagagttaatacagttcacccatttaaagtgaacaattcaatggtttttggtatgttacattattaattttttaaaattgtgtttatatatgtgtaacataacatttgacataaaatttttaaccattttaagtgtgcaatctaatggtattaattacattcacagtgttgtacagctattgacagctcgacactatttttcaagctttgttatcaccgcatacgggagctctctaaccacttagcaatagctctccatttcccaatcccccagcccctagtaactttcaatttacttttttgagtctatgaatttcctgttccaggtatttcatacaagtggaagcatatactatttgccccttctctgacaggcttattcacttagtgtgaatgtacatgttgctctgtagtctacttttaaatttagcagcatattatgagaatgaacttggttaggcagaggctaggccacggagctggactgagttttataaaccatgctaaagaatttggattttgttttgtaagcaatgagggaatattaaagttttttattctccattcccttgctttccttcccttcctaccctccttcccttccttcccttcccctccccctttccctttccctttccctttctttttcccttcctccctccctctctccctccctccctccctttctccctccctcccttcttccctctttccttctttcaacaagagtatgagatgagatttttgttttggaaagagcactctagcacaggtatatagactaaagcatggaagactaatttgtagttttgcccaatttgacttttaaagttacattgatagattaaatacttttctatttaaagtgaagcacaagtcactctgtattcacccttttttcaatacaaagaaaattgacactcaggtagttactctggtcactagaagaaacatgtggtgttgctgtgtcactgccctatttgcttctgcttctcactgtataaattctccttttcactaattcagtcatgtacaccttgtttgtacaaattggatttcgagctactttggataaggatactggtttattttatctttccctcctatgtcctaccatgtctagtgccagagttggcaggcatgagtatttgattaattgatttgaaaatagggcttaaattctaagattgaaatactgtatgtttattttttatgtggtgaatggcttgttcaaattgaaattcagcagatctatttttgtttttaaattatggtcattttgattcatcaggagtttattcctaagctttgattatgcatttaatctatttctcattgcattcctttccatcttgatccattgtttctctattctttactttattaccatccacagattcacttctttatttccttctatatcataaaagtatcatgaggaaatgatgctcattatactgctgcatagtctgactaccatttgtttctgcatgtggctgtcctaaaaaccaattgcaactatcctgtgtacccctcccaaaggagaccaggtgatgaggagccaatatcctcaattgatgggtctgccaattgctggatagcattttgagaagtctagaaagctcaggctcagaaatgcaagaaagacactacaataacagaggaggtgtctccttccagctattggacagtttccagaacaaggtccctctctgctctaacacagtgtgaggatggcatctgtcaggaagagcccactgtcatttctttgctgatgtaaatagctaattgtcccttctgaataggcttgtatgtaattgttcctgtattttcataagaggcaagataatttgaggcacactggaaacacccataaaacaggagcaggcgctgagagtgcagctgaaaggggccatccatccaccaccaaaatcaataattcggagtattccagaactagagtgtggctgctttatctcccatttacttctccttatctctttccttccccaacatgggtttgaatccactggtgaaagaaggggctggtttatctgaggacttggatagtagaccctggcaaaagcagcatcttggaatgggaaggtgtgatgtacccttgttccaccacttccctctctctcctaccaatgtgttatgtgaatctaaaggtgttttccttattttggcccgttttccttatctataaaacaggaagttggataaaatgatctctgaggaaccttgaagctctaacacttaaaattcctccttgatttcctagtagcttgatctgtggatcagccttctttcccttcctccctcccttcctccgtctctctggctttggtcaaccaatgtccttcctttcatttagcaggagatatagtgttcattctctaccttgtcttaccgggaaatttcctgaatccttcagacagaggattggctgagctttaagcctctgcctccatcaatgggaaggtatggccttcctttctgtttaagtggcatgtgtaattaaaacagtgtttctgggagaacatttgattcctaagtatgagtcatgacttggagccagcatcatgggagcaatagtgaagattacaaggaagttgtgctgttactgcaggtctcagtgtttcctgggttgtaccctggcacccatgcctgtgtatgatttacgatgcatctcccaggggaaaatgcagaaaaccaccttgtgggcctaacccctgtccctgcagtaatatgaaccatctctactactcaagttggcttggctgccatcatctgctcttactgatggtgcctgatggcccttctgatgtccttgggtgtattccatggtccaatggccttatctctaaaacagacttagtgtgtttgtttttattttttggttgctttcaatttcttacccctcttagtgcagctccccttaaaacatagaatattgagtcttgaccatttatattttgggttctgttgatctctgctggaggtcttgtgctaatctccatcattttcacttttgaaattttctctcgctttttcttactttatgtatgtttttggattcctctgttttcacttcagaatcctaaatattgaggatccttaattgctttctctagtaggctgttttgcctcattggaactcttgaacagacatcatcttttcttcatgtttcatgtcagacttggacgtccttgtctcccaggatgtccccaccccatgagtgtgccttcagctcatcccattgtttttattcctcatcttctttaatccgtcctggtgcagcagctgcctcacccacctctttttgcctgaaatttgtctacagaagcttccccactctccatagcacgtcagacaaaaattttcacaatcagcccctggtctttctcttcagcccggttctagttctctcacagttcagttacgtatctcccaccttaccaccttcaacatgcgaggatctttcctacctctgtgcttctgtttgcatgactaccccaatagtggatgcccatttccctcttttctggctgatgaactctttttatttttatttacttgtttatttatttttgagatggagtctcactctgtcacccaggttggagtgtagtggtgcaatctcagctcactgcaacctctgcctcctggtttcaagtgattctcctatctcagcctcctgagtagctgggattacatgcctatgccaccatgcttggctaatttttgtatttttagtacatatggggtttcaccatgttggccaagctggtcttgaactcctgacctcaaatgatctgcctgccttggcctcccaagatgttgggattacaggcgtgagccactgtggctggccttctggttggtaaacttactcatccttcagtacacaactcttatattgctgcttctgtgaagctttctctgctgctgggttgagacctttcctccttggagctcccaaaacacattgttttagccttggagagcatgttttcacattgtatcatcattacttgcttttgtctttccttcccattagacaatatgctccttgagggcaagagccaacctcggtttctatatacagggccccacacctgccagagtctagagaagtagaagggactattaagaagacttttgttggccgggcatggtggctcatgcttgtaatcccagcactttgggaggctgaggcaggcggatcacaaggtcaggagatcaagacggtgaaaccccatctctactaaaaatgcaaaaagttagccaggtgtggtggtgggtgcctgtagtcccagctactcaagaatggcgtaaacccaggaggcggagcttgcagtgagccaagatcacctcactgcactccagcctgggtgacagaacgagactccgtctcaaaaaaaaaaaaaaaaaaaaagatttttgttactattgagggtaggattcaagtcctaacttaccattaattggctgctatggtttggatatttgacccatccaaatttcatgttgaaatttatttgaaggtggggcctaaggggaggtgtttagattgtggaggcaaatctgtcatgaatagcttggtgctgtcctcacagtaatgagtaagttctcactctgttagttttcatgagagctggttgtttaaaaaagcctggcacctccatcctctctctcttgcttcctttcttgccacgtgatctgcatatgcagctccccgttgccttcccccatgggtggaatcttctagaggctctcatcagatgcagatgctggcaccatgcttcttttacagagtacagaaccatgagtcgaataaacctcttttctttataaatcacccagtctcaggtattactttatagcaacacaaatggactaagacactggccatgtggccttgggcaagtcactttgtcttggtttcctgttctgtctaatgggaataataatgtctattttgtacactggttctaagaattagagacaacaacattgagcagttaatagaatatttgttgtagagcagctgacagagtttgtttattgtatgaatgattgtcagtcaagtggttctgctttttaatcactttctctgctttcctgttctcctaggcctttctttttcatttttgcttttcttcctgatcttatttctaagctgtatattcttggcatgggtaatcatattcatttgtgggagggtgacaagaagtagagaaaggaaaaaggaaattgagaagttgccttcatttggacagtgatgatccagttttaacttgacagttgttctgtgatagactccccactctggttagatacatgaggcatgatgatattgtgatggggcttttagcagatatgccagattttgcacatgtgtacacttttgcaaattcatgcacacgtacacacatgttaaaatacatttctgtcaactgagttagccccttaagtgtcaccttaggccatctaccctacccagtgattttattgctctgcaattttattgcttttcattctctttcagctcttcttccagaattgcatattctttaggatcacctcagtgatgacaagtcagcattaatagtgacactaagaataataacctacaggtattgaatccttacaaggagtcaagtagtatattaaacgtcttacatggattatctcacttcatcctcacaacaagctcatgaggcaagcaccattatcccatattgcagatgaggataccaaggcttggagagactacagatttgcccacatccacagttactaagtggcagagttgagatttgaactgaggaatctggctttaggccccctggcctaagccaccagcctgagtgtgtatctgttgcacatttttggatgttattgccttttagaaaccaagctatgtgtggtcagttaggtgatagttgcattacgtaccacactgactatgtaagctagattgaagtaggcttttgacctattaactatttcatacacttaattgcagacctaaaaaaaactcagaagaccacctctgtaggcatttccaacataattatgtcatagtgcctcttctacttcatgctaggaactatttggaagtttaaaagaatatgtatggaaagtaaaacaacagacactatgataattattccatttcatgtggtttaaaaataaaatatataagaggaaagagaggaggatggggactagtgcttgggtcagtcactttagaaatattgttcggtgtaatcagaaacctatgccatagtcatttctgttctcatgttctagatgaggaacctgaggattactaaggttcaagttcattccaacaataaactcattttctgactctgaaactcatgtatgcgccactggaaaacatatcaacccacagggagagcaaggattgattactttgttatcaggacccattccccctttctctgcttagccggtatggggcttgtctttatccattatttgcacaattagggcagaaggagtctggtggaaaaggaaacattataaggatgatgtcgtttgatgtggcaggttggtgcctcagaatagattcaggcacacctggagtgggggccataaatggaagaggctctgtgaagtgatttccttgaggcttgcagtatttatttagacttttaaaaattatgttatgggatatgacatactagatcattcattccagtggatgtaatggctcattaaagtttaacaatggaatatgaaatcaggcgttttgcaatggcccttgatctttagttagctgaatatgatttctgcttgtttaaagccattagcggtacactctgtaggtctgactgccagtctgtgagacccacgtcagaagccagaggctgcagcaaccctgtaactttctcctgtggacacacatgggcagcagagcatccaggagaccaggaccctgtgctgggagctcaagctgaagaggtgccagctccagctgtagtcagcctgggcctatgcaggctgtagaggtggaagttgtggttgttaagtcagactgcctgggatcaagttccaggccacacctcactgctggggcaagcttgtgaagttccttcacttctcaaagctcattggctcacgtgagaatagaaattaatggcctctgccttgtgtaaggattgttgtgaggtctttgggaagagtctggcttctaacaggcccccagtaaaggttgctgttactgtgggtaagtccagagctgtgtgcactggggtgagaggagaactgctaaggggcttagagccctttgactctatgcaggaggatgtttcatacagaaacatagatttttcattttgaaatatagaagcatggctgcttttgcactacaatgacaggcagagttgagaggttgcagtagagaatgtgaggcctgcaaaaaatatttactatctgcttgtttacagaagagttggctgacccctgatttcatgcctaaactctactgtcagacagttgtgggtttgtgttccagctccattatttattagctgtgaaatctgggcaagatgcttttccttagagtctcagtttgctcatcaataaagtgggggtagtgatatttacccagcataggaaaattaaaccagatcagttatgtgaaatgttgggcatggtacctggagtatcatctgagctcaacaaacagctgctctgatgtctggtatccagagaatattgtgagactgtgttagctggagttggtcagggttagcttcttagaggaggttcacttggatttggaccacagaattgtggagaatgcgtaaaatctgggtatgtaggcaccaggaaaggaaggaaaggccagaataaaggccttacatgtgagagtagatgcttgaccagtgtaggtggaatgaatcaagagagggctaactcctgggaggtattgaggtctgagctcaggagtcggatgtgaatgaatgaacgacagggtatagtcagatgccaactacatgccaactcaaactttgaaccaggccttagccaggggctccgtccacctacatgagcttaccaaccttatagaaccaggccaatgctcagatgaacttcagcccaggccactttaccccaggccctcgtacatacctgtattactgttttctgatgctatttggcccagagagcttgggagaaatgtttaaatcagcctaggaaaattgtatttgagaagtcagatttttcatttcaaaaaacaacctctggtggattctaaatgtgactattagtgactttggtgttctccactgctttgaatctctcacatcccccttaaaaataatctgggactgattgtataaaatggccattgtttttcacaaccagcttggatttgattctttgagaggtaggacacagcaggagctaatggccttggttttctagccctgctgacctgctgggttgtgaggccgtctgattcaccgggcttctgtatatggtctcactaattgggtgtaatcaagattctcctgaggaatttcagagaccctgtggtcctgtccagtctgattcatcacctctccatggaaagtacggtgctggagcagacagaacaatttcagagccttctcagcagtgtaggcaggtcccaaaggtttcaagttattctgggattcaatggacttgttttttgtttatctgagagggaaagaggaaccagactttaccctaagattgagtcatagaggtgtggaaatacacaatgcaatatttgcctacattgtacaaaattcattggatggaggagtcatctgactcatcgtctggaatatgagtttaaatttctgtatgttgaaaagtgaaataggctgggtgtcgtggcgcacgctgtaatcccagcactgtgggaggctgagacaggaggatcgcttgagtgcagaaattcaagaccagtgtgggcaacatgggaagatcctgtctttacaaaaaaaattatccgagcatgatgtgcatgcctgtggtctcagctactcaggaggctgaggtgggaagatcacttgggcctgggaggtcgaggttgcagtgagctgtgatcacgtcactgcactccagcctgggtgacagagtgagaatgtgttaaaaaaaaaaaagaaagaaaaaagaaaaagaaaaagaaaacaagaaaaaaaaaggtgaaataatagctccttttccttcttagaattatagtgtgttctcatcttaatatacacataactcccacttgtgctaacaaacaacaggggctcattcatcattcagcaaatatatctgatgtgcttcagaacaatgttctcttcactcacaatgatttgtgattaaaaaagaaaaggatcatttttggaccctagttcatttgcatgcccttgcctttgtttaaggggagagtggttgcattaggaaataggcaccttccagtccttggcatttgatgatgtttctgtatctccctatttgtctcaattctgcatattgtttcatttatctgatttttctaaaccagagatttatttgctaattcaaacatacaggtgccggaggctgctggggagggctgtgttaactccagaagtaaattagccttcagtaaattcaaactagaagttcttaatttggagggaatgtgttaatcattgaataactaggtcttgtagaagtaaagcctagaatttctttgaaataaatttcaattcaaaaagtatctcttggacacttcccgtgtttgggaacttaggcataggctgggaaaggtggagtgacatgggtatcatgtagttcctgctctgatggcatagaggtttatcttggagagttaggacaaatatgtatgagagaagtagagcattttacagtgatacatattaggatttctcaagatcagtaccattgatactttgggctggataatcccttgttatgggggactgccctgtgcattgtaagaggtctagcggcatccctggcctctacctactagatgccattagcaccccctccctaaccatgacaataaaaaatgtatccagacagtgccagatgtctcctgggagcaaaattgcccctgtttgagaattgctgatgtacattacaatccaggtaccaaaagaatgtggcagtggcaactggtgcccagcgaagagccatgtaggaagggctgtgaggctctgcgaatggtcgccaatccccattgtctgtggagagaataaatgcttgcacatgtacatacagctttttgcaaatgtttgtagatactagtgtgttggaaaattgtatttaaaactgttactggattcaaagtagcttttagctattttgtattttctcattcagaagatcgtaaaaatgtaactggtgatatctaagtgcctgggctagctttgagtgtgggctctggagtcaggctgcctgattcctgccacttattagctatctgactttgggtgagtgtcttagcctctctatgcctcagttttcccattggtaaaattggaataatatgtacccttaatttattatcattataaggattaaatgagatattgcatatttggtttccagtatagtgagtaaaatatagtaagcatttaatacatgacagctattattatttctttatatatatatatatattttattatacgttaagttctagggtacatgtgcacaacgtgagggtttgttacatatgtatacatgtgccatgttggcgtgctgcacccattaactcatcatttacattaggtatacctcctaatgctatccctcccccctccccccaccccacaacaggccctggtgtgtgatgttcccctccctgtgtccaagtgttctcattgttcaattcccacctatgagtgagaacatgtggtgtttggttttttgtccttgcgatagtttgcttagaatgatggtttccagcttcatccatgtccctataaaggacatgaactcatcattttttatggctgcatagtattccatggtgtatatgtgccacattttcttaatccagtgtatcactgatggacatttgggttggttccttttgggggatatttagttttctgacactcaaattctcgaagccattactttagattttaagtgctatgagatcagaatggagagagagagaggagagcctccttgggacagcttcatgaaagagattgaactgagagggatggatgggttgtagatctatatttgcatacaattcagtatctagttgcttaggccatgggaccataggaggtaagaaagcaggtctaagggtttctaacttttggagactaaatgaaaatggatgtggtgaaacaggctctaaggacccttctaacagactctaacagaccccatgacccttgcctcctagactcatgcctttttgtgatcctctgccctgaggcaggctctgtgacttgcttctaaccagtagaatatggcaaatgtgatagtatgcacatgatcatgttacgtaagattgtaatgtctggcttggaaggagtttcttttttttgccagatttgaagaagaaagctgccacattgttagctgcctatggagagggctatgtggcaaagagggtagggtaatctccaatcaaaagcaagcaagaaactagggccctcagtctggcagtctgcaaagtactgaatggtgccaacaaccatgtgacctaggaaatggagccttccccagttgaacttcagacgaaaacccaaccctgcctgacaccttgattacacccttgcagaggaactggctaagtcatatttagactcctgatccacagaaactgaaataaatatttgtgtgttgttttaactgctagatttgtggtaatatccttatgtagcaatatataactaatacagtgggtgcaacacagagacaccaatgactaggacctccagacaaagacactttaaattcaacatgttcaagtctgagcttgccacctccccgcaatcttgtcctgtgtcctctgttcttagggaatgtctccagcatcctagctgtaccacaatcaaatcacacactttgaggccattcttcttttgtcttctttgtaacccctgtacaaatcagtgccaaatgcctactgatgctgtctcctaagtgtctcttaacttggtttcctctttttcactttcccccatccccaccttagtttaggttttaatatttctagcctagataatacagtagtctcttgacctgcctccagtctaaatatctttccacgctgttatctacattgtctctagatttttattttttaatgttaatctggacatgtaattatccggataatgaatcttgaatggctttccattcctttcaggataaaatgtaaagatctcattgtggcatgcaaaaccctgtccctggtaatctctccagccttccttccacttctttccttggttattctccacttcaagactcacatgtcacatccaagaagccttcctctactccctgtatctcatgcttagttcctaaagtccccattatgaggactattcattgacttattacgtgtctgtaattgcccagcagattgtgagtttcttaagggcagagactatgtctggttccctacagtatctccatcttctgttgatgagtcatagtagggtctcagtaaatgttggctgcatgcatgcatgtatgcatgaatgaatgaatggatggatacacatgccagagctacatctgtgcactagttctctaggcactctgccacctcctccaacaaacctccccaaaatagttctcctgcctttctgagtgtgaacctccttcctcttcacatctgtcacttcaagtgtggttctacagaatttggaagagaacatgtaatgagctgcttagttttctgggttgttagttttctttctttctttttctttttttctttctgtctctctttccctttctttcaggtgatgatgccctgccctgtatcagtgtcaagcttaaacttttcatgggtatggtctataaatgaaattttgttacagagattttccctttgctgatcttactgcaagttatgttatttcaaatatgaaaagaaagaaaaaggatgcgtacaaatggtcagttattttatgtcatctagtagttctgcttaattttccttcgcagtgttctgttacaaggggagtcattttgcctgtcaaatacccctagttttatcttccactgggaaagttttttttcttcttttttagaatgaatgttttaaagaattgctctgtttcttcatctgttaaatggggttgttagtttacctaggctgctgtaacaaaatattattaaataccattaatagtatcatcctttttctttcctctgtctgcctctccctctcctccaccccagggcaggctttggaactaggcggacctgaagttcaattctggctatccctcttcctagcaaggtgaccttgggcttgaactctctaagcttttgtagtctcacctgtaaaatttacataaagcctgcttcatagggttgctgagagtattgaataagagaaagcagataaagcactttgcaccaagactgaatgtgtaagtccatgataaacatcagctgccactccaacagcatgagaatcatggcctttttgccactctggattgttccagttggttccttttctattgatcctagtgtactgcctgtttccatgctctccttttttacttggctccagtctgttctggcttttgacaagttgcactgtcccttgaaggccttctttgagcaatgggctcatggactcttcttcatttctttaatgcatctctctcttcagcatttggtgtctctaccatgagcatttcactgtatatatatatatatatcctcttcttttccaagtgcctttgatttgtcttcatactggaatttcctgagtttgagctgtaaactttaaaatcaaccaggttggttagaattttgtgtcaagtaagagtcaacagactgaagatacaataggtctccatggagtctttaggcatggcctactatatgaataaggctcatatgccaaccgtgtgaactctgcagaggccatttacaaattcctttttggctcttggaaagtgaggttgcagattttagataggccagcttctattgtagttgacaataagcccctgttgaagctaaacaaaacagttggctgtgaaaaattttatttttttccttctgcactaataacacacagtgacatgttgggataaggaatatgaaattatatccacctcctgtcccccaaattctagcatcagtgatattgctttgtcccccagcaggtagatttggacgttgttctgggctagacatttcttctttttaagttttattttagtttcaggggtatatgtgcctgtttgttctataggcatattgcatgtcacaggggtgtacatattatttcatcatccaggtaataagcatagtacctgataggtagtttttctttttttctttttttttttttgagacggagtcttgctgtctcgcccaggctggagtgcaatggcgtggtctctgctcactgcaacctccacctcctgggttcaagcgattctcctgcctcagcttcctgagtagctgggattacaggtgcctgccaccaagcctggctaatttttgtgtttttgtatttttagtagagatggggtttcaccatgttggccaggttggtctcgaactgctgaccttgtgatctgcctgtctcggcctcccaaaatgctgggattacaggcgtgagccacgcgcctggcccctgataggtagtttttcgatcctcatcctcctcccaccctcaaccctcaagtaggccctgctgtctattgttccctttagacttttcaggagcaggcatcatactgctttggagtttgctctgaggctgagtaaagtgtgattgggaaatatagctaagcttttaaaagggcatagtttcttagttcacatctggtaattatagagccagcgtgtctttctcttagagattgggtaattgtatgtggagggttggtgggggtaagtgggtgtgtgcccttatttgtagccaatggttcacttattcaaatgatgccttctccattttggagccttaggtgttcgtgagatgagcagagggtaatttatcaccggatcaagccctaatttcgttgtcaccattttggtgtgtgtacaccaggcctgctctatttgtgtcatttagaactccagaacaaactgttctgtaaatattacttaaaaaataatgtagcactaccaccttcttctaaaataaactctaaaagctttgctttagagagctattttcttctgttaatttttttaagttgaatcacagattttttgagggtttaaatcaggtagcatcttctgttactaaattctttctttctttctttccttctttctttccttctttctttctttccttccttccttccttccttccttccttccttccttccttccttccttctttccttccttccttccttccttccttccttccttcctttctttcattttggtggtatcttagaaaagtggtagggtaaagaatcctgtttaccttgggtttgctattatttattggagctctgtaggtggctactaataaatagtttcaatcgtcaaatctttgtcaagaaaatggactatattgggtccatttggggctggtatagagagtggtagcaaagagggcatgcaggcaggatgaggcaagtttcatttaacctgcacagagtgttcaataaaatataaccaatgtttaagaacctgcagatttcacatagaaatcttgacataaagttgtatatatttaatttataaatacataattattaaatattaaatattgtagtatatataaaattaatttatatatatttataaataaaaatatatatatttgcctcccttgaaaaattgaagatctagcatctagacagcacgcacactctgtagtccccactggccccaccacccaacatttctctctgactttgaggctgaatgtagttgcagtatgcaatcaagatatgatggtgttggaattccagaattcttgtgcctggcccagagtttttttcctggtggacatttcagtccataatctctggcctgaaaaaaggacccaaagctctcctgatgcacagcctttttggcagattggttcttgggcttttgtgatggagaattagaaggaaaggaagagggaagcaagacagaagggaaggagaagctaagggtagaaggaatttagggggatggagctttttaggtgtctggcctgggaacagctgtagtatttgagaacaacagatgggattttaagcaaaattgagaattatgtgtccactccatagtgttcaagaaatacaaacacggatttggcttatttttgaaattgctggactatgtatcagtcagggctgagttagagacagaagctacaccaattacttcaacagagagcatttaatatttaaaattattaaccagatattagagaactgagaaggcagtaagacaacactaaggaatcatggaaagtagcaactgcaggaggcatttgccattcctggggttaggattattaaaatttagaagcttgtaggaagggccaagtggggctgaacttatatctccaaggtgatagctagtgctagggcctctgagctcaagaggagggtagttgagggcctggtacccagacctctgagagttggtactgtccaggtggtgttggaatctctgaagtctggtaagaggcaggctgggattgggggtctttaaggcaacacaatgaggctggttccagaaagaactgcaaactggattcagcagctgccacagaaaggaagtggggttgctagagtgaggaagcgtggctgggtcacgctcacaggggcaggaagccaataggaatcagacagggaggaacgggccaagccttcctcctccagcctcccagctttcctccagcgccccctataggcagaacctaacaggaagcagctgacaaagcagagatgtggttcacagagcaccagccctagcatcacaaagatggcatgaaaaagtgggtttggagctgggagacagtagcttaattaccagctcagtgttgtttcgactaccatggtattttgagtctcaactgtggagggctttacaagcactacacaaacatacgtggttccagttttgcaaacataatttagcagagtttggttcttgtggtctccaggttttcatcttgtctaacaccaattcccagtttgggattaaattgctgatttctttgtaatacactgcaagttagtatttgctgtggtttgaatgtgcccctccaaaattcatgttttggaaacttaatccccagtgcaacagtgttgagaggtagggcctaatggaagatgtttaggtcatgcaggctcctcccttatgaatggattaatgccgattataaaagggtttgtggctgtgaactccatctcgtgctctcccctgctctctccttgccctttctccattggaggatgcagcaagaatgccctttctagatactggcctctacatattggacgtcccagtctccagaacggtgagaaataaatttcttctctttataaattacccattctgtggtgttctgttataacaacagcaaatagactaagacagtattgttatgaactgatttttgcctttgctgcaagagttgacaaactgtatagcccattggtcaggtttggcttgatgcatatttatgtaaataaagttttattagaatacatccatgcctattcattcaccagaaaagatttgcagaccccttctctagtgtaaattttagtttctttttagttctgatttcagagccacataaactttttttctttgtaaattacccagccttgggtattccttcatagcaacataaaaatggactaatacaaggtcttatgtttaagtttttaatccattttgagttgatttttatatatggtgtgatatgataaatattattttaataatcacattaagttggccaacatcagtttttaaaatgttccagttggcaagtagaaatttaaaaaaatgtgacacagccatggagaccatattttagtcattttagtctctaaaaatgtgttagcaaattcataaagggcagctcttttaatatatatatagcgtgtcctttttattcaaagtgttacactgaattcctttccatagagattcctgtaacataagaagccaaaatggaatggatgaagtgtatcaaaagcctcaaaaatattcatatcctatgacccagggattcatctcctgggatgatgtccctttgggtggttttggcttccccaggttagttaaggggtagatctctgaaatgtaaatacagtgagactttgaaagttgtgctagattactttcttctccccttggtctggcacagccaacaggtggggtatgaagtaacacagtcttctcagggcctcatgcctgataaaccctgcacactccatgacatatgcttacagattgcatgcatgtgtttgctcaaccatcccacaatattcctaagtgtgggcatgcatgtggggattaggttatccaagacagcggaaacctcaatactgctctgatgccctttctaccaccctcatatgtgatcactacagaaccttacagctgagccctgccactagtttctgcgcacttttctttactggtatcattgttgtctttcactccccagctctgtagtcttcctctttgtataaatgtttcattatttttgaagtaggcaatctagcctcacctctgcagtccccccagtgacgttttctctttcaccatacaaatggtggtcttcataaactaaccattttcctcagttgtcccaggaacagacagagtgaactataagcacctgagttttactttcatatcccctgcaacttctctgggtagtgtttggcccaatgcttgccctttcaaccagactgtaagccccatcagagtagggctatgcctgtcttttttagtgttgtgtctccagggcctggcggagagtagatggtcaataaaagctgttgaacgaatgattgaacaaaacacattaaaggcaagcctatattcagactttgttgttttcagggagggtaaaccagatccttacagtgtctggtctgggtcagctatgggcctgctgcctatttctgtaaataaagttttattggaatatagccatgcccattcatttaccagaagagacttggggacttcttttctagtgtaaatattagtttttctttagttctgatttcagtgccataaatacctcttttctttataagttagccagccttgggtattccccaagcttggtgctgtaagtggtcttgctgaggaagaacatgtagattaggaactggtacattggttttcattgacacatccaacgaggatgtgttgtatatctcccgttttttcctgtagcagatgctgtgcttagaattggaaaacatagccttgtcctgagacacctaatggtgaatagaagataaactattgtgatctgtggcatatagtaggcactcagtcattgttcggtgaatgatccaccattaccagagcatgaggccatcaactgatgttccattagtggaaatgctccaattctgattccttatttgattggggttgatggaatgttgggggtggcttgctaacggaaaagaagctatcaaagaaataaataaatttacctggtaaatgcatagtatatgggtgtcaggtccaccctttcttagaggatgatgttttttccttgtcactcctcggggttttggtgtggcgggtgaggaactcctggctcctggctcttcaccctgagcaatggtgcagacactgattaaagacagacctgagggcacttcgttacagtaattgtgagctttgtgctcaacagaccatctgaagacatgtcgctgttaggttctctcagtgtgctaattggggacggtggagaatgaggaggaggaggagggaaggtgtttgccagggcaatggagggctggttgtgctccagggctaaagggctcaagtagccagcttaacctaggttattatacattctgccaggcctgccttggcccttttctcacgtttgttttctttgctttccttcttgccactttttccaggagatgtgagcaaatgaaatcctatttattttacaaatgtaaaaagatattttgtttaatatggcatttgaaacatccgtctgcctctctctgcctgtttactctgataaatcctagtaacataggcataggtgggtgaggagccaggggtcgtgcagtatattctctgggggaaaagaatgttaaatttcaacagaaaggattattcaaataagtaatcctttctttgttgttattgaattctttagtctagcgttatattgtggcttctgaaaacaacagaatttgtgaaggtaacaagggcaagactttgtgaagaaaggaaatttatgatttaaaaaactgaactttacaataaggaatggtaatttaatttagacaagtctgctttgtgtcctgtcctttgctgtttgttcagtgaacattctggtgcacttactagaagccagacacgtttggtcctctatgagcttacagtcttttaggggagcaagtcatattaactaaaaattaaaatttgataattggataattatttattttagagatgaagtctcactttttgccgaggctggaatgcagtaaggtgatcatagctcactgcagccttaaactcttgggctcaagagatcctcctgcttcagccttctgagtagctggaattacagatctatggcaccacacctggctaattttttttttttaattttgaagcaatcctcctacttttgcctccgaaagcatagagattacaggcataacccattgtgcctagcctaaaatttgataattatcgattaagtgcttattttggtgtaggcattggggacacaatggtaagcaggacttgtggagtttcattctaatggggaaatgttgggtgtggagcttcttacacagcctggtgtgtgtgtgtgtgtttgtgtatgtgtgtattgcctgtgtgtgtttgtgtgtgtgtgtgtgtgagagagagagagagagagagagagaaagagagagagatcctaaaaggctgcccaaaggaggtggttctttaaggacaaatccaaatgaacctggttgagagagaaggaatattcaacctgatggtgggaaaggttggtatgggtctgtcaagtctttagatgtgatgaagatcaaaaggaagggatgtgattagccctggcttgaatggggtgagagagaagatcaggcagagacaggctgaggggcttgaacttcatcagaataaatgcccctttcctggagaactcatttatcttccatgagctaaaagacaagccttgtaggagggatcattttctcatcccacagaccatcatttctcagattcttaatgacttctctctactccactctattcggttttatattccattgtattcctctttcttcaattaaaaattgttccaaaaagggtgaggtctagaatatatgaatgagtaatcactctctcctcggcagtgcctgacacacacctggcagaatcatgtgacagttctccttccctactgaagtgttagtcctctgagagcagggctagactgtttcatttctgtgtccatcctggtacactctggtgataaaaatgtgtgttgaatgctatataggagcacactcaaggatttgacatgggttcttcagaagtctgtggttatggtcaattttcaaatggaaattgaagtgcttagccgaatagctggcatatggcaaatgtctgatgaatggtaatttcctacctatttaaatcaaaagctgtatcactagggatatttgttattatggaatctaacactgaaattacttagtgaatttactggcataacttagtgaatgaagtgttacgtgtttttgtgatcacagtatttcattgtatgaatttattctgagttctgtgatggcaataagtagtattcttggtttgaaaccagagtaagaaggggcttgtgcagcatttataaaatggtctgggacatttgagctaaaatttctgctgggttactcccagcctcagactgctggaaagagagttgcctgaaaagctggattctatgttcctcacatgaagggagaggcagggtgggagggttgccactgcaggtttgcagaatgcagagtgataaatgagcaggttctaagatcattggtaataggaccacatgcttgcttccctttggcaccctgcctctccagccagcctgcaggagtgtctggcttggtgggcagcatgggctacagaaaataccttcataagcctcccaggatgcccttccctgagatctcgaatcctgcatgtggtccagaggtaggtgatgccctgcttaggaaacagaaataaaaggtttaccctgtgttttcagggatcaccaataattagaagccaagtagttgcaatgaggggtctttccttgggaaagcaatgttctggaggctgaatgaatgactcaggaattgctaacaggattactggggcttctgggcacagtgggatgatatctggtgatagagagcttgggggtctcagaatggactgatatatctggttcttttcttttagttttttttttttgcccctaaaagattggcaagctcatgactcaagccattcacagagggtcattcttatctgtggtgggtgttgcaaatggggacaaataaacctttcatcccaacaggtagttctgtctctcatgctaacaggaagctggaccctttgaggattctctattgctctgcataacttctgcttcttcaaaatggaaggcttggctcccaggggctcaggtcccagtgccctgtttttaattggcagaatatctcctaagccaacagtgatacattgtgtctgttcccagaatgacttttattataggtttccagagctctactccagccccaaccagttcaccttagaatagcctttgtaagatggaggaaggtggagggggcaggaaggagacagtctccaataatagatctcatccctttaaaataaccatgacctgtcacattaagtattaattgcaaatctgttttaatttttaaataacagtcagttctttaaagatttacaccgactcatctaagctcaataagataaaatttaaaacagaggaagaaggatcaacttctgggtaccattcagtgagctaaattagtttcaggattttttcccccccaaagaagtggaacatttatttttaggacttagatactttttttttcttttgaaaactgctcagaagtagcacaggtctatcttgggaggaggtctttctccttttactgttttcttgtaggcagcaataggttttaatttttgcaccatatagagagaaggagatacttataactataaatctggctcattgttgaggataagctataaaggaagatgtctgttgagtatttggagcatctgttttactattaaaaagtttccttggttgtcctcagggcacgagtttggtgccaccttgtgggcaattgtcagacgattatgcatgctgttaaaagaaaacttgccccaaggctgctaataatgcttaaaaatatgctctgtaaattagtgagattaaacacacacacacacacacacacacacacacacacacattcactctctctctctctctcacacacaaacacacacacaccctcaatgattctctcccactaggtttgcacagcttcatcttagaagcaatattgctacctaatttcaggaaacacctgcctttatcttaagggattttgataccctgctgaggtacaagtgctttatcactggtgggaaacttgtctgggtgtctgcattcattttttaagcctgtgttttaaacacattttaacattgttatctttatttaattttaagctaaatactaggtatctatcaggatatatcattttaatgatagtatttaatgctgtccttatcagagataatataataaagtcaaaacagattactcccaaaataatattgggcatgttcagatatgagaaatccatgttaacttattttaaacaaaacatggatactgtgtatatatttaccaaatcataggatttaattacttataattaataagagaacaaataaagtatgctttgtgatgctatttgcatcaggatgtcacttttatcaatatcttggggttgtgattttgactcactttcacacacttctcatagcacctctgaggtatgtagactaatcttgttatcctcgttttgtccgtgcagatgagcccggaggctgtggtggcttggcctgggtccaaggcctggtagtgggagagcaggattagatccagctttcaagaccactggtctgttgctcttgtcattagctggtgttgtccctattgtttataccatagggtgggaaattcaggaaatgaaagttgcggggcagaagggagtttcagagattcagggtgctggagagagggtggagtaaggacaggggtgggaagagggagagggagagagagagacatgtcttcctgttgccagacattggacttaggaaacatctccttgatctttttaaaagggaaattggacccctgattaaatctttctcttgattaaagcttttcaaaggctccctttgcctatgtgaagtcagaggcctttaagtgcctctcagctcctttatgaccagtctccctggcttctcctgccagccacaccgcacttcagcagtgccaaagtattctgagtgtccttcctcccagttcccttcatacctccccaccttaacacaagctgcccctgttgccttgactacccttacacttctctttcccctgatgaaaccaaagcattccatagttcacctcctcagaaactcttccctaacacttccctctcatcctctagtctggttaaggtgcgccacttctgtatgatggcgcactcccatatgctgtgtgatgatctgttgttacttctattttcctgattcaattgcggctcccttaagagaaagacttgcatgttattaacttttctcttattagaattgagcacgagatatgacccatgttgtctcccatagctgggagggacagaactgaggctaagttgtagaaatcaagacatcagaggtggaactggggactcgaggctattgaaaccctctccctacctttgctggcctttgctactcttgatgcaaggcaccattctcaggcacttgtcttatctctgtccaactctcagcccttttgccctcttctgtcagctttattttgttcatttgcagacatgcttcctccacatggctggtaaaagtggcctcctgaagtccagactcatttttgtggcctgacagccttagggagaaagtgcttctctccctaaatgtcccagtgtggattttaaggaaggactttggccctgattgggtcatattcccccctcagaacagtcactgtatcctggcactttgtatatgttgaatgagtggttaatgtggcatttctccttgtgtccttcatttcttgcttgtgctaattataggcgtcttcactcactcttctttgttttcatgtctcaaaagtgacatgataaaagacaggggctgaccctgggagtatcccttgagactgggatggaaaggttagacagttctatgaaggcaattgcaggtggcaggcccatcttctcacctcttctgtatccttcctgtctctcatcccccaccaggattttggctcaagtagacaggcggtacagaaaggcagagctaactgcatagaccacagttctctgacgttcctgaaaagagggcctggattagatgaggcaggcaggagtgatttaagagttgctttgttattgtgagatatcacacagatataggaagtatacaaaacataaatgtacagcataatgaatcaatacaatacacatgtaaccatcacgaagtaaggaaacaacctaaaagtcttctgtgttctcctttcctgtcacaaccccctacctcccctcaaagctaactgttactctgacttcatggtaatcttccttgtttttctttattcttttaccacctaagtatgcattcttaaatgctagagttaatttgcttgtttttcaactttatacaaatgtaaccatctagtcatattcatttgtgtctggcttccttcatttagcattggatttgtgagatttgtcccttttgttgaatgtagccatgatctattaattttttgcaccatgtggttggtattctatcatataaatataccatcatttcatcatttatttttccattctactgttgatggatatttgggttgtctccagtttttggctattctgaatgatgctcctgtgagctttccagctcttgtctcttggtgcatgtggcttgcacgcctgctgagtacacatcttggagtggaagtactggggcagtgggtaggtgtatcttcactattaagtcaatatgccacaaaattttccaaaaaaggtggccaatttgccagcagtgtttttttttctgtacctcatctaatccccaattttggtggcattgtgggaaccacagatggataataatcataactgtcatttatttagtgcttactagctaagtgctttatgcatattctatcaggtcatcatcacagcaacccttagagccaggtgaaattgttcccctcattttgcaaatgaggaccctgaggattaggttgaggttgagtacttacggttacataccccatatgtgatggagccaggtcctaagcctgggtccaatctctttgactccaaaacctgagttcttaacctctatactgaaagttcagggttttacctggtaatcagtgtgggaaactgtggtttggcacagtggacctgttatttgcctttctgcttatacttgtgggttcagcctgttggcagtcattcctttaaagaagatccggttttccagaaggaagaaacataggaaaaatgggatatctgggagcttgaagcgtttattaagtttcctttggtaagtacatcactagggcccagacttagctgatactggtactgagagtttgcctcaagtatttgtccacccagaggtggtttttttgaagcatcagaagaccatgtctcaactatacctctcaaacctctattaaaattctgaggttataaaatattcatatgtttttctaacaggagttaggttacaattgatttgaggtagtatttagcttttttattaagttttggtattagtgataaagttgaactcttaaatgtgtagagaaataatgtcttagaaacattttccaaggcctctgcacaatccacattgagcttttcttccttttcagccacataacacagagtctcgctctatcccccaggctagagtgcagtggcgtgatcttggctcactgcaacttccaccgcctcccaggttcaagcgattctcctgcctcagcctcccgagtagctgggattacaggcgcctgccaccatgctcagctaatttttgtatttctagtagagatggggtttcaccatgttggccaggctggtcttgaactcctgacctcaggtgatccacctgcctcagcctcccaaagtgctggggttacagacatgagccactgcacctggccacaacaggagatttcctactggccagctggtccatctgcattcatcaccacacccccattcatcgtcatgatagcagcctataggcattgtttaaaaagacttagactgctcgaatgtcttcccagcaaggtcctgtgtgattaggcccctgctgcccttatgctagtctctccttttctatgttccaaccacaacacttgataaacacttttccatgtgtcagacaccattctaataatcccgtgcatagaaatgatgcttcctatcttatatatgaagcacagagaggttaagtaacttgcccggggccacacagctaataaatgtcaggcagagctggtattcaaatccaggttcactgtgttgcctctacttcctagacttccctaagtacatttactacaccctgctctttgcctcagggcttttgcgtatggtgtttctttggtctggggtgttctttccctctagattcagtgcactaggttgaactgcctacaaggtagggtagatacttcttgttatttacttatttattttttaatattctgctattattattacttgtggactattttgcttttccttgtagaccataagcttcctgaaggctggagcccacccaccctgtttctccccaagtcccgcacacttggcacacagcttcacacttttttcattcagccgatgagtgaatggaaggacgactcacagcagagtagagacacagtgttatttttctgtccctagatacatttttcaagtgctgctaacttaaactcaccttctaattattgtttaaatggcttttttggtctgatgctagattgatttggaattttaatacgtatttttagttcttagtctacttttcttcaggccctaccttaaaatttacaagctccattatcaagagttgtcctgcccacgatattgcattttgtcttatgggttatagatcattaataatgcttaggcaaaatgttccaatgtatagacagtgcacactggagttgctacttatcagaactcacccctcaccccagttttaaaaaatcatcgcttttttgttgactcaaaaaaattcttttagtcaagtatctttgaaaatcatcacgtctttttggtaaaatcatggagaaattctgctgacatctgtgtgtcctgtatttgccatttatgtactaacttgaggaaaggtaggaccctgagaggaagtgagttttcagttgcttctttaattgtgagcatgttaaatagtgtcttacgtcatatagttgaatagaatatccaccagcctttgagaagtcacatcttaacctgacatgctagtgtaaatgccacccttcaagaaatacatagattttgggcttagatgccctatgcccattagaaatagcattttaggctgggtgcagtggctcacacctataatcccagcactttgggaggccaaggtgggcagatcacctgaggtcaggagtttaagaccagcctgaccagcgtagtgaaaccctgtctctactaaatatgcaaaaattagctgggcatggtggcacgtgcctgtagtcccagctacttgggagactgaggcacgaggatcacctgaacccaggaggcagaggctgcagtgagccgagattgcgccactgcactccagcctgggtgacagagtgagactctgtttcaaacaaacaaacaaacaaacaaataaatagatttttacattcaaatcctataagctttgcctcacattcaaatttttatatgaagtttttatcatcaacttcaccatcagtatcaatcaccttggcaacgttttaaatgttttctgctcttctgataagtaagtttatcaggcatggtcttgccctagtctgttggaaacaaagcagtgttttgttttgttttccctatgcaatatttcttaatgattctaatttaatattatatgtttatagttattagagacaaaaagagagcatctgtaaggatagttttagttacaaatatagacaaccaaatcaaatcagcccaagcaaaatgaggatgtatggtctcgccatagctgggaaggacagaaatgaggctaagttgcaggaatcaggtcatcagggatggaactgagggctcaagggttcagaaacctctttctgccttcactggtctccgattctcttggcctatggcctacttctccagcccttgcctgatctctctccatcctgaagccctcctgccctccgccagtcggcctcctttagtcctactgcagatttggctgaggaggtggcccccagatgctccaggcaccttcttgtaccttggcatccaagggatttgggggaagagtttctctgtctccaaaggaaagggagactgttgctagaagggtataagaccatttgagggaaagatgacaccatggatcccatagtccactagatggttgcttttgggattaaacaagcattcattaaggggttcctttgtgtcaggcactgtggtaaaccatagagattcaaagattaataagattacaaaccaagtttaataggcataaaatacagtgggagagagtgggttatatataagaaagagcctcccaagagtggctggagttagacttcaaaatatgtttcctttagttattctttagaattttctgttttgttgtgttttaaaaaattctcacatctctgggatgatttgactattatagatattgcaagtcaatttcctgaagggtgaagatagattttaaaaatctttcattgaaaaattacctttttcctgaaaatgaaaaaaaaaatgttcatttggaagagataagaatatataaagaagaaaatgaaaaataattctagtagccagaggtagcatcttggtttgctacttagcattttggagtgtctttgtgatcttttacatagacataggtaaatatgaactaacaattatttttagacaaattattttgatagtatttgtttagttttgaattctacttttaaatttattgttctattgtgaacattttccctgaccaagaaatatatgttagatacgattattgttattccctgcttcatagtccacaaagttagccattcttctcttatagcacattgaagttgtttgctaaattttgccaacatgagaaacacaaagaatgttgtggcacctaaatctttatctgcctttcaaatgatttccttgggttctaggagtggacttgtgagatcaaaaggaagacacatatttaaggttcttcatccacatggccaccctgcccttgggagcttgtttcagtttacattcttaccagctgtataggagagagagcataagaaatgtaagacattaatggaccgtctctgacagttagccgtagtgtccagttaactgactgtgaggggctactacgtgacatcccagtgtaaccacgtgttgcatattggaaaaagctctggcagcatgaactaaaaaagtttaacttatttctcctaagaattcatttctttgttgagaaattctctgttctttcttttaaggccaagtaaatagaaaatgcagtatatgcattgtttttccccccttttcttctctggcttctttttccctccataaccccattgaaaagtgtctctcagattatctccttggatctgattcctaggagtgtaatgggatcaaagggacacacagtttccattgttgtcaccaacaaaagcagaaaaatctgattagaaggaccctgaagtgaaggttatagccttcagtaaactggaaatataatttaagaacctaaacagattcgctcattcagcaaatatttattgagcacttactgtgtggctctagtgtgaaactggcccatgaagggttcgactctgagacactgagtattgtgtcccactcccatatttgatggaaacaattcctgatgtgaaatcagggatggagtggagagaacagtggccttggaaccagaaagagctgggtagaaatcatggctctgctgggtgttgttgggcgtattactttacctctctgagtcttagtttccttattggtaaatctagccaactcatagaactgataggagtaaatgcaatggtttaaatgatggcatcagcaggtgttcagtaacaaatagctgctattattgttgttatgatgatgattattatggagatgactctgagattgtatgagcttggatgctttggcagtagctcctaatgcctccctaagcattttgcctcatggagcaaaagcaattctgtgcatttatgtgcatgcgtgcatatgtgtgtgcatgtatgtgtttgaaatctcttgtgtgtgtgtgtgtgcacatgtgtgtgtgtgtgtgaaaaataggaagtctttcccctggaattaggcccagagtgtgtatcaagaggatccttaaggcagctgttaggtccccactctccctgctctgctccctgaaccctgagagctcagagtggaggcacatgggagtgagttcaccagtgaatcttcagcaggaatcaggccttacataatctgggttttgtggtatagtcgctagaagtgggatacttgtcctcaaaaatttagaagtgaggctttttcttatccatctgcctagcttttgggatccaaaaggcaagccttggtgacgggggagagtgaggaggtcatggaccaaacttcagtggctctcaaagccacatgcctaccaaacactgacttgggtagggaaggcagtgaggtggttactgcagtgtggccgatgccacacgcacccaccagttatatttcccatttttaggtctcagtgttcttgtgctctcctgtacttcttccatcagatcaaatactgaattaaaatgtgtttgaacgtcctagtgcatacaagcctcagggctttctgggtggtagaaacttggttccagaagctcctgagcccaagaactgctaatttgctggagtatcattactgtgttaaagaaaaaaaaatattctgacacttgttaaaatggtcaggaagattttattcaagactattgcaataagggtattgtaatgggggagagagattgggttcaactctgaatacagcaaagacagctggggatatatagccagtgagtagagtgaggaggtcaatgggtggaaaattactatgaggagacttcaagagtagggggttcttactaaatggatccaatgagattcttgctaaaggcagatcaaagacttagacaataaagggcagggatgaagaactttagcaggtatcaagggtaggggattctctctaaactgactttgtgagattcttgctaagactgagctgtgcagacctggcaaggacaggtgaacacagaagatcaaggttaagaagagggtctacaggagcctaactaaagtttggccaaggagtgtctttgatgcttgccatgaatagaatgaagcacaaatatcaagtggttaattagggctcacctttggaatcacaattgctggatgttgagacattgggcaagttattttgcctctgtgatcctgaatctcttgctggaaaacggaccgaacagtacctccctcataagtcctgcaatgagcataaaaggaggtcatgcacaggaagggtttgtcagagtgcctgcctaaagtaagggctcaataaatgttatttgtattaaaggtggagtatcccttatccaagatgcctgggaccagaagtgtttcagattttaattttttttggattttggaatatttgcattatcccaaattcgaaatccaaaatgctccattgtgcatttttgttgcgagtcatgtcagcactcaaaaagtgttggattttggagcattttggattttggattttcaaatttggtatccctagcctgtgtaagttggggactgtaattaagttgaaatccagtaaatttattttagcaaactctttctaatctataggtaatataggacaagatgtgggttagtgaaaattgctctggactgagtttgaattggtgtgtttaaaaactagctccaccaatgtttagcatcctcctagatctttagttacttatctgcaaaataggccactgtcttctctgcttttcccacacgttggcatgaaatgagaaaatattaatataaatgaggccctgtatggtggctcatgcctataatctcagcactttgggaggctgaggcaggtggatcacttgagcccaggaattcgagaccagtgtgggcaacatagcgaaaccttgtctctaagtaaaaataaattcaaaaattagccagctgtggtggcatgtgcctgtagtcccagctactcacgaggctgaggtgtgacaatcaattgagcctgggaggttgaggctgcagtgagctgagagcttgccacttgcactttagcctgggtgacagagagacaccctctctctctcttaaggtagctgtggaaatatatattggaaatatatatatgtttattggaaatatatatgtatatttgaaatatatatatgtgtattggaaatatatatgtatatttgaaatatatatgtatattggaaacacatgaatatttgaaatatatatagtggaaatatatatagtggaaatatatatatggtggaaatacatatagtggaaatatatatatggtggaaatacatatagtggaaatatatatatatatatagtggaaatacatatatatgagaatacttggaaaactacagaggactataattagtacttaatcaaaatgtgtctaaagttgttcctgtgattaggtctccatctgtagtaagcctgtgcccctgggctgtgaccttcacaagtgcttctcagtcttgttttgttttgtttttctttttaggagagacaggaaagctagaaggggctggagttggatgtttcccttcctccaggcaggtaggctctggtgaagtagtttcctttgagggcagacctttttatgaacagaatactctgggcatatttcaaaatggtgactttctcacaattccctgcaggaggaaccaggagagctttctctgaacctcactgtgagaacctgatagggctcctggaggtagaactcatgatattatgaaggctctccaggctcccctggagtttttataatgttatttctttaaaaattgagaaacaaaatagtacttttcgtgcactgttctcaacagcctatagattggacagaagaagggagttaacaataaaggcatttcttaaccctcctccaaaacaaatttataatttaggccatttataacaaaatcttttaaacatctgaagtatacatcccatgttgtaatttgcaaaagattttgcttttaattatttcagcatctataagtatccttttattggaaaataaagaaggtgaccaagggtggaggtggactatagtggaaataaatagagaaatatctaagcttcactatccatggacttgtcccttgctctactgttctactacttttacttgagttactttcagaatgccagtgactgtggctgcatccttcaagaagctagctctcagagcagatgctcctgtacttttccaaacaccaaatttaggcttttttctctctcttctctcaaagtctcttgccgtttttcaattcaatgtcaggtgttgatgaagtgtgcagcttctgagattggacttgctgaggtccaatctggctcttattcttgtgtgtgaccttgggtgtttcttgacctctctctatcccagtttccttgtctgtagaacaataattatataataatatctccctctcaaagtagttaggattaaatgggagaattcatgtatggggcttggtaaaggttacttgagggtattattatgctaccttcccctttcaccacttctctcttctatttctttttcacttttgtacctttgcacagactattttaaaaatacccgtttgtaccttatcttcctctagtatgggtgtaagatatcacatgcattttcagctcagttttgtttagtactcacacatatatacacatttctttactgaacagctgtagtgtacaaagcactactgaggatgagattcccaattttgtagattttgcatctagtgagaaaattgtggaaggtgatgagtcaggtttgaaagtggaagaaagttcagggtgctgtggagttgtacatccagggtacaaacccagcctatgaggtcttggaagccttcttggggaggggacattccagctgagactggaagcataagtaggaactttgaggattaaccaaatttcggtcttctgcatggagccctccctggtcatacttactcttcttcacccctgacttaggttactatagcactttatttctgccccaggtatagcatctgcacatgcctttcttgtcatttaaataggtgggtctaactctcctccactgagttacaaatgccttgaagatgaaggctagaccttattcactttgtatggtcacagcttcctgcatcacacagttcaaaccagccttcatttggtgttttctgaactcaaccacatgtagtttgtgaagtgtgaatcctataaaggaatcttccttactaatgtttggctctcttggacctgaggttcctccttgccttgggatgactcagtttcatcatataaactggaaggattgtgttagggtcctgctggttagggtttctctgattccctcgattcagaagggaggtctctgttgtgtggatggcagcatgaatgggtgcttatggtgtgatattgattgattgattgattgagatggagtcttgctctgttatccagaccggagtgcagtggtatgatctcagctcattgcaacctacgcctccctggttcaagcgattcttctgcctcagcctcctgagtagctgggactacaggtgtgggctaccatgcccagctaagtagtgatatttaaatatgggttcattatctttcagtgtgatatggttaggctttgtgtccataccactttgtgtctaatcttgaattgtaatccccacgtatcaagggagagaccagatggaggtaattgaatcatgggagcagtttcccccgtgctgttctcatgatgctgagtgagttctcacgagatatgatgcttttgtaagtgtttggtagttccttctgcattaattctccttcctgctgccttgtgaagaaggtacctggctttctctttgccctctgccatgattgtaagtttcctgaggcttctcctgccatgctaaactgtgagtcaatcaaacctctttcctttataaattacccagtcttgggcagttctttacagcagtctgaaaatggactaatacacattggtcttcaaaggggatattttggctgggaccatgttgtaactggtcagcaggtggagctgggacagcagcatcctctttgtaggcttcttggcctcccaggcaggcatcatggaacatctgtgggaaagtacttgagctcttaatataagtggaatccagacatacgtagccctagtttgatgggccagggatccccagagaaatccagtttcagagaaagagggcatgggacccttgagaagagaaatcatcacaagtgaggagagttcacagagagcagaggaatgatggagcaggtgcctaaccatggcctggcacagcctctagcctgctgctccctgggaatgagagggctgtggtcactagcagcccaccaactctgctgagggaacctcattctgaaatattgggtcatgtgggacagcaggagcttttcttctggccagaaatggccaaaggcagcagaagttggtgaccttgataaggtcagcagtggtagagaaagaaaaatctggaatctggaactatcccaactctcacacctgcatgtacaggattaataagtaattcaaggtggttctggagaacagctttagagagggttctgttggacatgaacaccatttctcttattttttatttgttctagtctgaccaatttattgcaatatgtttgggtgggtgggttgagactgttcaaactatcttgagaaaaaaaagctggggtttgctggagcagaaagtggagcactatcaggatccaagttcactgctcctttagggcatttctatgacttccctactctgtgctcctgtcttcactatctgctttccgcactcttcctgtgtgtccactgtgcttcctcagaacttggactttcctcaggctttggcttgcaaggccccagctcttcctgagcagttctttgcaattttgcctcctccattgcctggctcagcctctcagtttccaattctaattttctaagtgaggcatctgatggcccagccaggccaggggtgagagtcccatcccttgatcatttagccgctagaagaaggagagtgaggagtagggccacgtgacatggagcttggcggtggttgtacagagtctgcaagaagagcatgcaaccagagtgtgtctgatgggcatctctagttcattatccagtcattcattcattctgtttcctacctggaagtatagcattggggttaaaagcttgggttccggagccagactgaaatctttgctgtgaccttgagcaagtgacttttctctttgagcctcagttttctcatctgtagaaaggggatggtaatcatacccacttcataaagtggttgggaagaaaacttggaaaaatgcataaaagatcctagcatagggctcagtgcagggtaagtactttacaaatgtcagttatttttacatatagttcataatgacaagatccatacagcatctgtctttatagaggttacaacttcataattttcatgaaccactgatgtagaacactattggtgatacatttacaatgtatagaagacatctagtaaattcactaatagaagaaatatttattgactatctcctggttgtgttgtgcagcattgtcaccagcattgggtatatagtgttttttttttatttttttgagatggagtctcgctctgtcgcccaggctggagtgcagtggcacgatcttggctcactgcaagctctgcctcctgggttcatgccattctcctgtctcagcctcccaagtagctgggactgcaggtgcccaccaccacacccagctaaatttttttgtatttttagtagagatggggtttcactgagttagccaggatggtctcagtctcctgacctcgtaatccacccatctcggcctcccaaagtgctgggattacagacgtgagccaccgcacccagccgggtatatagttttaaacaaatagtcaaatccctgccctcatagagcccatgttagagttggaagatagacacacaaattaaaggtagatagatcatgaggaaaaaaaagcaggctaatggactagggaatggcaggacatatgtgggggtcttaatgtagatagagtggtccaggaagactgccctggagaagtaacatttgaacaaagaactgaaaactgagggaggggaaacaactagggaaagagcattccaagcagagggaagggcaaaggcaacatcctggaagcaagagtgtccttggcatgatggaagaacagcaaggaggctgcagtgcttggaaccaagtgaatgaaggtgagagccagaggaaatgaggtctcagaggtagtcagggctggggtgattttaattttacccttcctgcaggttcagttacatcttgtttctgtggctcatctgggcctttcagctcagcatgaactcatggtttgtcagtttccattgtgaccaaaggcagcagacagatgcccgttttgaagcagcctgaccttgaagatgcatgaaggcccgttagacccttacctacagtgggtccataactcatgatggtttggctttgatttttgactttatgatggtgcaagtatgcattgcccgactgtaggctaatgtcagtgttctgagcacgtttgagataggctatgctaagctatgatgttcagtagattgtgtattagatgcattttttacttaatattttcaacttacgatgggtttatcaggacataaccttgtgctaagtcaaggagcatctgtatattgtggcctgttgggccctgagactgcacttggtatttctccccaccaaggctgggtgagtcatgggaagggagggatcctgataaatttaaagccagctccctctgtcacaactaacacagagctgcttccttagtcatcctttaatcttgtttcagttttctgacctctttcttcaggattaaaatagcccagcatgctacttccagtgtagttattgtttagggataggaactgtgctgtgtgactcactaccaataagggtgaactgcttagctgtgcctgtgatgtgctgctgctgaggataagaagaccacagaacacacggttgtaggtgccagaacagggctgtcctcaatcttccatggaaataagaggaagaagtggtttctttttttttctactctaatctcatgacagattaagaaatggttatttctgtcagcagaatcttgcgagtgcttcacagtggaggtgacatgtgaaccctggtatttcaggattctatgatggaaaacatgttttttccacagtggttttaacctcctgcgaatgaggaaggctgtgactcttgctgcagttgaggctggctgcccttagatattcgtttaagctgatgggtggtagagatgggccatttactggatgtttattgctgtgtgtatataacattgtttttgacatcttgtttatcagttatctattgcagtgtaataatcagccccaaacttggtgacttaaaacaacacctgttttatttgttttcatgattcttagggctggctttggctgggctcagttaggcagttttgctcatatcttctaaggtccttcatgaggctgcagttatctggtgatttgacagggcctagtaggtttaagacggcctctgtcacatgtctggtggttgttgctggcatttgtctgggcctcttccctcatgatatctcattgtcaaagacggtagcttgaatttcttcatatcatgatactgtgttccaagagagcaaagtgtgagctccaagcattatttcctctatcgttttgggtggtttttcctttggcctcaggcattttcatcacacacatgtgatgaccaatagctgaatattctagggggactttcttactccttttagtgtttgtgtaacagaatacctgaggctgggaaatttataaagaagtttatttgacccatgattctggtggctggaaattccaagattggtcagcctacctggtgagagtctcatgctgcttcaactcacagcagaaaacagaaggggaagcacagtgtgtacagacagaccaaacacaagaaggaacaacctactctcaaggtaactaatatagtcctgcgagagtgggaactcactcctgtgagatggcattaatctattaatgagggatctgcccccaccaacccaaacacttcccactaggccccatgtcccaacactgtcacgttgggaatcaaatttcaccatgagttttgatggggacaaaccacatccaaatcatagcagagactctctgcacccttccttcctgtgaactctacctgacatcatctttccagattcccaatttggtcttcttaaatgagggagaccactggtcttcgcctgggcttcccctccttgtgctgcagcctggacactgtctccaggcagtaggctgggacagttataatgctcacctcgttctacatctcaggaatcactgttcttgaaaccattatttcatacatgttgtccagttttttagtcatttcaggcaagaaggttagtctatctctccaactccatcttggctggaagtagaagtctcaagagtacaaaagtggcagtggcgtggtctcttgaggcgtagacttggaactcataaacctcacctctgagttctattaattaaagccattccagggccatcccaattcaaggggtggagaaacagactaaaactcttgatgcaagtggtggcaaaatcatattgcaaaaggttatctggataggatgggaggaaatttgcagccttctttgcaaacactcttctttgcaaacaaaaagcccactgtttgtggatttgcaggtagggttaatgacaataggatagctattatttgataaacaactgctatgaaccaggctctgtctgaaacagtttatacatagctcatctaatcctactaacattgtgaagtgtagttgttagctcattttacaaatgaggaaactgccacgctctgtggttaggtgatttacctgaggatgtacctagaattatatgatttccatgcttgtgtgattccaggcctgcgctctgaattagtccttttgctttcagctttgctgtgttcttaagtttttggtatatttcttgttaacagattatagcagcatttaaaaaatgcaaatacatgatttatctcttgttaggtggtgagtttattgcatttacatctgttgtaactgttgttatatttgcatttatttctattgttaaagtaaattaaaatggggaccaggcctgaagtatcccttagcaaacaaaaccagttaggccttatgggtgatctaaacttgcttgatttacaaacaggaaaaacttaacttgagttatttcttgtaaatgcctatattaaagaaaaacagaacgtaggctcaactgatcagaagcagccaacaaacttatataatcagagacagtccaacaggatagaccaaataaggcaactgtgtatctgtaaccaatcaaatattttctttgctctacttcagtgtttatcctataaaagcctcccccttgtgttcccttggaggagctcctgaactacttctggtttagaggtgccagattcctgaattgtcatttgctcagataagctctttaaacttttacagtgcctcagttttctctttaacactaccattttattttgttacttatttaccttgccttttccatgtctatctcctctttttaaattgcattttctgtattctttttccctacagatatggaagttataattctattctctattctttcagctgttatccttaaaattttaatattatcctttaaatttgcatacttaaagtttaaagttaccctatttgtcttctcttttcacacgaaaatatgaggaacttggaacatgcttaacaccaaccacctgcctcctgtcttacatgtttttatttttatactctcctggggacatggtgggattacgcttttgtgtctttgaaatgagatgtggccatctgactttctttggccagtgaagtgtgaaaaagcttagcaagacagcgtatggttcaccatgcgacctgtggcaattgttgaagaagactttgagatgatgcttctacttggccggagtcattgaggggctacaatgggcagacttccctagctaaaccctgaaggatatttaacatgaatgagaaataaacatttgttgttttaagccatagagatttgggattgtttgttgccacagtataaggaggttacctgactgatatgctcccactctccccacctcaggaattgtcatcattattattgttttatgcataagtacttatttagaattacatttactgtatttattttctcatttttctttccttcatatcaatccttccttctagatttattttttttcttgatgtacacattctagttctttgaagtcagtggcgtgatggtaaatatttaggaactggtcccccaggggcaaaaaaatcctgttttttagtgtttgccaattcccatggtttaatactcccactatggctgatttcaatttatcagcatgttttctacagactagcaaaattcctgtaaacctcacatttggctcttacaagctagtagaagcatgctgcaatttcaggtggattatgtcagtggtaagctgtttttgtctgaatgtatctttattttatcctcattcttgaatggcagatgaacttggagtaaagttctaggttgagagttattttttcttagccctttcaagctatgttgttgaaataatatttttgtttccttgaaaagtcggctgtcatcttagtccttgttcttttgtagttaacctgtttcttctctatggttgtttttgaaatctcttcaaaacacagtacagatactgtgtatctgtaatcaatcaaatattttctttgctctacttctgtgtttatcctataaaagcctccccgttgtattcccttggaggaactcctgaaccactcctggtttggaggttcctgattaatgaattgtcgtttgctcagataagcttttttggtattctgtaattttacttgtagatgtttgagtgtgagtttacatttgcttaccctgctgtaacacatttgctccctgtatctttagtgagttttggaaattttttagtcatgatctcttcaaatattgtttgatctctgggattctgtgtggtctggattgagggactgtccctgtagagcatttttgttgctgttgttggtttgttttttatagagatggggtctcgctatgtggcccaggctggtcttgaactcctgacctcgagtgttcctctttcctgggcctcttgagtagctgggattccaggtgtgagctacggcacctggcttgtgtttgtttttgtcaggtattgccttggaatctttttttcttattgtgataagaacatttaacatgaaatctacccccttcataaatttttgagtgtacaatacaatatggttagctataggtgtaaagttgtgcagcagagctctagaatttacccatcttgcttaattgaaactctataccagttgcatagcaacaccctgttgcctcctccccctagcccttgacaaccactatgagttttactattttagattcctcatatcagtggaatcacgtaatgtttgttcttctgtaactggcttattttatttagcgtaatgtcctcaaagttcatctttgttgtggcatatggcagaattttcttttttttttttaaggctgaataatattctgttgtgtgtatataccacattttctttatccgttcatccatttatgaacacttagtttcatttccagaccttggctattgttaataatgctgcagtgaacacaggagtgtgaatttgtctttgagatcctgatttcaattcttttggataaatacccagagtaggattgttggatcatatggcgattctatatttaatttagttttggaaacttctgttgtgtttttcttagtgaaacactattttgcattctcaccaacagtgtacaagggttccaatttctccgtatccttaccaagacttgttatctttttttttttttttttttttgagacagggtcttactgtgtcacccaggctggagtacagtggcacaatcacaactcactgaagccttgactcctaggctcaagcaaacctcccaccttggccttccaaagtgctgggattataggcatgatataggcacgaaccactgcatccagaccctctttagctttttttttttataacagccatcctaatagacgtgaaatgatatctcattgtgagtttgaattgcattgccttgatgactagtgattttgagcatctgtttcatatacatgttggctatttgtatgttttcttttgaagaaatagacatttcttcaaaaaaagtctatgtgcccattttaaaatcaggttgtctttttttttttgcttttgagttgtagaagttccttatatatatttttgatattaaccccttatcagatacatggtttgcaaatgttttctccattttttcagattaccttttaaaaataaaaacaggctggttgcagtggctcatgtctgcaatctcagcactttgggaggacaaggtggccgggtcacttgagcccaggagtttgagactagtttgggcaacatggtgaaaccccatctctacaaaaaaatacaaaaattagctcggcatggtggcacatgcctgtagtcccagccacttgggaggctgaggtgtgagcccaggaggttgaggctgtagtgagccatgatcatgccactgcacttcaccctgggtgacagaataagacattgtctcaaaagaaggagagagacagacatacattttaatgataatctaaaacataaaattatctggaaattaagacaactatttttgtactgatcatttatatttaaatcatccactcaaaaaacatttattaaacactcctatgtgccaggcacaatactaggcactggagctataacaatgagaaacagagaaagagagacaaagagcattcttatagacccttaggaatgtttgtgacaaatgtggggaagtaaaatcttcttctctgaaaatatctctcaaatatcttatttccttcaggtctttgctcagataccatgttaatgaagaagtgcactgactgcttgactaccctgtatgaaatgaacaccccccatttgactttctacctcttgccacgttaatattttatttgtctgtgcagcacttactgtctcttgctatgctatacttttatttcttggttacctcctcttattagtctaacttctatgaggtcaggtactgtgtctcgctcattgttatatccccagtgcctggcacataggggtgttcaataaatattttttgagtggacgattgaaatataaatgatcagtacaaaaaagtgatgtcttaatttgcaggcaattttagtttttagattatcattaaaattaaagaactttcaaattttcataaaactcacagacttctgagaatgcattcacaagcccagtttgcaacatgtggtgctaaacactccatttacgtcgcccccctgctgaatgaagtgccctttctatgttcttctggatcctttattgatgagtatcgctaccttcgtagctgcctccttctactcttggggttcatgtttagccatcaagctgtcttctttttccacccaagatgccatgcatttaaaaagtatgtatatatatatgtgcctttgcccgtgcccttcactctgcctggaatatctttcttccttgttctaggcctcacttaaggttcacatcctctgcagaatcttcccttgtgctcaaaccagattgatgcctccctcctctgtgctgcctcagcactttgtacacattcccttttgctcccatccttttctgttgtgattgcgtctcctcatttgttgcttcttttgactaagagcttctcaaggccaaggacgatgtctcatgcctctttgttgttgaatccccatgccttagcatagtgcttagcacactgaataaacagtcagtgaaagtgagttgagtgaatgtcacctgtgaatggttgtggcagaaatgaatgaccagcttatatactatacctctctgtatagactctaacgaaggaagaattctttgtagcataatggctgatagatagggagtataataagagattgtgttatagccttaaaaatgtttctttttgaaaaaaggaaaagccttctatctaaggagataagtaactgtactacctggaattcactgaataagttgtgaaataatctttaaagagatttccccagcataatagttatttttactcttaatactagttataatattaagagaggttatttactgtatatatgtgtgtgtgtgtgtatctgtttgtgtgtgtaaatttattcatcactacaactgtatcatctccattttacagtggaagaaactgagggcaaacaactttccagagattaaacaggacagagattaacagtggtagaataatttcttgcttgaattcaggactcaggttcttaactagtctcccacattagatctcagtaactcataataacagcattttctgtccacttaaaaggtgatttaaaagtttatttaaaggaatgagtgaagagttgcttcgcagatactataaactgtaaactcatcctatgtttcttttttcttttttaaaccataaagcctgcaattctttccacttttatttccctttggatttctgaaataaagaaataaaatgttcaaagataacagcaaaaaattccactcattttgcaggcctttgtttctgctggttttgtgcctcactcttctcctagtccacagctaaggacccaaacaaagaagagagggacagtcatgcatcttaaatagagtacagatgcatgggttcaagaggcctgtggcctccctctgacttggtgagggatctagtgtgttgaagtttatgtaacccaggactaatagttcatcttattaggaaaaatgccagcaagacctggagttagtaagggcttacttcgatttaaattcttctttcattcaataatgcttttgttctgggcaccagcagtatctgtactgttagatactttctttttttctatactttcctgttgggaaactatcccaacagggatactttctttatatccctgttggacttgataggtgagctctgttccagactcaaatttgaaagctattttttttttctctttctgactttaaaagtctcaaatgaattgtaaaacaaaataaacatcaagggatgaaataagcactttgcaattccttgtttaaatatagtttttactgtacttttggagaaatttctatttcactggtttgaagatttgaaaaataatcttaaagcatatgaaatatatctatgtgcttaggaatgcatacatgggtttctgagtcttcgttttaaggaaaatttttgttgttgctaataggcccaaaattatccagatacaataaaataatctcaaacagatattactcaagattggtatcaagagatcttatttctcagtgatatgacatattctttcggtgatggtatctgcaaaacaaccatttccttttttctggtttttgctttgacttactcaatgataacatggatctcctgtgacttatcatttccaggttcctaagtggccccttaattcttaacatttatctcacatagatttttaggaaaaaaaatttctctaaaccctttttaaagtccttaagctcccgggtagaagaatgtcaaatctgaaaaaatccttaaaggtgttctttagtaagtcattcagagagaggagttacttcatcttggttggaatgtgtcatgtgctccaactcctaaaggcttggagccgctggagtaaggaatgtggttatggcggctgtcccatcagtggcatgtggtggaagggatgcgtctagaccaaagacatttgactccagtgtggaactctggctcgtggcagctgttgcacataccctgaaactaattatgtggtaacatgccctctgcagtgcagtgaccaaataagactggtacatggagctagaagggaaagagcaggaaagagttttgtgctgagagtttggtgcctggacttcacaactagcagtgctgtcatttctgttgtgacttcagacaaccagtggtcaacctctttgggccttagtttatcctcctgcaaaaagaaacaaagattatctttgtgatctgtgccatcactagtgttcagtgatgttaaatatttgctgtctctttaaaatgcatgtaccagcttgtggcaaaatctagggttattctttttttttatgtgctattttatgtgctattgctttatttgcttcaagttagcacttgaagtggccaaactaaaaagtttctctggttgaaagattttctttgtatagacacagccaaacattatttcactgaccccacccccccacccactggaattgcagtttcacctgtttgcactgcattctggaacagtttgcaatctgtatttgtatattaataatagtaggagcttgaaaatgatggcttcctgttggctagggtacttactaagtttcaggcataagtaagtattgggcatgtgttatcatctaactttatcatgcttctgcaagatgtgttattagcagcttttaaaagagatggaaactgaggtttagcgaaaataacctgccaatatcccacagcccccacctccgcaaggttatatgaccttaaagctagtgtatgaccacattggaggcccattcaaggttatctgaccccataactagtgagtgaccaggcttttggccccagactgtctgatgtcatagtcagagatcttaatttgggatagtaaatcaaatctttaaaactttccattatccttagcaaactaacacaggaacagaaaaccgaatactgcatgtcagaaggttgaactggcatggctacatctttatcatgcagttcacctgagtcttatatatagtcctaaagggtactttaggaatcccctactccaaagaaacataatcatagcactgtcatatcatttatattgcttcttttttctttaatcagaatagcaattgtagtagattcttcttggggttgctgtggacctttaagcaactcttcttcctcttggagtagcttctgatggtgagggtcagctgccacagcctattgatgcttggaagacacttggcccaagccaggctaattctatactccatcctgggtattttcaatttggagcagggagtccttgaaaccaagtaacatggaaccaagcttctcacagagattcatgctgcgtactgcttccttcttttcttgggtcttgttttcacagttgctgctttgattcggggagatgtcttgatatccttctcatgcactcccttctgtggctcaagacaggccaagttgttttctgttgcttgcaacccaaagaatattaactagcctagcgatgatgagtaaataagttattcttggaaaaaatatttgctgaatgaaaatgggaaataggaaggcatccgtaatgctctcgcctcccatcatttttaacagctttattgagatataattcatgtatcataaaatttacccttttaaatggtacaattcagtgatttttagtatattcacagagtagtgaaaccatcacgactgtctaatttaaaactttaagtactctaatttaattacctctcctaaaaactccctatcctttagcagtcatttccccatcctcctctccccagcaatgatcactgtggtatattttcctctcttttttttttgtccattcatattacttttttatggtatgctggacacatttttgtttatggggtatggcatattctttcatttatttattcattcactcatctcccaccccatatatatatatatatatatatatatatatatatatgaatatacatattcactaaatattaaggaccataggcattgtgtggatatagcagtaggtagcttatcttcacaccagagaaagaaaaagatacaggcctttgattctagttcattaataaaatggaaaaccttagagaatttgaattattaggctaattaggaaccagtatattcacatattcaatttttttctgtacattattcaagttataattaatgaaaaagatttatcacagactcctcatggttttcccagtcacttaaaattccaccgagagcacagacatgctacagaaatgctgcttaaaagcacaaatgagcaaaacagtttagtgtaatgcctagaactggcattgtgatgactttttaattgttttattatttttaaattgatacatagcatttaacatatttatgggatacatgtggtattttgttacatgcatagaatgtgtaatgatcaaattagggtaaatacttcatcatcttgagtatttatttttatatgttgggaagatttcaaattcttttttctagctactttgaaatatacaatacattgttgctaactatgatcacccactctattctgctttcaaacatttgaatttatactttctaactacatgtttgtacccattgaccaacctctcctcatcttccttttcacccacacacccttcctagcttctggcatcgatcggataatttttaaaggtcttcttggattgttctttaaattatgacaacaataagtagcaggacagaattaaaattcagtatttatggaatctttagaaatagtaaacaacatacacactcatttcttggtatctgtgggggactggttccaggactcccacagataccaaaatctgtggacgctcaagtccctgacataaaatggcgtagtattgcatatatcctatacacatcctcctggatactttaaatcatctctagattacttatactacctaacacagtgtaaatgctatgcaaatagttcttatgctatattttttctttttttattgttgtattattttttgttttccctcaaatatttttaacccgtggttagttgaaacctcagatgtaggacctgtgcatatggagagccaattgtatataattttatacacacacacacacacacacacacacacacacacacacatttatatgtatataatttaacctggcaggatttcctttttgacttggaaaggtatcttggtagagttgattaacgggtaaaaatacatggtttgatagaagaaatagacatagggttcgatagatcagtagggtgactatagtttacaataatctattatacatttcaaaattgctagagaataataatttgaatgtttctagcataaagaaaaaaatattggccaggcgctgtggctcaagcctgtaatcccatcactttagaaggccgaggcgggcggatcacgaggtcaggagattgagaccaccgtggctaacacggtgaaaccccatctctactaaaaatacaaaaaaattagctgggcgtggtggcgggcacctgtagtcccagctacttgggaggctgaggcaggagaatggctgaacctgggaggcagagcttgcagcgagccgagattgcgccactgcactccagcctgggtgacagagtgagactctgtcttaaaaaaaaaaattatatatatgtgtgtatatatatatatatatatatatatatatatatatagagagagagagagagagagagagaagatgatggatatcccaagaacactgatttcatctttacaaattatatgaatgtgttaaattatcacatgtgccctgaaaatatcaacatctattatgatctgtaaaaaaaatagtacatagttcaacaatggttaaatcaatgagtgaatgacccactttatctagtagtgtcctgcattgggggcgccactcatagtttactcagactttattaatcacacacactggcttttcagtctgtttctcaggactatcctacagcattgtgttcagagtgctttccttccctaactttccattaccaaataatcttaaatcagtagtaaaactgaaactttttttttttaagtttagggaagcatttctcacaccttcatgtgactacagattacctgtgggtcttgttaaaatgcagattctgattcagcaggtctgaggtgagacctgagatcccacctttctgacaagatcccaggtgatgctgatgcttttggtccaaggatcctctgagtagcatggaggtctgttattctcccttctcagggttggagtgactcaagaagtagagagaagcagggagggtacatggggaaaatctctcctctttaaaactttaaagtagcaaggactagagtttggctgatgaacccaggcagctcagagtaggggaaagttaatatagttcaatgcctgccacccagctatttgaaatgatattaatttaggtaagacatcttacaattctgaaaagtacttagatggttagcagttttgctaaatgaacatgttggagggtgaagaggaagtgacagggaaggaaatttcaataaaacctttaaaacatcattggcattaaacatttgctaagcagttaaatgaaagagccgtcctataataactgtatatggctgtgactgttaatattataagcgtttctattttagctatcgtttctatcattacacgtttggggtagcttctcaacacatttttaaaataccagtatttcttaaactgtagttttttttgtaacctgtatcaggttgagaagtgttgataacagggcatgccattatcctttagttggttgtggattactggctaacaacagggaaagaacactgaccttcaaaacagaaatggttggtattcctgagagtcccttgtagagttatttacaggtcagttaatgtgaaataaattatatccatcttcgaattggtcttaaaacatctatttccctttttctcttatttaaaaaaatgccaaagcgcttagcattttgtttcccactgttgcatttatttgataatcaaagatttatgttcattatgcccgtttcttttccctgcccaaatcggaggagggaggacagaaattttaattccaggcctctagccaccaccagtgtctcaaaataatgaaaatagctaacatttgtggagcattcattatgtgccaagccctgtgcttcaggctttaagggaacttgtttgctcactcagtaagcatctcctgtggtgtttgtatgaaccctgtagtgagttacaattattatttcctgtttacggatgagtagcctgatgctcagagtacttaagtaatttgttcaaggcatcacaggctgtcatgggtagatccaggattcaaaactcaactcttcaccactgttctcggaagctgagacaagtttagtgatttttccccagatcacgtaactggttagttgcaaagctagaattagaacttaagtccttaactctaagctcagtgcagtattccaatattgtgccaccttagagtattggtctgtaatgaaaaccagaactcctctttgtgtacaaaagcaactgccaagagggctttcccatgtatactgttcttagtgctatgaatcttggcaaaacgtcacatattatcaaccaaagtgagttatgcagttatcaatgacagtgtgtgggtgaggaacccagagtcccagtgcttttaaaaatcacctatccatattctttatttagttatatgtgcttctccttggggtattctaccccaaaagagaaagcctagaggctagaccatatgtctaaatattaattttttatacctccctcagcaggccaactcttccaccacacactggggccacatgttttcagctggtctgctgtttgtcttttcacacacatgacacagcctaaggaagatttgaagtcatgaagagtgttgtacagcctgtacataggattacagagaaagggatcagagaacctgcccttcacattaattacagacaaactaggaagtgattaataagaaaataaagtcacaggagaagtaaagcaggccaagttgtctgcaaagagattctgttttctttgaaagagttatggtaagtacttgcttgagaaggagtatggatttattaaaaaaaaaaacttcacgacttttggatataagccaattcatatttttatatagcttggagacggttttcatagcaatgaaaccctaagctgctttacagtgcaaaactttatcatttttgttttttccccatagtgtggaaaagagcttaaggtcacacagtttttcaaacctgccaggagctcatattttccatgtttggagataagacacagtagattctaaacatctggctattccctatttaaataattgtgtgttccatgcacatcatacatatataattatattttcattctagttacctttctgtgttttagacttctgagatctggattagattctgactccagtagctattggaagtcactcttataaacgttggctaaggcaaagtgtatttttccttcttttttatataaactcaagtagggcttagtttcttgtattttcattgtaacttctttcagaactgaatgaatataggagcttatatgagttgttcaagatgaaattctgtagtatttttagagcaggggagactgtagaattggctggaggaaacctcaattttagacactggcctgtatctgctaatgatgtgattgcagtcaaatcccctaagccaccacaatttatgctcttgtgaagtggacatagtgttggcagctttggagcagtattgtcagatgagtgagtggtggatgtgaggcatgtgagttttgatggagaggacaggacagagtaatccaaggttaaggaaactctctgcacccccagcccctcaatctagctatagctaagcaaagaggaatggaaacctgttctctctgaaattgttcccttgtgccgacggtctggtgagacagtttccctctggtcctctcacctttcttctatacttcattatgaaaattagaaactgtccttgagagggtcattctgtgtgtgtgtgtgtgtgtgtgtgtgtgtgtgtgcaagtgtgtgtatagtgaatacatgattatatgatacatgacaatagaacccttcctttccactactcccccaacagaacacgtattaacatctgcagaatgctgtttcagggaacgtatttggggaaacactattgaaacacagtctggtaaaagccatgaggatgcttaatgtttcagtggcctgattggttaaagaagtacaccaggttaatggtcttggcattttggctccaatgtcaccagtatttgaagttgaggactcgcttttcttgagggcttgtctagaggaacacacagtgtctcactgaagcctttgaataacattgtgaggtctacactgttatccccactttacagatgaccaaactatggcttaggggagattcagtaactgagctctggtaattgagagactctcagccaatattgctcaaaacccatactttcctccctacactgtaattgtgcactgcatggaaaagataaattgagataagacgcaaggattcaggttgcttctttactttggaaaggcaaaaaatatatacatttttcttgttgacctggtaggtgatgatttcaggtgctgctgatgttgaagttggcttctcgttctttgtgaattcactttaggagccatgtgcagacattttctagccaaacatcatgattatgagactatatcctacaccccctgcccttggtaggccaccttcctgtctggatcctgtgataatccatcagtgcacctctgcaccagggccagtgtgtatcacagtgccctggctctggcctctgattcaaccatgcagggtgaaggaggatggctgtaggcacaggctctgctgatacgtggggagtgatgctgagcatattgtgagctcatgcttgccactgaagttatgatttgtgtgtactctgtgacgtaaggtaggtcttgcatccctgttttacagatgaggaatctgagattcagagatgctgagacattttctcaagatcacacagcttgaaagtgatagggctgggattggaaccaggcagcctggctccagagtctgggctgttacacactatattatactcctcccacaggttcatccaaggagattattctatgctgttggataggtacaaaagaacacgtatgtaaattatggtatataatactaacatgaacacctggagagcctccctgccccacctgagaaaattacccatcctgttgatgttacacatgagtgcttctcagtttctatttcttcttctgtgttatgataatcatgcccttgaaccttgtctaagtgagatgatgttgtatatattctctgtttttacttcttccgttcaatattcttttaagataaattcctgctgcatgtagctgtcatttgttcttttgcacaataatctaacatcccattacatgcttatgtcataatttatctgttttcctgttgatggactatttctagtttttgctattaggaatagtgctgtactgaatgttcttgtatgtgtctgttgtgctcatgtacaagtatttctttagggcaggggccagcagactttttctgtaaagtgccagttagtaaatattttagatttcatgggtcatatggtgtctgctgcttgactcgcaattgtactacaaaagtagcaatagacaatatataaggctgggagccgtggctcacacctgtaatcccatcacttttggaggccgaggcgggaggatcacttgaggtcaggagttcgagaacagcctgggcaacacggagaaaccccgtctctactaaaaatacaaaagttagccagcatggtggtgcatgcctgtagtcccagctacgtgggaggccgaggcatgagacttacttgaacccgggaggtggaggatgcagtgagctgagattgcaccagtacactccagcctgtgccacagatgagactttgtctcaaaaaaacaaacaaacaaaaaaaagacaatatatatgtcaatggatatggctgtgttccactaaaactttatttacaaaagcaggcaaaaggccagatttggcccttaggccgtagtttgccatcccggcttcaggtatggcaaattcaggtacctaagggtaaaatttctgggtgaggatatgcatggtgagttcttgcattgttgcactagtttacgtgcagcagctgtgttaggagttcttattgatcaacatccttgtcagtacttgctattgttatttatttttgctgctgctattatgattattatagtgtgtgtgtgtgtgtgtgtgtgtgtgtgtgtgtgtgtgtgtggataagagagtggggtataaaatgctttcttgttgtggcttccatatggctcatgtggttttctgattactaataagattgaacatcttttcatatgtttattggctgatcgtatttcctgttctgtgaaatgcctgctcatttcttttgtgcatttttcaattaactgttggtacttttttattgaattataggaattctatatatattcttgataataattttttgtcattttaatgtattgcaagcatcatctctcaactgtggattgttttttcattctgtttatagtatcttttgttgaacagaaattcctaattttaacattgtcaaatttactactcttctttttatggctacattttttgtgccctgctgataaggaaataactttcttatttttaataatttatagattcttttgggttttctaagtagaaaaccacataatacaattgatgataatagaactttccttcttttgaattattatttttttctccttattttctggtcttactgtcctaacttaagcctccaggagaaggctgatgcaacattctacaagtggtgcttataatagcgtaattttatttctcattttaaggggcatgcttctaacatttaccattaagaatgatactgtcagtttgcagcagatatactctataagttaaagaaattcctctttatttctagtttgtaacaatttttagaaaacactaagactttatatcttgagctgatcataattatttttcatctttactctgttaacattatttatagaatactttgtctaatgctgaagtatcctctaattcctatgagaaacacatcttgggcatgatgtattacctttttaatatatccctgtattccacttgctaataatactcatcgtctaagtgtgaagtttggactagaaggtacctttcttgtatagttcatgcctactagctttggtgtcaagatgatcaagtctcacagaatgaagactttccatttatctgaaagtttttgcaaattggaatcacctgggctttctttgcaggaagagttttaaaattctgattctatttatttaatagctgcagaactcttcaggatttctgtttcttctagagtcagattatgtaagatatgactagtcgtttgtccattttcttgacatttcaaaatttgttggcccaaagttaacagtattttcatatcaccttttaaatatttcctatgtgtactcatttctgaagaggcttgttttattagtcatttcaaagaagcatcattttgtttgtggcttatctccattgtgtctttgttcactagttttctcttttttcttaccccatctgttaggtttcactttaaatactttatttttcattgctgtatatttttattctttttcagatctggttgataattttggagagtcacttttccatgctgattcttcaattctatatttctgctgaaatatttatttattttcttaaacatttcaaaaacaccttatattttgcatatggccatcactcgtggaagtttccttgtgtctgtggtaattttttattgtaagcttgtatttcattaatctgaattttttggactcctgagggcttttgttctctgcctaatcgcctctcccagtccttgcccacccactgcctgtcccccttacaaggatttgcatttgcatctgttaggcgccagggggcacttaggaccacattcaacccttctgcaaatatgggcttgctagaagaatctcagttccctcgcttcagtgagtcccagttcgctctctcaagctcagtgcttagattggcatttgctccttataagaagaggaagagagaccagagagtgctctctcccacaacccctcccttggagatttcccttacttccttgtaagctcaactatgctttgaaaagcatatttgctcttatctagctgtagtgtagaggagggcctatcagaaaatgcagtctcccggaagcctagaaatggaagtcattatgacctccttcattgtcctgggatggtataccagagctgcatgtttgaaactgggaataaattggacacaccaagctatttatctccccttccatttgcgtatttttaatgcacagatgagtcattttaagctttttcccttttgtggactggagatggggctagtctttactatccaggggagactttaaagtatgcaactaagtttggaaaaaggctaaacaggattgggttaaaagccaagtatcaggataaatgtaaaaaattctatttgtgctcctagcaaagtgactgcagacagcatcctggattcccattgtcacagttgctttactttcctccagggtatctttccagtggcagacagtggagaatggagtttgccttttgaattttgaatctttgcagacaactggagaatgatcccagaaacagggtggcgagtaaaaacctttctgagccctcattcaaccacagactcactttgcacttgaggagaattagctgttttgccataagcgctaagctgtgctgtaagtgctaagttgacagcagtttgactgggacccaggcatgagattggatcacctggtaatgtcctttcctagtgcaagtgggtattggaaggtctctgtcctgatgtgcagtggaatggaagccacagaaagaatgactgaagctttcagaagttgagaccacagtgatgcctgggagattccaaagagatggccctagaatacagtcatgcaaattctggtttgtaggtacttgctgtaggtaacaagatgaaatgaatgccagtggagtttgggtgactgtcttaaaagaagtgtgttttcatagttgggaaagggtagatgatttggcttgaaggaaccccctctggaggaggaaattgaaaactgcagtttttcgtacctttcactcagagagaaggtgctgtggctttgctagagcgttcacttgtattgtatcctggtcctttagagctagtttttattgaatatgtcttccaatatttacacagtctaattctgagtacttagaaaagaagtcttaaataaattgtccttggatcattccatgtgatttaactactggataggacccggtgacatggaagtgaagtgacttaggtatctctcatcctccttgtcagagacaccatggccatttcctacattgtcaaagtgtacagttgtcaaagttcctagtcaaagtgtacagttacccccttttggtctactcttagggttattgaaatacataccaggactgagtccaggatcccagaaacccagattctggctttgtcagtgtgtatctgctcttgagcctgtcatttcatctgtgtggatacaattttcttgtttataaaatgaggttaataaggcagtctttaaggtttctttgagttctgaatgttcctattccctggcagcagatggtttatgtctttctgaatatagttttttgttgctattgtcactgcagcatatcctaagcctatcctgattgatgtcttactctgcatgtggtactttctagagctttatatgtattaactcatttaatccccattaaatgatttatcctcattaaatttaatgattccaaggtagaaggaattactactctcctccttttacaaatggggagaccgaggcacagaaagtttatcaatttctatggattatttctcttattatattttataattgaaattgtctatgttaaatacataactgaaaatctggtaatttttttttttatttttattttttttagatacagggtctccctatgttgcccaggctagtcttgaactcttgggctcaagtgatcctctcagcctcccaagtagctgggactataggcatatgccactgtgcccagcttggtaaatgagttttgaaacttgattgagttgaattgctaaaaagtagaacaatgagaaagaagagagtaggagggggagagaagaggggagagggaggatggataagattacttcacatcccctccccgtcttcaattatgtaaagcaaaaggatgatcaaggatctacaaggtatgtattttcctcaaaaatcttttttgtaggaacaagattcctatttgattttgaatatcttaaaattaaaagaaaatgaaaactaaaagaaaatgaaaaattaaaagaaaatgaaaatataaacatgaatttgagaaaattttgaacactaaattttatggtgattatgagattgcttcatcatgctgaagtcatttagtgactaatagtgtgactacctgaaaaatagattttgcttcttaataaatgtacagcctggaagcatccatcgtaaccacttctgaataaggaacagcctggttaggatggctaattctttctttttaaatagatatggggtctctctatgttgcccaggctagtcttgagctcctggcctcaagtgatctcccatcttgatctcccgaagtgctgggattacaggtgtgagccaccacacccagccaagatggctaattcttatttttgagaatttctatttctgttataaatgcctacctgtctgcttttactacttctcccctccccatccttttctcctgccatcttgaagcatttgtcccaattcagaggccaatgatgtcgtggtttgaacaggggcattggggtcaaagtgtttggatgaacacctgtggctgtaccacttacgtaggtgggtgactgggagcaggttacttaagtactttttgtccccattttcttatgcattaagtggagatcataacagttgctaccttttagggtggttctgaggattaagacaccttaggaccatgcatggcatgtggtattacaaatgatatacagatttttgctttcactgtttcttaatagatctggtctgtccttacctctttgcttttacagtttctcttctctttccatcattcttcacagggatgactctcatttgcccttcaaataagacatagtttattggtggcctcttggtttgggatgttttcctacatgcccctagcctgggttccctcctctctgcatttctagccacctggttatgacttctattgtaaccctcatgacatagtgttgcttctattggtttacttgtccacatagactttgaatatgggctattttttttcttttgtttttctttttttttttttttgtatttcatgagtatgagggagatactcagtaactgtatattgaatggataaatggaccaattttccctccattctcctctgctccctttcttctttcctgcttttcttctttcttatcttccttcacttctgccatccttcctccctcccgttgctgtcaaacctggcacttgccaccttatcttcattattgcccacaggaaccctatagtaggcattatgattatccccactgcgtagatgtggggacaaaggatcagggcaataaggaatgtgtccattcaaaggggcagctccctcacagagtggtctttccaatgttgctgtttctgttcaaagcatttggcagtttttctttggaatttccttctggctggtttacgaatcttaagaagaccaatcttatttttggttatgctcagaaaagatcatttcctttgtgatcatcccaattcatgatgtttgactccagataaacctggatcatctcagaaatccaagccaccttcaaaggacaaagatttgccatggtcaagaatatttaaatgacggccggacacagtggctcacaagtgtagtcccagccctttgggaggctgaggcaggtggatcacttgagctcaggagtttgagaccagcctgggcaacatggtgatacctcatctctacaaaaaatacaaaaattagctgagtgtggtggcgcacacctatagtcccagctacttgggaggctgaggtgggaggatcacttgaacccagaaggtggaggttacagtgagccaagatcatgccactgcacttcagcctggggactgagtgagactctgtctcaaaaaaaaaaaaaaatctattagctgggcgtggtggctcacgcctgtaatcccagcactttgggaggccaaggcaggtggatcacgaggtcaggagatcgagaccatcctgactaacactgtgaaaccctgtctctattaaaaatacaaaaaaattagctgggcgtgatggcgggcacctgtagtcccagctacttgggatgctgaggcagcagaaaggcgtgaacccgggaggcggagcttgcagtgagccaagatcgcgccactgcactccagcctgggcgacaggacgagactctgtctcaaaaaacaaacaaacaaaaaaaaaaacaaaaaaaaaaaacaaaaaaaaactatctacctatctagctatatatgtatatatatatagatatataaaatgcctcaaagacagttgccaaagcactctttcaagagtcttggctgcagccgcatctctgggctgaaggctgcggatactcctgtggactctgttctaatgtggtttaaggacagcgggttggtagaggaaggttagattactttatggtcccacctcatgatttttgtgacaactttgttgatatataatttatgtaccatacaattcactcatttacagtgtgaaattcgttggttttagtatattcacaaagtggtgcaaaggacacccctatctaacttgagaacattttcatcaccctagaagatgccccataccctttagagtccccccatttactccacaccccccagcaatcactaatttattctccatctatggatatgtttattctggacattctattagtggaatcatacaatatgtggtcttttgtgactggtttctttcacatggcataatgttttcagatttatccatcttatcctgtatgtcagcacttcattcctttttatggctgaataatattccattaaattgatatactagatttcatccattcaccagttgattgacaaatgggttgttaacactttttgactaatatgaatgttgctgctatgaatatttgtgtctgagtcaactgatgaatggatacataaaatgtggtatattcgttcaatggaatattattcagccataaaaaggaacgaagtacagatgcacactaccacatggataaaccttggaaacatgctaagtgaaagaaaccacttattgcatgataccattgatatgaaaggtccataacaggcataaagacagaaagtaaatcagtggttaccagggcctggggaaagggagggagatggggaatgactgctaaagggcatgaggtgtctctgaggtaatgttaaaaaatttattgtgttgatggttgtacaactttgtatgttacactttataggggagcattgtattaaaaatgaataacctccatcattaaatacatatcagtttctttctctgcattcaataccctgagaggcactgtggtatacagatgagaatgctctaataatttctcaatggacattcataaatgggaatatgaattggatacccagaaacaatataatcaagatggtgcatcacccagtgctagtttctgggtgtaggccacactcagaaagatctcaatacctctgagtgtcagctataggaattcagaaagatttcaaaatgttgactgctccaatattcatataacttatagtattaccccatgccttacaatactgtgagttccctgtgggcaggagctatgtcttatgtccctcttgattcctgtgcttagcactgtgttcattccacaagcaggatcatgtgtttggcgaatgaacagctgctgtcttggaagcatcttggcttgtccatagggatagaaatgccttcaggcttgtggctgccttctctgaccagcctgggggtttgtcctatggggaaaggtgttgccaaattcatcaactatcttcaagcacgggtgccttttctcacatctgataactattttgtttctctggtgctttcactctgactttgcttaaaatggtgacccaaaataacagttgcttccctctctagtaatactttcaagactttctgtttctgggtcagtgagatttaggaaaacaaaaggtgggataaacctcaggtttggtctttcttttttttttccatgtctatcaaacgtcaatgctataaactccatgtagcttatgggtctttgctgtaattagaatttttttttctttttttttttcttcttctgtgaaggtactttgtgttaagttctttctgttaaatatcctttgcttgcactggacttttctttgtgttgattttttgcttcatttttttttcatttaccatgctgttcagttactggatgccagaagaaccaaggtttgtccactctttgcagcttgtttgttctgctctgtgcagcctcacctccttgtgtgtttgagtgtgtttgtctgtgcctgcatttattcccttttgcttgcagatgcagtaatcctgtttactaaacctgttcacagctttatttgtaaaaaataaagtctttgtttgtgtctacttgtagtggatgctattattttcatttttaaatcaccacatattgatcgtgggaaataatggatagtacaataaagaataccttaggaaacaaggaatactgagtctggagcattctgggcataaagaaggtgtgtttgtgaaagtttccttctaaccttttccatttcctaaattaaaactctgtagatgtataatttcccttgtgattgacactaatctattgtttctgtgtgtgtgtgcatttctcttctctcaagacattcagaaagcatcactgaattaatctccccctctccatgtgctgtcccatgcttctgaagtcaccgtggaggaattcatggctggccctccggacctcatgattaacattccatcttcatagtgtggtggcagcaagcggcacttgacattttcattgactttttttccttctttctcctctcccgctccatctttctcattgcagcacctacagttgacaatccaggcccttcaagatgagctgcgaacccagagagacctcaaccacctcctccagcaagagagtggcaaccgaggagcggagcacttcaccatcgagctgaccgaggagaactttaggcggctccaagccgagcatgacaggcaggctaaggagctgttccttttgaggaagacattagaggaaatggagctgagaattgaaacgcagaaacaaaccctcaatgcccgagatgagtcaattaaaaaacttcttgagatgttgcaaagtaaaggcttgccatccaaaagcctggaggatgacaatgagcgaacgcggcggatggcagaggctgagtctcaggtcagccacttggaagtgattttagatcagaaagagaaggaaaacatacatcttagagaggtaagagcattcactgtatttccccaaagccttaatttataagtgaaaatatgttatcaagttattttcacaggttggaagatatctacatccttaacaaaattccctttgtcatctgctttatgaccttcctgccggcttaagaccattaaactggaattttgtattagtctttgctcactgcacatgcattccattattattcagcacatatccgcgatccaagcatatacaggacatatcaactgtaagttggtttataaacaattgctttcccacaggtggctgtggtttcagagtcttttaggtatggtactattcagtttagttgtttatcaaatatcatctctctaaaggaaaaaataaataggattagcaacacaatgaccctaaatatttttattactgaattggggatgagatttgcagaaagtaaagcctatgggaaagaatggtaaaatgcacagaccaattttgagtgtttagggttaagataatttttgtctgcatttacatttgtctaggacagagtattacaggttttctgagtatgtgttttgcccttagtagattaaatcatttgaagtccttcagaggcagtctctctggccttttaccaccattcaatgttgggatgctcgtgtatctgagaatatgtggttgggtagagcttagaaaaaatgtggatgactgccaaggtttgaaattttaatagcagttccttgccactgtggtggatatggaccttaaaagtatcatgcaggcaaaactgctgtagggagacgtggatctcacagaaaataacaagcaataaaatggcattaaatatgttttcaaactattctatagcaataaataaaaattctagaagatatttccttctagaccaaactagatttcttggcagtatacctgttcagatggtggtgcttcttgtgagtcacttgtttggttggtcggaagacatggcttccatgttgggatttgcaaaagtgcagatgctcccaggaatttgctctgatgtgggttatatttgcctagcacataggaaaagacttttgtgtctgcaaatttaatgtcctctactcctattcttccttgtttcgttttaatgatactttaccaacatgcttgggaaaccacatggcttggtttcatattgaaaagcttaaagagatgttttggttgggcctggtcttcccatccatcttccaagagggtgaatgtggtgagaagacttccaagatggcctccaataatccctactccttggaattcacaccattatataatcctcttcgagtattggttgatcctcataacttgctcctaaatgatagaatatggcaaaattaacagaatgtcaatgttatttccaggattaggttacataagactgttacttccatcttactagcagactctattgccttcatagcttgcatgctttgatgaagcaagctgccatgtggagaggcccatgtggtaaggaactgagggtggcctccagccaacactcagtaaggaacagaggcactcatttcaacagccacaaagaaaggaaacctggtaacagccatttagtgagcttggaagtggatcctttcccagtcgagcttcagataagaagacaggtcctgggatgacatcttgattgcaggctgtgagagactgtgaaacagaggaaccacttaagttgtgccttgattcctgacacacagaaactgtgagataataaatgtgtactcttttaagctgctcaattttaaggtaatttgttacacagcaatagataacaaatacagtagagcagaaagtaattttctccatgtcttacttcatagacctctcatgtagtttacagaagaggagcaacaattactggcatgttgttacttgcatgtagactaactgtggattttggaatttttcttgtgttatctcaaaactgcagttgatagaggatcactatagttggaaaaagctgctgttttattttgatgccaaggggcagcaaggctgtgatgccagagaaatctccatctgcagcaccatttctcactccttgttgggatcttgtggtcagggtggagtcattcttcttctgcaattagattctgctcattgatagcacttactagatggtgccttatgtggctgcctccatttaaatgaatctaaacacaattcatcttgggttttctgagattggctggttctcacaatggtctggtgtggatatagatcatgtttagatccctaaacaccagtttgaaagcacacagaagggagaacagaaagtgcagaccaatacattcaactagtttccctgagcatcagaccaaagtgagtaggtagcccttattttagctcatcaagagggggagaatttggaaaatacatctgtatataaaagactcatgttaaacttgaactcagcaaacaagacttgaaggcctgaaaggatcattcccatgagaagggttgtactgccctgtgagagccatttgttaaattctcaggaatctcatgatcctggtgttaaaccacacgtagcctggaattggtcatatttggtgtatttacaccatggaaattggaagatgctactcttagggactaccttccccattcccttgcccattcctgaaagctggtttactggcacacctctgaatgaatgttgtgaaatgtttacctctaatacagcaagaggatacactgtggagtcataatgttacttattgggagaattatgattatgtgtgtattaaccactcacggttccccaaaagttttcaaaatagcatctgtatgtgtcagcttatgtgtcaggcatcatgaagaatgctttacgttgattcacactgaatcatctcattcattcattcatttattcattcatccatccattcattcattcattaatccatccattcattccttcgttggatgaatacttattgaagatctgttttgggatatagcaatgataattaacaaaatgtaccttcatggtgcttacattctattgggggaaaatagatgacaattttatggtttaaatagaggcgtgtcatgaagaagagagtgaagcactggtgatgtgggtggggctaattttatgttgggttgtcagggaaggcctcttggagggggtgacagtatgaactgagacctgcataaccaaaaggaccagccatgtgaggatctcagaagactgttccactcagatggaaagacccatggcctaggaggtaggtgctgttactttgcccatcttacctgggggaacagagggacaaacccaatgtcacactgctaacaaatggtgaagctagtgtttgaatcagcctgactctggagtctcagctcttaaaccattttactatgtcccttttcttttcttttttttgcggggggcggtgggggacggggtctcactctgtcacccaggttggagtacagtggcacagtctcggcttactgcaacctctacctcccaggttcaagtgatcctcccacctcagcctcctgaatagttgggactacaggcatgtgccacgatgcctggctattttttttttttttttttgtatttttggtacagacggggtttcaccatgttgcccaggctaggctcctgagctcaagcgatctgcctgcctcagccttccaaagtgctgggattacaggtgtgagccaccgtgcctggcctacatcccatttctagaagaaattttccccaaattgtgcttggcagaacagccattttgtgggctgttgatatgtgttatgagagaaaaagggttgcagtgccaagtgaacttggggaaatgagggattccacagagttacagtctcagtctttaatatgcaaatatgcattagtcatttccaagaaggggaccagagaaggcagagcttctcaaacttacgtgacttgcttttctcttgttgcactggtgttctttgtaagacatttttgaaaaatgctatgctagaaaataaaaagtgcttctaattaatgacctaccaaatacgtaataatatacaaatggttgtttcccattgccaaataactgggttatttccttcattagttattttataaggcaaagtttattgcaagctatttccatattctctactgagttttagaatgtactttgtcagggtattttttttttttttttagtagaaagaatgtgtctgaccacttttgtcattataccagtaagaataacttagcttgaataaagaaattgcctgacctctgttaatatagatgaatctaaaacaagatttaaaatgtacttgaggttttaggttcagtgtgttcctgatttcattttcattatgcacagttcgagtaggttggggctaggcagtgtgaagctggggaatggagtgctagtggttttatgattcattcttaggcagaggtggtggacctcacataaaccccatctcctggccttgttcagcttattgttttaggagatttggagttggcaggagttgcatatggggtgggttgctttagtgtcttattgtcttttggtggtctggaaaaggctgagtgtgaaaccacttctttgtctggcaggaaacaacaacaaaaaggttatgatctcaacttacttggaagaccaaaaccattgcgcaggaactccaactgatgtgctaatgtgagccaaagggttggccgaaactcagcattactcactagcattgtctgatgtatttggatgcaggttgatttgataagacattgtttgacgtttaccttgttctctagctttttctgcaaagaacatattgttccatctagaagttttagcgatcaagtatttgaaacacaactgatctcattaaagaaaaagaaatggattaatagaccaagatcctcttatacttaccctgcttactattttcttgactggtccttagaagagagataggggtctttggacttatctcgctgtaagatcttgatgggaagcagtatatgttctgctgctaatcctattgatgtcctgtgttaatccttttgggcatcttgcccttctttggtagcagggccagaagagcacccaagtctttacaggccacagttgctaataacccaggacaagcaaaacccccaggagacctgggcctccctctgtgctgggggtgggcagacaggagaaagaggtaacatgaattattggtctcctggtctccttatccaggttgaacccaggacagtgggagatccaccaaggcaaaaggtattacctggaatttcttaagctttcagacctttactgatggctcaaacttgtcctgtataatctctgcccaaacttctaaatgccattccggtcccccttctcaaaaccacatgatttccttaatacatgcttgtccctagttctgctgacctaagccatgattttgctgatgcaggcatttctaattctgtctctacagattcaatacattctatttctaccaacaaagctaattacagaaactattcccaaacatataaacataacattttatatacacgatcttttacaagggctgtttcctatacatattacagaacttaacaattgctccctattttaatacagtaaatttcttacctgatcagtacattccatcagtattcccagacctcagatattgccagtagctgctcaataaatattgtaatgagtgaaaaatttgttaaaaatatctagagaattactctgtgatttattttgtcagtatcagaagaattcataatggttggtatgagctccattaaaaaatgttttctgcatcattgctctatgtttggagtagagaagaaactttgcaggtagctttaactggcagtcttctttcatttttttctaaaatgtgttggacatcattgggcatatgttgagcatccctatggaggatgctgtgggagtatcagtggcaattttgtggtcttgttcagagattcaggtgagcaataagaggaacagctcataattatcaagtattgtcctgtgctaagtaaatactgttgtcatcatgtgtattacacagatagggaaacagaggcagagtgaggtaagtaattgcctccagtcacacactgcaaaagctgcaatcaagagtggaagctgggcagtgtgactctagactctgtacctgtccccattgcatgctactgcttcttggggtggtacactgagaggccttgaatggcatccaaatgctgtacagcttaaaggtaggagagctgacaactggcttcatccacggtagaaccagtcttcaaggcaggaggaattttagcacatggggttggtgggaaagcatgattggagagcagatgactgagtcaaatcacagaggtaggaactgtggagagtttgaggcacggtgagtttggagcagctgaaactctgcctttcagtgggggaaggaaataaagctgagcagatggtttggtctcagatcactgagggctctgaggcccacacacagggaagtggctttactctgtgggctctggggagcctttgaaggcatttgacctggagaatggcatgaccagagaagatgatcagttgacagtggattggatgggaagagaacaaaagcagggagagaagttagatggatactgtggctattcaggttgccaagagtgtgaatctgggtggtggccatggaagttgaagggaaaggtcatctccacctgtaggcaggaccttgacaacttaagaactgagtgctgggagatttgaggaggaagagacaactgctgtagacctgtgtgcaggcagatatggtacagcagtgggcaggcaagggttgtcagcaggaggagctaaggttgagggaagacttcgaatgtgttgagtttgatgaaatcttggtggagccgtgcagccaaggttgagaatgtgggtgaagaaatgattgtgacgttctgcccaagtacacaaggcatttctgactattgctcagttttatttatttttttcacacacatctgataatttgtaaccaccacgccccaaggccgtgagcattctaaggcatgccttttcatttactcctactagtatttaaccactagaattgaatgtttctcctttgtgcctctttcccgagtaagcatctgattttgaatatggtatctcttttgagattatgtggaattttcattgactgatgctagtttgagacaaattccctttgttttcactgagttccattttctccgagtactccatgcaggatggatgtcaatgaagcatctttccagaaaagcgctctctctgtaatctgacagtgcatccaaaagtaggctttcataatttttatcctcacatttctgatgacacggaaaataaattcctttctgtttagcatcatttgccttatctttaaattctcatgcattcttttaagtttgaatgctacatgctaattactccattttcatttcaatgagtatcatcaactgctttttacggtaacagagactggtggagccccagaaagccattagacacaaggcattttgaaacctgctgagaaaagaaagtgacagggttgggggtgtggggaggcaccagggaggagtgagaatgtccggaggttatgctgagagaggctctgattacttcctcttcaccctcatcctcctgctttaccttaggtgtgatggcgctctgaaaaatattttttgggtaactgacataatttatcatcatcatcatttgtgatgatgccccacaaataaaacctcagcagtgagaaagtaccccaagcacaggctctgtgagtatgttagcatgtttcataagctgcagcaatgggtagttgagacaggctcagctataccaaggccctacctgtcttgagtggaaacattaatactttacatgtggaggcggcttggtatataaagcctataaacacattccattataaaacacattccgttttaactatttcctcagatacttttggcaaccctgggaggacatggagactcagagaaattaagcagtgatgacatgtaacatttactgggcactcactaagggcagcctgtgccagtcacttcccaaggagtgccatttaattcttccatcgatactctgaacggaacaatggtttctctgcctctcaggtggggaagttgaggccttgagaggtgatgtgactggcccaggttctcagagcacatagtgatggatggatctggcattcaaatttggacttgccgattgaagtaccttgttcctaaccacttcttgatgctgccagggatttcagtgtaatccagagtagaccacagactaggattctggtcttctagcttcttgctgaaggttattttctcataaatgtgaaaaaggaagaaatgcaaaaggctctgatttattttcttgccacatcttatcagagcctgttgaattggggactataaatccgtgaggtcatagagcagcgggaagattaaacagtgccatgtagaaggcaacgtcagggctaggtcttcccattccatttttgactcatgaaaatgaaagcacctggccctccataaattctgcacaaataggtgaatttttgtgagcagagaataaggacaaatgtgtggcacttagacctctcccatttcatcaaagttagttttattttacaatttttttaacttcttgaatatctcactgccaaaaagaaatgctttgtctcccaaaaccaactttactttttacctagtttttgttgagtattttgtgtttctttctgtgtcaattgtgagacacggaaattgcatttgtaactcctaagacatgtgcatttcattgctcttctaatttggtaaaatctactttcccttccaccttggctcagatgtgaaagggctactttatttgggtttccagttaggcatgtaggttgaggggtctcttaagtgtttcggatagagcgctaaaaaggcaatgtgaactgctaatgggtgattcctaggagtggctatcgttacagcagctataacatataagaatgaattaaattctcactaaaggaaaaatataattctgtataagttgtttgtagaaaaaggaaaaagaaaggtgagtgagacttcatgagtaaaaattacaaagacttgctacgtttttagattgagatttggcaaactatagattatgggccaaatgtggcctgcagcatttttttttttttaaatggcctgggagctaagaatgttttttacctttttaaatgattacatttgaaaggattacgtaagtacgtatatagtaccctttattttgcctcttggtccacaaagcctaaagtatttactatctgcctctttaaatgtgctgacccctgaattagataataagtaagtagctttctgaattaaggataagtaagtagttttttgaatcaagacatttggtaaaagcctgtctgcaattagttatatttagaggatcaaatcttactgttttcacatatagcttttgaggttggtttttaaatcaggaaacggtatttttttctgcctttttttttttttttttttttttttgagatggagtttcacttttgttgcccaggttggagtgcaatggcacaatcttggctcactgcaacctccgcctcctgggttcaagcgattctcctgcctcagcttcccaagtagctgggattacaggcatgcgacaccacattccggctaattttgtatttttggtagagacgaggtttctccatgttggtcaggctggtctcaaactcccgaccttaagtgatccacccgcctcggcctcccaaaatgctgggattacaggtgcaagccaccgcgcccggccacctatttttctttcacagttattagatctgtagttttgatctctgattcctaacacattgggtattgtcagttatcacgaaagtctgcacctcttttaggagtggtgtgttttgggaaggaaccccggcagattccaaagggactgtgaacaaagacttctttaagaatcaccagagaagtggagattgccattcaaactccaaaagaattaggacttccttacctgataaaaacacaggcttcctcctattcctcctcctccttctctttttaaatacctgtgtttattgacactttttagccctacacaattagtgctttaaaaaatgtggctgctttgaaggaactgacctgaaaaagaaactgtgtatatctgcaggttgtgttaaaaaatattgacatgtggtagttgttagtgtgccatggccttgccaggtttgcccatggacactggtcttactcagctaagccagaatttggtcaggaggacagccagttcccttatcactctctgcccttcttcctgcccccagggcaatcagatctctcgcatctgtttgagctgggctgccagacatttgagcatttttagtattgggggaagactgcctgttactaggatgttgctggcttggtgtagcccagggattttcagtctcagcaaggttgacgattgggcaaggtgattgttgtgtggggctgtcctgtgcattgcaggatgtcgaatagtggacctttgcttactagatgcaattagcacttacactcttccccagattgtgctgacagcaacaaaacagtctccagacattgcaaaataattatggtggtgaactgctggtatagagtgacccatccgttctgctggctggcctggggctgtggcaaggacagtaactcctagccccatctgcttgaaacttggttttattgaggaaggacagcccagatcaggagacttcttcacccggagtctgactccaggggatttaactagaaagcagatgtgctggggggaggtagggatgggggggagcttgagcctaaaaagaaacataagagtgtgtgtgtgtgtgtgtgtgtgtgtgtgtgtgtgtatgtgtgtgtgtgtgtgtgtgagagagagagagagagagagagacagagtgattgagattgatagagacagagacaggcagatggagggagagattgagagagaagctgcctccaactcccccaccccaactgcactcttctctctcagaaactgtagggctggaaatgaggcaagtcctgcaaaagaaatctaaaggaggggttgggggtggtgttttatctgatataccacatgggaagattgggactttgtgaaaataaaagacatttgattctcaggagtatttatggaggtaataattatggatctgagaagacacataagccttacattttgattactggactctcactattaattggcagttttattttacagtaaaggttgtcatccctgcttttccctaaatggcctttgtgtctccctttctgttttttaaacaaacatttctctacatgaactgcctcttcctcctcccctgcttctagcaccaccaaacttcggaataattttggagtgtagtggttttatcatgtggaaatgcagtgcagatgttcaaaattaccttttctttccccctttaaaacattgtgaccacacatgctttgctctaagtactattaagtatttttattattgctattaaaaatcttgcctcaggcagagtcccactacagctcaagtcaaggcaaatattaaaatagcagcaagtatttatgcataacacgttaaaaatctgaactcacatttggctttttatgcaattgaaacctttattttttgacccacttgaccaagtcctctatctagttttatcctattttcctgactctaaaactttaagttcagactatatgattttgttcacctacaccactcaccccaaatcttctctaaacttgagttttttctttaccctgcatatatctttgaacttagcctgattgtagaatgaattttgatgggaagatttcaactgccagtgtgaattagttagtgcatgttttaaaaagttattaatgaagcagagttctttttttgcagagaatcttgcagatttgtggcaggggttctgttcttggagtgccacacactggggccagtggccatttaccaaggaaatgcttatcaacacttaacacatcttgcactcagaaacctatttaaggagattagctgccactctaagcttaatttcttttaggtttatctgtgccgctttctttttgtaccgcttgtccagccttaaaaatatttctccaaagagttccttaaaaaaagcaacaacttcttttatgatttaatcacttgaatctggaattaagagctccctcactacctatgtgcactttttagtgtgctagaaagtaatcctggtttagacaaatgatcttctttaaaatgctccttttctcatccatattcaaatagaatacattgcaaggtgatttatttgtaaagggtggagggggcctttgtcattctggcagagtccacacagcaaagaagaggcaaactctgattgtgccttagacagtagaaatgactttttatttttttattttttagatggggtcttactatgttgcccaggctgatcttgaactcctgggcttaagtgatcctcctgccttggcctccccaagtactgggattacaggtatgagccatcatgcccggccgagaaatgactcttaatgtaggtgttccactgtaccttcatgatacacagtggtgttcctgtcagtggtctctgttgcaatactttcatgatgcatgtcaaggtttagatgatttcaaagattcaagctttagctgctttaaaggacagaatggtgcacgatggctaaatctttgccaattgcacattgaaagcttgagatgccttaaaaacctgccaggcacaaacctcagtgggtattgttgggatgccccttaagcaacccttacaggtagagcaatcatgaaatttagtggacatttgaggatatttgtgctgaccgtggggacttctgagacacaatgacacaggcttttccagaagacaggaaacctttgtgaataactcattatcttttcttctttttctaggctgtggttatctttgcatggtggctctttgctttgttgccctgcagatacaaatgtgtattgcatagaggacttagagagaatgatctaaaatgaccacatttcctgaaatcacagatgcctcctgaggaatctgtgtggcactggaacatttgagggttgttgggcttatcatggaatagaggtcatggaatctcatcttgggaggtcctggtgggatgctgttgatagcataaatcagcagcagcagcagcagcagcaccactgttagatggaagatcttctagctgcaagcatggagctcagtgctgtactcagttcctcctcagaacaactctatgagatgtaggtgctgacattgtcctattacctaatcagggcagttaagtaacttgcctgagacctcatgggggacttgacctcagaaatgagaaccagcataccatctattgttttgtagaaagtcaaaataacttctagtcatttcttcccacccaattcctttccttctttctggtttgttttctttgaaactttccttttctatttgggcttctcatctggtttctattatgacctcatttaaaatcttattctttctcttaatatgttggtttccctctcttattttaaccttaatcattttcctcccattgttttttcatctgcattgttttatgaggttaattgcctttgttgtcatatttctagtagctgttctgcacttttgcaagagacctgggaatgctagtgaaatttacaggagacttgcggtctaatagaattttaatcagcagttttctctgcctgctacaaaatctttgcattcacctgcttgggtttactctttggtctcaagtgacatgacctatgcaaagcactttgcacaggcttggctcagcaaatatcatttatgtttccttgaagaaaaatgaggaggggataagcaagagttgccctcggatcagttggtctccttgtaaagcaagttcatgcaccctttgcaaaccattgacttctctcctcaggatcaaaccttgcctggtggcattttacatgtcacttattggggtactgatgtttgttctgagatgtgacaaaccttatcttcatcatcccactttcattctgtaattgcttcagaatgttatggagacaattctactgtatgggaaatatctgattcacagggcttcaataagtaaacttaaatgtaatacatgttaaatactcgtaaagctcggcacttagtaggtgcacaataaatgttagtctacatgtagaaacatatgtctatatctatatctgtatctatatctaatctgtcttctctcaagactgtgcattccctgagggcaggaatcacattgtactcatctttagtatcaccagcagcttgcacactgttctttatcattattgatatatatcctgtcataattgtgcacaaattgtaagcagagataatgtcctctatacttttttttttttttttttttttttgagacggagtcttgctctgtcacccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgtgcccggcctgtcctctatacttttaatgtcctatagcaaatgaagtattcgatacatttagaaaatgactggggaaggaattacaatttgttacagctttttggacaacttaagaacttcttatgatttatcaaaatattcttaatgggttgtgtataagctgttcttacttagctcccctttattgagcacttaactttgtgttgggcactcaactaagtgccaagcactcattttaaatttaatcccattcaggatttattctctttttaaagataaggaaactgaggcacagagaatttgtaacttcctcagggtaacatagctgccatgctattagaatataagtattgttctttcccttactcagtcttgcctgtagaaatagtcactcctcatagcatatatcataaccatagcaatagtaacagtagtactcctgaagctaaccttttcattaaaacatgaaaactcggtagacctagttaagtatataccaagtggtgagtggcaactttgtggaaaattccatcccaagcctggacctctctcttgagcaccagcaccatacatgtaaccatctagtggacttcctgtgggttgcagaaacatattgggattagcctgtccagaatggaacttgtcttcttcccaactattctccccctgtgtccttgtcttgctgtcaccaccacgtacctcccaacccaagccagacactgggaacctcatcaatttctctttctccatcactccctgtattagttttttattgctgcggtaacaaattaccacaaacttagtggttttagacaatacaaatacatgattcttgtacagtcctggggatcagaagtgtgaagtcagtttcactgggctaagatcaagatgttgtcaggcctgcattccttctggaagctctcagggggaattcattcccttgcctttcccagcttctaaaggccagctgcactccttggcttgtggcacccccctccattttccagccaacactgaaacattttcaaatttctttatgacccttgcttctgtggtcatatttcctgccccgtgactttgaccctcttgcctccctcttatcaaaacccttatgattacattgggcccacctagttaatacaatataatcttctcattttaaaatccttaactcattcacatctgcaaggtccttctgccatgtaaagtaacatatacacaggatttgggaattagtaggtggacatctttgagggggtccgttactcagcttaccataccctctgtatccaatatatcactaagccctatttattctctctctctacacacttttgagtctgcctaagttctttcatttccattgctcttacctttggcttggtcctcttaactggtctcccagcttcgtacctcttgtagttcattcttcatgctactctcaggatcatcttagaaaaatgtatgtctgtcctttcagaaccctgcattgcccgaaggacaaagtacaaagtcttgagcctggcttacaaggcccctgcctacatttttccaccttatcacctacttttcctttctcacttgcctctcccagtcagcttaaactctggctttgctgaacagccagcttctgggctctgtgcctgtgtttgtgtgactcccccactgctggggcttccttcctcctccatcctcacttgactaacccttacttgtcctacaatattcagcccaggtgttttaccttctctggatatcctcactttcagtccttcctgccctggactggattaaggtccctacttgtgcatatattgctcataacaattactaaatattcatttacttgactgcctttcccactagactgtgaaatatcaaaaggaagaaccatgtccagttcactgatgcttccatgaaccctagtaatgccttagtatatgataaaaacccaaaactgttagggaatgattttggagtgaagctgcattagtgttcttttgtgaaggatcagatttttatttttaactacttacagacttacagaaaatttgcaaaaatcaggcagagggtttctgtatgtctctcccctagctttcctcagtgttcctctcttacataacttgagtacaagtattagaaccaggaaattaccatttctgcctggtatggcacatgctataatttggatatgtaatactcaaaaactcatgttgaaatgtgatccccaatgctggagttggggcatagtgggaagtgtttgggtcatgagggctgattcctcatgaatgacttggtgctataagggtgagttctcactctattagttcccatgatagctggttctttaaaagaaactggcacctcctcctttctctcacctcctccctcaccatgtgatctgcacgctggctccccttcctcttccaccaggagtggaagcagcatgaggccctcatcagaagctgagcagatgcctgtgtcaggcttctttacagcctgcagaactgtgagccaaataaacctcttttctttataaattatccagcctcagcctcaggtatttcttgatagcaacacaaatatggactaaaacagtagataccattaaccaaactaaagtcctcatttaaacttcaccagtttttctaccaatgttcttttattgccattccaggatcctatgttacatttagttgttatttctccctagtgtcctgcagtttgcaacaattctttagttattccttatctaccatgatcttggcacccttgaagagtattgatcaattatttagctgaatttccctcacttcagacccttcccatatcttcgcatgattggacaaaggtcatgcattcctgaaagaaacaatgtgatgtccctctcaggggattggaacacagagttaatgatgttgctaggtcattttattgaatactgttgatcccaccagtctgaactctgctctgggatattgcagtctttactaagtagatagttgttgttgtcatcatcatgactaacatttatcagtcacccacggtggggcaggcactattctaacctcttgatatgtagtaactcctttaatcctcacaacaaccctggtaaagctgagcctattaatctccccttgttacaaatgaagcaatggagtcacaggaaggggattactctgcctaaggccttacaggaagtcacagtcagggggccaacagtcctgtgctcccaatcctcgggctactctgcctcctttgtgtgtgggagagtcggagtggggctggtgcagcctgctgagtaacaagggcttcccaaggggcaatcccaacccttattctctctgtaaccagtttccttgccagtttccctaaagaaaattagatgtttatactaatttttttttttttttttggtaatttggcttgttttttaatcaggcttcaagtgtctaggaagtatgaaaatatatgggtgaacggaaatcctgaacccaccatttaggagtcagttttgaaagcctaggagactgttcataaggtagaattaaggtgatgacagtgggaatagacagggaaaggaatataagaagatgccttgaaacaggaacatctaagaacctaaagaatgaggagggtggaggtattggagagcctggagttttcagctttggggacagggtcatttctaatgcctgtgacagtcacgagggaggcagggttttgggaggagaaggaatgtttggcatttgaaaatatgggtttgcatttcaaggcagaagactaggctagagatgtgggtttgggaagcatttataagagatggagtttagataccccttcacctccccctgtccctgcaagtgaggagggtctgatgatagaattagggcatatctctgtttaagacaaataagaaggaagaggagcagtgaaaaaaactgagaaggaaatatttagagaggagggagaacccagaaaacagggccatcaagggcgagagaactcattcattcattcattcactcttgcattcagttgttttatggagaacctttaactctaaactatgtcttgaaggggacactgagatgatagagactctcatgggagggacctttgcgtttggtccctagggatgaggcaaagttcatcgacagataagtaggaaagatgggggcatgtatggcctcgggccctgatatactggtacaagcttgtccaacccataagccacatgtggcccaggatggttttgaatgtggccccccaaaatttgtaaactttcttagaacactatgagattttgtgtgtgtgtatgtgtgtgtttttaggctcaggagctatcattagtgttaatatgttttatgtgtggcctaggacaattcttcttccaatgtggcccagcgaagccaaaagattggacacccctgcactagcacatgcgttgttctttctcaaatcctcctcctcccaaagaagctatataattttaaccaaaccttaattcacctctcaaattatattcaaatgtagtcttcctaagcatatgctgtaattaaacaatatggcatttaaagattcttaacaccacaatatgccatggttactttagtcaaaaatattcaacttgaactaattttttggtgctgtgacattaaagagccagatgaatgactgagtttgttttttttttttttttttagctgagtttgggagttgaatggatgctgggtgcagagcatggcagtatcccagcatgatattgatagtaggtttcaggagctaatgctgaataataaaagatggtttcatgtgatccttgctaacaaggtaaaggtttgagctgccagaacaggaaattataaaatttgtatctaaaaataatctaatcccttgcattttctattgtgacatccagtgataagatacaaggaccttacagaaactctgggcagtttctggaacccctgtctgtaatcagctgatttgattttcttcagcacaatgacagaatatttgtgaggaaattaaacttcatcatgctccagctatcagttacatggcatcaacatttctatcaggctttatggagaatttcttaagtactagagctacctttaactccagtgcaagtttgcaaatctacagcggctttgaaagaagtctaaatgaactcaggccctctaagggtttctcaaccacgccagcactgttgacattctgggctggatagttctttgctggggatgggggcttgtcctcatgtaggacatttagcaacatccctgacgtccatctatcagatgttagtagcattactcccccaagtcatgtcaatcaaaaatgtctgcagacattgccaggtgtctcctgtgggatagagtcatcccctgttgaaaaaccactgattcaaagtcttgctactaaaagtgcagtccagcaaccagcatcaacatcttctgggagtttgctagctaagagctgtgtcccaggcctctggaattagaatctgcattgtaacaagatcttcaagagacctgtggacacatgaaggtctgagatgcactgatctaaagctctacccagggcagtgtggtgtagcagaagggcaagagctttgaacccagacatgcctaaccattaaaagctatgtgacctctggcaagttgtttaactgctctgagactcaggttccacctctgttaaaatgggactaagaaactttctgtgttatgacaatgatagtagtggattgagctgaagcaacaagaagggtatacccaacccttattagaatctcaactgggctggcttcttcccctctctgctgttttcattggccgtactacactcactggtgctagtggtgatgatatcagagggtgaggaaaagcagtctgcttgagttagtgctctgccagcagaggaggtcataaaaaaatctgcttatttacaaatttttatttttgaattatttactttctttaagctgtgactctcatggtagtctggcccttccattgcttgggaaactgggatcgtgtttctggaaaactcattatcctgggccttgtgaactcttactggtctcatttaaaggccagaatctaaaggtgggaaaggtgaagttgatggcagctaaatgtagaagtgtttaaggaagatgaggctcacatggtaaactttattcctgcactatagcaactggattttgaaatggggcaattatttttgtgaccattagaaacatttttggttatacaagttaaggataaatatttttgccttgggaataaacagattgctccagaactccagatttttcttttttcttctttctctcaccatgtcatcgccttagtatggcatgtattttaaaatttctcttcctggtatatcaagaatagctgttctcatggctgtgggccagtaatctaacctgacatagacaattctcctttttggcaacatttatttaaataatatataataaaggtacatacacacagaacaatcacacacccacacaaacaatatttgaatctgacttgttacgacagtttttaggcaaatcacaattatagttggcctttgaacaacatgggcttgaactacacaggtccactcatatgtggattttttttttcaaccaaatgcagattgaaaatacaggtttccctggatttgaacccatgtttatggaggggaatttgtgtattcaggttcttcaggacttgagtgtgtgtggattttggtatgctgtggtaggtggtcctgtaacccagcagttcccaacctgtttggcatcgggaacttgtttagtggaggacaatttttccacaaacagggctgggcaggggatggtttcaagatgaagctgtttcaccccagatcatcaggcattacctagattctcataagtagcatgcagcctagatcccttgtatgcgcagttcacaataaggttcaggctcctaagagaagctaatgctgctgctgagctgatagcagggggagctcaggcggtaatgctcccttgccctctgctcacctcctgccatgtggtctaattcctaacaggccatggaccagtaatggttggcggcctggagtttggatacccctgctgtaaccaattcctcatctataccaagagacaactgtgatttatctgaaatgttgtgatgctacaaacatgaagagatgtcatttagagtcagtgtacagaattgtgtagattgggcactgcacaactctagagggcaccatttttatcatggagatcatggatttgcatatattttatacgcttgtcagaagatgacaacacagtttcttatctaacaaaatcagtacattgcaacagtgttctggcagatagaagtgaagtgtcttgggaaggggcttcattttctaatttgcacaaaggagtcatatgggctagtggcagccctgctatcttgcctttttttgggagcttctactctggtgtgcaaaataatacaaatcattacccccaaagaaaaaatatggctgagagccataagaaaaaaaatacagtttgtttgattttcatgaatgtgaaaaaaagaatcctccgtaaaaggggtgtccttgaccgggtgtggtggctgactactgtaatactgacagttggggaggttgagatgagaggattgcttgaggccaggagtttgagaccagcctgggcaacatgggaaaaccctgtctctacaaaaattagctgggtatggtagtgtgtgcctgtggtccttggtacttgggaagatgtgatgggtggattgcttgagcccaggaggtccaggtgagctatgatcaccactgtactctggcctgggcaatggaacaagaccctgtcaccaaaaaaaaaaaaaaaagaaagaaaaaaaaagtgggaggtgtccttgaatgcccctttcatcttggcacatttgctaatgcctctgttcatgctgccgtacttcccaaatacaggtaacaataccaaggaagatgaagcaacccagtggtccaagggaaggaagaaatcatttaaatagcagaggtttgctgacacaggtccagcagataataatcaggatatatggaagaatctcatcagctgtgattggttgaagatcagctgatgctatgaaggaaagtggttaacatggttattgcgttacagagatgaggacgagttaccccttttatacgtgagactacatctaatgtatgttcttcaggactttgcttattggatgcaagggctgttcccataacgtagcattggtcatgtgagcatttttgtttgcctagtgttaggtctttggttgagacatgttcctgcagttacccatttttacctccatttctttctttgttttttattattgagacaaaatctctgtcgctggggctggagtgcaatggcatggtctctgctcactgcaacctccagctcctgggttcaagcgattcttctgcctcagcctcctgaatagctgggattacaggcatgcactaccccgcctggctaatttttatatttttaggagagacagcgtttcactatgttggccaggctggtcttgaactcctgatgtcaggtgatctgcctgccttggcctcccaaagtgctgggataacaggcatgagccactgtgcctggccttatctccatatctccatttctttctagatggagtctgtagtttcacatagaattgcatctgaatagtcaccaaggatgggaaaatggtggtttcaacctggcctatttaggcaacagccttggtgatgctgataatgggactcttctagataggcagagcaggaaagagagaaagcaattattgacagcgaatgagatggaggaaaatctactttttttgttcaagtgatatacttttggggttgtttttatttggttttggtgtgcccaggttggttactttgaattgcgaagaagggtctcacatggatttttattttggtggtgatgtcatttttatagtggtgaatgtagcagagttcccaagtgtgagcgttaattgttagatctggaggtaacaatttgttcttaataataattaaggtcatgaaatctgcaaataatgtgctaaaactaaactttatgattatatataataatgatgatggacaatggtagactggatatagaaaatttggtacatatccaccacagaatactacacagccataaaaaagaacattgtgttctttgcagcaacatggatggagctggagaccatcatcctaagcaaactaatgcagggacagaaaaccaaatactgcatgttctcacttataacactgagtacacttggacacaaagaagggaacaatagacactgggacctacttgagggtggaaggtgggaggagggtgaggatcaaaaaactacctattgggtactaagcttattacctgggtgatgaaataatctgtacaccaaacccctgcaacatgcaatttccttatataataaccttgcacatgtacccctgaacctaaaataaaagttaaaaaataatgatgatggagataatagctaatgctactagatggcttatataatagaaagtttagtttgggcccgtgattgtacttaattctcatataattccttgtgtaaggttctgttatctctatcttatagctgtagaaactgaggcctagagagtttaagttcacactgctgggaagcagaagggatgagatttgaacccagatatgaacaagagactcctacttacttgaattcagttatatttcccaagggactgtgcataaccatatctccaggtgctgcccacgtggatgtcattgctcctgtaggatgaccaaccgtcccagttgcttgagagtgaggggtttcccaggatatgagactttcattaaggctggggaaatcctgggaaaaccaggaggagttcatcaccctagaggactagggtgcatgccctgacagagacaaagaatggataaagtgggaaccactgggttgcttcatcttccttggcattgttacctgtattttgaacagtttgaatgagagtgtgattttcccacttaagtttttcacaacgtaaagaaaatgtgtgaagaaagtacaaggctggttttttttgtttgtttgttttgttttgttttttgagatggagtcttgctctgtttcccaggctggagtgcagtggcgaaatctcggctcgctgcaagctctgccttctgggttcatgccattcttctgcctcagcctcccaagtagctgtgactacgggcacccgccaccacacctggctaatttctttttgtatttttagtagagacggggtttcactgtgttagacaggatggtctcaatctcctgacctcgtgatccgcccaccttggcctcccaaagtgctgggattacaggcataagccaccatgccctgcccatggctggtcttttataggccttgttttcagccatagatcttccacagagtctttgtagaagaaatgaaaaaattataaatgaatacacaaatagcctgccatgctggtgggaaacacactacagctcagatttggccatgatagtcacatttcatccagatagatctcagttctggtctttgccaagttgacagattttattaatttgggggtattcatccctcacatggccccaccctaaatatgggctatccttcctccattaccggaatttaaaaactagaatttaatatttaacaaccatacacattctggaaactggaaaaatggcaataaatgtgcttattttaaaatggaaatttgctgtttggaagtatctactctcttgggaaaattcttcaggtttgatcattttgtattggaagatctgcctgtaggcctggcagttgttcaaggaaaaatttatttggttcatttttttgtaaaaattagaatgatttgttgtttttctttcttttttttttttaggtgctcttgtgccctcattggaaacttagagatttgtttttcagctaattgacaattatgcctatctggtcacacattttatggtctattttttcctccttaaatggtttgggtgtagggaggagatatctgtgcctttctggacatctgctgtttgttgttatagctgactttggaatgctgtccttggaacggcttccaatgtggagcgtccatatgcagtgcttcattaactgatggggtgggaaaaaggagcttttttttataagactattccccaagtgaccagagcctcaccctttaagtgtcaacactttcaaaactgattaaccactctgagtgaaatctttataaattacaactatttgaattttcctggctttcttaacacatagaccgttctgagcagattggagccttttcttcatagctgagggtcatgattaaccatgtctattattactctttcctgtgaaggggtgggtgcctttagatgtatttgggaatatagggttatttgcttccttcctaagtggtctcagatgaacttttaatgtccacttttggtgttttgtgtttttttcccctagttcctcctatgttgctaagacatcacctctcacttttgacaatatttgtgtctgtagcacttttctcacatttcagcttttgtttgttaattttctttaggctgggagttagattgccaagcttgttaaaattatgcagaggagggtctgagcagactcacccatgaggaaattgagtgtgtcttagtgtgttgaatttggatcatctaagataggacttctagatagttgtggtgccagtgagtttaggtagctccttgtgggtttcagcactggtgaaataaagcttgtgatgaaataaatttgagatgagaaccaggaaggatctaattcctcagaatagtaacttgactttactgctttttagtcaaaatggtgcttggaactctcagttcttctcaatatcctttacagctggatgtgttacaattttttccaagctgttaggatcttgcatgtttataacgttagccaaagtgctagtacttaatgaaatttccattgttttctttttattgatggatctgaaattttttttctattataattttgcctcctatttgtatctttaacctcaaacctagctgattgttactagaaaataggaatggtctcactcacaaatttaaggcgtaccacataatgttttgatatacatatacagtcatgcacaatcaactttagggacattccacatcaggttaaagtcagctgagtatatagtgtggaaaggtctgggagaaggctggtgaaaattagaacttgtaaagcgatacgttttgttagattgggggagtaaactttaccaaattggcctgcccttctattttggtctttcaatgtttaattgaaatttaaaagttattagacttgctttagattaagtgggagtcaagtcacttataccagttaggcttactataatataacaaattaaacaattataacacattaaaagttgatttattttgtaagttagcaaatataaattctgtattattctggaatactgagaatttctcaagtttttacttgctgaaggtgtgtaggggctagaacaaatatgtattttagaattttagaattctcttatatttattttgttttttatatatgtgctttttatttatttttattgtataaatataaggtatacaacatgatgttttgatacacaatcatgtgttgcttaacgatggggatacgttctaagaaatgcgttttaggcaatttgacattgcgtgaacattgtagagtatacttacatagacctggatagtatagcttcctacatacctaggctatatggtatagccaattgctcctaggctactaacttgtacagcatattactggactgaatattgtaggcaattgtaatgcaatggtgtatctaaatatttctaaacatagaaaacgtccagtaaaaatacagtattataatcatatggtactagtgtcatatatgtggtccgtcatttatcgagacatcatgatgcaggaattgactgtacattgtgaagtgattacaatattcaagcaaatgaacatatccaacatgtcatgtagttacctttcttgattgtgtctgtgtggtaagagtacctaaaatctactctgttagcaaatttccattatgcaatactggaatatatctataaaactatagttaataatatgtattgttattaactatagtcctcatgctgaacattagatctctagatttattcatcctatgtaattacaactttgtacttgacctacatctgcctgtttttttgttttgttttgtttttgagatggagttccgctcttttgcccaggctggagtgcagtggcaagatctcggctcactgcaacctacgcctcctgggttcaagtgattctcctgcctcagcctcccgaatagctgggattataggtgcctgccaccacacccagttaattttttttttttttgtatttttagtacagacggggtttcaccatgttggccagcctggtctcaaactcctaacctcatgatccacccgccttggcctcccaaagtgctgggattacaggcgtgagccactgcgccctgccaacatctccctgttttacccactgtccccgcttcctgccataaccattcttctatcctgtttctattgtatttgatttttaaaaaacattccacatgtaagtgagatcatgtagcctttttctttctgtgtttggtttatttcagttagcataatgtcttatagcttcacccacgttgacccaaatagcaggatctccttattaaaagcaaaataatattccactgtgtgtgtgtgtatacaggttgagtatcctaaattcaaaaatctgaaattcgaaatgctccaatatctgaaacttttaaagtgctgacatgatgttcaaaggaaaaactaattggagcattttggattttggatttttgtatttgggatgttcaactgttaagaataatgcaaatattccaaaacctgaaaaaaaaatcagaaatccaaaatgcttctggtcccaagcattttggataagggattctcaacctgtatgtgttcctttatccatttatctgtcaacagacactttggttgttcccatatcttggctattgtgaataatgctgcagtgaatgtgggagtgcagatatctttatgaggtggtgacttcatttccttggagtatatatctagaagaaggattgctgtgtcatatggtagttttatttaaaagtctgcattctgaccaacagtatttaagggttctcttctctccatatccttgccaacatttgttacctcttgtttgtttgcttatttatttatttacacagacaaggtcttgctgtgttgcctaggttggcctcaaattactgggctcaagtggtccttatacctcagcctcccgagtagctgggactaaaggcatgtgccacctcacctggctacctcttgttttttgctaatgccattccaacaggagtggggagatatctcattgtggttttgatttgttatttccatcatgattagtgatgttgagcacctttccataaacctgaagactattttttgacttatttggagaaatgcctatttaggtcctttgctcatttaaaaatctggttatttgctgggtgcggtggctcacacctgtaatcccagcactttgggaggccgaggcgggtggatcaaaaggtcaggagatcgagaccatcctggctaacacggtgaaaccctgtctctactaaaaatacaaaaaattagctgggcatggtggtgggcgcctgtagtcccagctactcggtaggctgaggcaggagaatggcatgaacttgggaggcggagcttgcagtgagccgagattgtgccactgcactccagcctgggagacagagcaagactccgtctcaaaaaaaaaaaaaaaaatctagttatttgtgtttttgtttttgtattttttctgttgaattttattttattttattttattttattttattttattttattttattttattttatttttttggtcggattctcactctgtcacccaggctgaagtgcagtggcatgatctcaactcactgcaacctccaccgcccaggttcaagtgattctcctgcctcagccgcctgagtagctgggactacaggcacacaccactgtacctggctaatttttgtatttttaggagagacaagatttcagtatgttggccaggctggtctcgaactcctgatttcaggtgatctacccaccttggcctcccaaagtgtcgggattacaggcatgagccactgtgcctggcctattgagttttgtttctcatatattttgaatatttacctcttatcagatatatggttcacaaatgttttctcccaatccataggctgccttttaatgttgttgtttcctttgctatgcagaagctttttagtttgatgtagttacacttctttattttgcttttgttgcttatgtttttggtgtttcatctgagaaatcattgctacaaccaatgtcaagaagttttttcctatattttcttctaggtgttatacagtttcaggtcttacttttaggtctttcattcattttgagttgatttttgtgtatggtgtaagttaagggtgcagtttcattcttctgcatatggatatccagtttccccaatagcatttattgaagacactgtcctttcctcattgtgtcttcttggtgcccttgttgaaaattagttgaccatatatgcttggatttctttctgaactctctgttcttttttattggcctgtgtgtctgtttttatgtgagtaccctactgttttgattactgtagctttgtaggataatttgaagtcagggagtgtgatgcctccactttatttttcttcctcaggattgctttgcctatttgaggtctttcatggttccatatgaatcatagaactatttttctatttctgtgaaaaatgactttggaatgttaatagagattatgttgaacctgtagactgctttggatagtatggatagtttgacaatattgattattccaatttatgaacatgggatgtcttaccatttatttgtgtcttctttgatttcttttatcaatgtgttatagtttcagtgtacagacctttcacctccttggttaaatttattcctattttgttgcttttgaaattgtaaatcggatcattttcttgattttttttttttttggataggtcatatttgctgtagacaaatgcaactggtttttgtatgttgattttttttatcttgcaactttactgaattcatctattattttaacagtttttttatggggtctttatagggctttctacatgtaggatcatgttacttacaaatagggataattttacttcttccttccctatttgagtgccttttcttgttcttgccttattgattttttttttttttgagatggagtctcacactgtcacctaggctggagtgcagtggtgtaatcttgactcactgcaacctctgcctcctaggttctagagattctcttgtcttggcctcccaagtagctgggattacaggtgcacgccaccattcccagctaatttttgtattttcagtagaggcggggtttcaccacgttggccaggctggtcttgaactcctgacttcaagtgatctgcctgcctcggcctcctaaagttctgggattacaggcgtgagccaccacacccagcctgccttattgatcttgctagtacttccaatattacgttgatagatgtggcaagagtgggcattcttgccctatatggaatcttaaggaaaaagcttttagtttttccccattgagtatgatattagctgtgtgcttctcataagtgacctttattatgctgaggaaactactttgtttaacctaatttcttgagaattttcaacatgaaaggatgttaaactttgttaaatgctttttgtgcatatattgagatgatcatatggtttttagccctcattctgttaatgtgatgtatcacattaatttacttgcatgtgttaaatcaaccttgcatcccagggatatacattgtggtcacaatgtataataatttgatgtattatcaaattcaggatgctcatgttttattgaggatttttgcttctatgtttatcagagatattggcctatacttttcttgtggtgccttttttgggctttggtaccatgataatcatggtcttataaaatgagtttggaagtattgcctctagttctatttttgaaagaatttaagaagaattgttgttaattctttttttaatgtttggtagaattcagcagtgaagccatctggtcttgggcttttctttgttgggaggcttttaattactacatcagtctatatttgttattggtttggtcagaccttctgtttcttcttgattcagtcttggtaggttatgcttctaggaatttatctatttctctaagttatccaatttgttggcatatagttgtttataacaaccccttctgatccttttctctgcggggggctgctggagctagggagttcctctctgtgctgatcacagctatagggcagatgacagatgggttggtgcagagaaaatgaaactgttcttcctattatttttgggaggtgattctcatggcttttttttttttttaatttcactgtattgttgaggctacttaagtagactgctaagctcttccagaaacacttttttttttcatggacagttgctgaattgttgctcttcatgggggaagtgatggctggggtctcctactccaccatcttgctagtgtctcaccctttcttatattatatttgtaaatcagtgagaaaatcaaaagtgaattgaattatcagactaaaaataaaaaacactttgaacttaagttactatcttgtaagttacataagcctgagagtgaaatgttaagggctcttccttgccaaaggcagtaagatgaatggaaatgggctagtattatatttgctttgcttgttgctgctgtagagcttcctgttctgaaaacatctctggccagtttctatgtgggtattaagaggataattttgctctaggtgaattggcttgagaccaaagaagaagtgacaatctttggaatgttaaattgttacagggaattcattacaactgtatccctatgaaggagatcctccttatgtgaggatattcatgttggaaccaattgataccaaaattggggaccaaaatttgtatatgtaatgagaggaaagttagtaactttagattggaccttcatcttgcaaatgaaattaaatggtatgaaatgagtgtttaactcttacatttaacaaaatgtaggtgacaagtgaaactgtgctcatttttagaaggaacaaagaatgaaactcaaatatcagttttcattagggcataatttttccagtaaaattgacagctaccatgatggaatatctgttactcctttggcctttacactactgtcttttaaaagagaatcagtttgccaaaagtatactggagaggttcattagctttctctgctgcctctttaatacattgctactcaaatagttactttgcagttcctcttctgccatcatctttgttaactatccaagctcagcagatcctcacttgttgatgactctgactgatattcagtggtcccccacaacttcaccttcattgagtgtgtgccatgtgccagacacagtggtgggtgctgggtactgggatgatgtggcccctgctcttcaagccacacagcaggggccagcaggaggagacacacacttgaagagtagcaattccaaacatagtctacaaaatagttcaaagaatagcactattcacaataacaaagacatagaatcaacctaaatgcctgtcaatgataggctggataaaaaaaatgtggtgcatatacaccatggaatactatgcagccatgaaaaagaatgagatcgtgtcctttgcaaggacatggatggagctggaggcccttatccttagcaaactaacacaggaacagaaaaccaaattaccacatgttctcacttgtaagtcggaactaaatgatgagaacacatggacacatagaggggaacaacacacactggggactattggagggtggaaggtgggaggagggagaggatcaggaaaaataaataatggatactagacgtaatacctcagtaatgaaataatctgtacaacaaacccccatgacacaagtttacctatgtaacaaacctacacatcctgcacaagtacccctgaacttaaaataaaagttaaaaaaaaagtaaagaataaacaatttcagctcaatgttgagaatcctaaaggctccctgtaggaagtggcatttgaaaggggcagagtttgagagctgaaatgggatgggatagccagagagggcacagttcaggaaaagctcgagtgagaacacaggatgagtccagaggagagtgagttacaagctgtgcaatttatttaatggctggggtgtaggagaggcagggaggatcagaggaagttcagggtgaaaggtaggggaggcttccccttcttgtagacgttatatacaagaataaggttagtgagtctttattgactgtccactagacagtgtagatagagccgtttataagatagtgtacgtatccttatgggaaataacagattgtatataaataatctcaattattaaatatgttctggagtgtttaagagggttacttaacctaggcatgagagggcaaggaaagcttcttgtgaagcctggattagttgtgtttaagctgagacttgaaggatcaaaaggaatttaagaagagggttgggaaagagagactgggaacccgctaaagacagagggtatagcttaaaaaggctggaggcagcagagagctgggaccttagaagaaccaaggaaagtttagagctgtgctgtccaatgtggtagttacagtcgcgtgtgactcttgaacacttgaacagtggctagtgcaaccaaggaactgaattaatttgtcgagaataccaatagagtggacaaggagagaggttttcattaggacacagaggagcattagagaaagattttgtgagatatggtagaccatgccactaaagggttgtgggtcatgctgggacataatcaaattggcattctgagaattggcctgggaacaagatgcagctgctgggtttcagcaagaaagtgatgataataaagctgctcctaaggaaggctgatctggagtggaacatgggttggacaggtcagggtatggagggaggaggagaagccagagggaagtggtggagcatagcggttaataacacaggctctggagctattatggccagagccaaacctggatctgccatcttcggtttgactgaaggaaggatgcttcaactaagtgagcagtgcttgtccccagagctggcccacctcccacagctctgggtgggtaacagaagggctgcttgagcttgcagccaagcccctgggagccactgtgaattgctgttccagggctggggcgcgggggcgatgttctcctgttttttaattgtttcacttggtacagaaattaagggcccttggcgacatctcattcaacctttttttttgccttatttggtaagcttttcacttaacttttatagaaagtctgttattctcatctgcttcccataagaagatgtttggcagtggcagagagtcccaggacttacggggaggagtggtttcctgagggtcccccacaacattctcatagagcttgctttccccgcttgcagaccaagtggactgagggagcaaattctcattctctctggagaagactgagcagtgtggctggaaaggtggaatgagaagtggggcagggcagtgtatgaaaagttcagactctgtggttgcaagaaactctagttagcaacattagaaaatgagttttcactgaaaaggaagcttatggaatccaagtgctgggtgctgctggccctgaggaagcgctggtggtgggaacccgagcctatcgggggttccatctctcctgccttttctgcatttgggtctatgtggtaacatcagccaacccatagctcttgaatttaccttttatagatccagccaaaagctgggaggcagcccagcttgggtcagttttcatccttgtaccagtcaggcctagcttgctgagaatggccacatggaaaaagcaaggcttctgggcagccctttccatggtcccttagggcaggggctctgtttgattgttttcagaatcatatatcatatcatatcatatcatatcatatcatatcatatcatatcaaatctgtaccagaattacatactataaatatataatataataacctagagggtatctgggatattatatcaaaacttattctaaaacccacgtttcctcccccatacctgttgtgtccccagtcactctgatataatgttttttataaggaaacttttttgattctgctcaatttttcataaaattggctacttacacaggagaggagggacacaacctaattttatatggtatttatgaaatatattttttgcggtaaggcgggttgacctatagaattgcagtgaacgtacatcttccaagaattaaaatgcactgtgtgtgaaagattacatttgagatgatcatgatttataaagaaaaacatagttttttgggctgggggcagtggctcactcctgtaatcccagagctttgggaggctgcggtgggtggatcacctgaggttgggagttcaagaccagcctgatcaacatggagaaaccccgtctctgctaaaaatacaaaattagccaggcacggtggcacaggcctgtaatcccgttactcaggaggctgaggcaggagaatcacttgaacctggtaggtggagtttgctgtgagccgagatcatgccattgcactccagcctgggcaacaagagcaaaactcagtctcaaaaaaaaaaaaaattaattaattaattaaaagaaaaacatagttttaaggttcaaagcagctacctggtgaatgaaagagatacaattttcctatattaactactttggtaaattttaggggtaaaatgaaaataaatcaaagtttaagttgtacaaagtggagtttggggcactctctatgatacatgctgcttctccatctcgaatatcacgtgaacaaaggtacatttccagtttatatcagggttggcaaactacagcccatgggccaaatccagccagctccctggtttagtacataaagttttttgtttgtttgtttgttttgttttcttgagacggagtctcgctgtgttgcccaggctggagtgcagtggcgcgatcttggctcactacaagctccgcctcccgggttcacgccattctcctacctcagcctcccgagtagctgggactacaggggcccaccaccacgcccggctaattttttgtatttttagtagagacggggtttcaccattcacaggatggtctcaatctcctgacctcgtgatccgcccgcctccacctcccaaagtgctgggattacaggcgtgagccaccgcgcccggccagtacatattttattggaggactagcacacccatttgttcacacattgtctctggctgcattcaggctatagcaagagagctgagtagctgtgacagagactgtatggccttcaaagctgaaaatatttattatctggccctttacagaaagaatttaccaatccctagtctagatcatcttggtcagtgagttttaaaggtgcactgcagggtcctagagtctaggatctgctgtgaggtgagacccagcagggcagggcatctggccccctagtcctgctgcatccagaggagtttggctgccctttttgctctcaggcttctgtgcatgacttgatatgaagaatgaaaggattatcctacttaaaaaattgtgtataagctgccggtctgaaagcacagggacgcattcagaagagagagaaggtcaccctgaatatgtctaattatctccattgtgaactgaagtggctggtactgtgacatgatgtctccaacctaaaaaataaaaaatccttgatgagaatttttaagccaggataaacctctgtaattactaacatgctgggaattgcttttacatctctggcagtccatttccccttttttgtagacaaagatgataaacttcattctgtgctagaatcagatttaaaaaaagaaaatatgactggagttgactaatggagtgaatgtcatacatgcaaggcaatggccgaaaagcaaaatgtgccaaatcctctatatttgtcctaattgtgaaagcatcaacacattaatttggccttgaacgtgatgccatggaaaatggccttttgcttggtaaattcctcaagtattgctgtttttgtaacttcagtgaaatatgagctgctagagttattcagggtgggaaatggagccttagcattgggcagataaggatgaggctgtttggtttgacgtaagttaaattgcctgaactgcaggtggttctcaagcttgccatccctgatgaagactgtaaccatgatgcattaatgtgtattataaaccaaaagaattgaaatattttgccactttactagggcagaaacttggaacatatgtttggaaatgaattttcagtattttaaatcagagaggatgggatttattgttgaaccaagcacaattttagatatatatagatgaaagtcatctggaggtgtccggaagatcacctggaatcgaaaacctagaagagattgggggtgggtagcacttgtttcattccagtggttttacatacattatctcatttaatcctcatggtgaccctctgaggtagaattattacccccatttaaaagatatggaagctggttaattcttttcaaggtcacaaaagtaagtatttaaacatatggcctgtattagtccatttttacatggatataaagagatgcctgagactgggtaatttataaaggaaagaggtttaattgactcacagttctgcatggctggggaggcctcaggaaacctataatcatggtagaaggggaagcaggcaccttattcacaaggcggcaggagagagagaaaagtgaaggaggaacctccaaacacttataaaaccatcagatctcatgagaactcattcactatcatgaaaaccacatgggggaaattgcccacatgattcaatcacttccttccctcaacacatggggattacaggtccctccctcgacatgtgggaattagaattcaagatgagatttgtgtggggacacaaagctaaaccgtatcatggtccagtctttctgttacatcaggctgcctcccataaaaaaaaaaaaattcctggaaattaagtcactggttacaacaaaagaaaagataaattatgaagttttcctggaaatcaagagcaaactctctcgacatgttaaggagagaaaataaatctgtctcaaatacctggatattgagataattctcattaggagctattaacttcagagccacagtcagctcatgttagtttaattttgtgtccaactctctgttattcagtactcactttatttcaaggtgattttaatcacctgttggaaatgagcacttagcaagttaatgtttttgaaatattaaccaatgtgattttcattcatggtaagtactggttgttcctagttgtctctgcaggtctcctcctggcaattcataggcattctttcgttctgtggaaggggtaatggctcactttaaagctttcagacagagtttaaaaaattacagtagtctgaacaccaagttacgtttgatttgccatagctagccttgtggaaagagagatgatttttcttgtccttgtagaggaagatccacattgagggaactgttttggagtttatctttaacctgctgtgtctcaagctgtaatgagcttaccatgtacctgggaatcttgtcaaatgcagctttcagttaattaggtctgaggtggagcctgagattctgcatttctaattagctcctaggcaacgacattcatgctgctggtccgcagaccattttgaacagtgagggtctaagccatagagtagagaatgcctaaatggcaggagagcacttatccaacccaaaggaaagaaagaattcaacccactggcagaaagagatggatccaaggggacgtgattggacttgcaaagcagatgggtgcctgagtagagattccctgcactctgcctcattccaggtgagggaagaaggaaatagatgtgggctcctcagatccagaaatttctcgaaagtatctaggctgtatattcctcaggaggagcccagagaagcagggtaaatgagcttgcctcccagggcagcccagggagatgagatgatgcacattcaataggcctcttgcatggtcaagatggtagtggctgaggacagccttataggactcaagccccagtgtggtgtggcgaaagcagctgcggggtcttgagctatcaaagggagctgagacagttggaaaactagggaagcccaggatggggatgagaaggactcaagagtgtgtggaccttgttggagtccgtggtgggggttacagccttaagtagttgatgccagaggccaacacctaaatgtagatggcaccagctattctcacacatccatagaggacaagtgtgccccagaggccactttcccagtgtcaagaagttagaggtagatgaaaagatggagaaaggagagagtcttcagggacaggtgtgaacaaatgataactgtgttacttctaagtcaagattaaggccgttgtccctttattctccactaggggatggaaataagaattgtgaactacgttgaaatttcattatggagatataatatttgtataccaaataaaacattatatttggcacatggtctttgaataattgctacaataatttttcaccggaattagctaaattattatcttcttttttcacattagtgactaaactatattctttgactatttaacaggtgttagatataatgttctttatgtatattattacacttaatttgggaagtatgtacaattatttaatattgtgaggcagagactattgttatcccacattttacagttgaggaaactgaggctcaggaaaattagcttacttgtccaaggtgacacaactgatagatgaatgaggctggagttactgattcaacattcattttgggctttcagatcccggcccgggacttgacacatacataataagagcacagtaaatatttgaatgaatgaatgaatgattgtgcaaatgtgcaacagtgtcagctggccagttggtatgtggggaatcctgttctgagcaaggtaaggaaagaaaaatgagccagaggtggggcctcctccttaacagtgaatctgctgtccctaatgtgctaattctaactcagagtggagcctttgaaaatacttgcgggtcctgtcagaaaatacacagaatgtaaacgagcaggattccatcaacttacattttcaaagtgaaaaaaaaaaggggtttaagggctcttaaggaatgctgttaactcttgggctgagtatagttgttggggggtgctttagaatatgtgaggagccaaggaagtatttcaaattagtctctgcctgttagagtcactttgcaacatcccatcatgccgcagcaatccatggggaaaataaaaggggacgacataaagcaattacaagccagctctctggtgcaaagctgtgccaggtttgaaacttgggcgctagccctctcccaatccatctaaactaactgacaatactttagtctggtttccactttgcattttggtccctgttaatcccattgaaacaccaatcctatatgcaggtattaaactcttattaagaccttgaggttgaattcctaagtaagagcttttctttgagtttgggaaatttttattttatttttttgagacaagatcttcctctgtagcccaggctggattgcagtggtgcgattataactcgttgcagattcgcacccctgggctcaagttatcctcagccttggcctctcaaagtgctgggattatagagccaccacaacagacctggggagtctttagcatttgtatctcatatatagggagaggcttcttaaagtctgagagatgtgcaaacaaatgagcatttccagagccttccagttgctgtgcatgtttgacctggactgaaccacaagtggtctgtacacctacagttatctctcaagcctcccattcataactgaggctaaaatgttccaaatttggtgtaaactgggacaactattttgggaaaaaagcttgtcaacataaatgagtctaaccttttgattccgtaactccacttctggaagatatcctttagagatgatttttagtagagaaaacattttgtgcctaaagaagttgagagcaattcctcccttttttagaaaaagaaaagtaagttttcttaaacagttttttaaataaggtaaaacttttttaaataagagaaaacttaaaattttctaaataggaatctggcagtgatagaatatcatatagccatcaaaattattttaaaagtaccaagctgggattacttgtatttatttttaatcttcattaagttattattattacatttttcagtcttgagagaagggaatggtctctggagccagagtttgtgaacacatgattccttcttagaataaccagctggtaaggtacagcagtgaaaaacactggaacaggtgtgagagttggagatctggctgtggctcatgctgtccctagaagatgtggaacctgagaccacttagccaggaccacctgaacaaagtactctgaaagttgctacatagctgacgtctccataggttccctggggtgcccataagcacaatgcccacagttgtatttttaaaaagttttctatctatttccaagtgaagatctatttaagttttcaggatagtttgtaataacatctctggaagctgcttttgtaattccaatgttagcatcccatgtaatattttcttcagttgggcaaatgtaaggcatgtctttttttttttttttttttgagacagagttttgctcttgttgcccaggctggagttcaatggcgcgaccttggctcaccacaacctctgcctcctggattcaagcaattctcctgcctcagcctcctaagtagctgagactacaggcatgcaccaccacacccagataattgttttgcatttttagtagagacggggtttctccatgttggccaggctggtctcaaactcctgacctcaggcaatctgcccacctcggcctcccaaagtgctgggattacaggcatgagccactgtgcccggccaggcatgcccctgttaaagctattattttatgcgtaatactttggtttttgatgtccacagtcattgctagatattgtggttgtccttcaggtttaaccttagatggaacatgtatgggaggcatcagaaataactctcacacactcttaatttgtgtttttacaaaactataacaataaaacgtatagagatgaactataacattaagatcaattttcagccagattaaaaaataaccataagaacttggaaggaaagtattattttaggttttaaaatcaatattttaactgttataggatgtccaagcctaataggcacttagcatgaagcctccagacctcccacaggagaattttaatgctaaggatgaggagcaagggggagcaccttacagcctccctcctgctttcacccagccctcgggttacaaagacacacctgccatggaacttgaccagctataaggcagcgctgagaaccaggacttcaattacttcaattgaggaccagttacttcaattactggggccctcctgtgtaaaatatggaggcaagagttgaattagattagcatttcccaaacattgttttgagaaactccagcactctatgaggagttcagaggcatctacaagtaaagagtttccctgactgaatacaagtgcggaatgccacgtctccgtttagagatttccaatataggttaacatatttaaggctgtgagatatcctatggttaagatgtattttccacagcatttcacctagcatgtgttaaatgcatttgatggcagaatcctgctatcaagaaatatactttgggaaacactgaactaagtttcttcttagctccaaatttctacagttttaaatatgccatccaaatgttgcttagcaacattacagccacctcatttgcccactagatggcagccttgaatgagatttatttttttcttcttgccaggtttctctttggacatttttggacattgcttttcctgtgtaccaggagagtgcagatcagttattaaattgattttaaggccattctggtaacattttacaatccatttaaaataaaacagttgtatcaactgtagggataaataccagccaagattgaaatagtatatgattttttgagctttttttcttttaaactcactgaacaatactgataatgtcttacttttttgcattttacagagtttagccagacagaatttaactggacatttgggttgttctgttgatcaacttgaaaggttggattgtgaggctgttgggaactttctgtagtttctggtggcagttgggaaacttctttagtttctatggtgggtgagaaatgtcttcagcccttacatgtgtataactttgtttgggatccctgcaatattatcgtgtttagatggcagtgcaccttcagaaggtctcactctccaggcagcctgtgttaagtggtctcttaaagtctccttcatgttctagtaaatttttgattggctctttattcaacatagtttgctattaggcattaagattttgctggtttgcgggttcatcagttagtccatctttcactgggtctcactgttataaggttaaagcaccttagtgatccccgtcccatacttggagttcatggaatttcacacatccatttaagtgtgcccaggagttttagaaaatgaaggcaactttacttaggtatagtcatgcttcaggtttgttcaactgacggatgtttacctattagaaatgtatgcctttttattgatggaaagggagcttttaaaatatataatgagggggcttcctgaagtgcttcctgaattacctgaatatgtgtgcgtatgtggagtgggtgagaagccaaactctggaacaagcgcctcagcttgctcttctgttccagttttggtgtacgtactgctgaagcgagcgtgtcatcttgctctttcaatgctacattttgaaggtgaaatatttgtaagccctcttagatcttattccaggaaaagattcttcctgaaccccaaatagcactccaaggacattaaaattctcatacttcctaaaggtaagctgtttgaatagcagttttcttagtgtgatgatctgatctactcctgtctcttgcctcatgttgtgggagatttttctttgctttttcctccataatatacagcatggcatgggccctagtttttagtttatctttggactttagatttttgggtggtatggtgcaaaaccatttgtgggtgcactcttactgtgtaagaatatccatttaagaaatttgatggccgggcgtggtggctcacgcctgtaatcccagcactttgggaggcggaggcaggtggatcacaaggtcaggagttcaagaccagcctggcccaaatggcgaaaccccgtctctactaaatatacaaaaattagccgggtgtggtggcgggcgcctgtaatcccagctactcaggaggctgaggcaggagaatcgcttgaacccgggaggtggaggttgtggtgagccgatattgtgccactgcactccagcctgggtgacagagtaagactccgtctcaaaaaaaaaaaaaaaaaaaagaaatttgatgcagattttgtgagtgtggtttataatggaaatgtcagataaaatggatactaatcttagttaatacatattgagcacttactgttgcaggcattgtgcctagcattttacatgtattagctcatttaattctcacagcaacctgtagtgtgtagatgctattgctatgacattttcagatgaagaaactgagggttagaaaggttaaacaggtgaattaggccgggcacggtggttcacgcctgtaatcccagcactttgggaggccgaggctggcagatcacaaggtcaggagatcgagaccatcctggctaacacagtgaaaccccgtctctactaaaaatacaaaaaaattagctgggcgtggtggcgggcgcctgtagtcacagctactcgggaggctgaggcaggagaatggcgtgaacccgggaggcggagcttgcagtgagctgagattgcaccactgcactccagcctggatgacagagcgagactctgtctcaaaaaaaaaaggtgaattaatgtcacattctttgtaagtggcccagcaaggactgcaaacaggtctctcatgcctcatgttttaccagcatatgtatgatatgaaatatttgcatcttaaatgttttcaaaacatgcatatgcatccttgtaaggttgaggtgggctaagctgagtggccacaatgtagcaagaaattctcctgataataagaacccaactgccaattttgctctcagctctagacaccaagatttcttggcctgatggcctcatgttcaaatacatttggccatgtttctcaaaacactgagttactatactttgcattaacagtgcttggctttgtcttttatgcagaaagcccctccaggcctctgtaatgtgctaaaaaagatcttgtctaaaactcatgaaaataaataacataaactgttctgaataaatttgggttaagtgaacagaactcttttctgtgtacgtgtattgcatacatacagttgtgtgtgcctgtgaacacgtgttttgttgctgggtctaggaccaatatcctctgtagtgaagaatatctcagaatttccattataaattattttaggggtttataactaatactgtaaaaaattcagcactgcctggaatgtactttattgtgtttacagaattagttattggaaagaagcatgtagaagcaaatatgtctttgccttagccatttgaggtggtgcaaatgtttgcataattgttggcaaggatgggacgctattgaaagcagagtagggagctcaaggattcaggagataaagagtaacaaatcagtttgatttgggataactgaggagcaaatggaaaattcgatcttgaatgttgattataaataggaagaccgtgcagcatatcaatacattttgtggctaaatcccatttttaaaagaaaataattggtagtagggccaggcacagtgactcacacctgtaatcctagcagtttgggaggccgaggcaggagaattgcttgaggccaggagttcaagaccagtctgggcaatatagcgagactctgtctgtaaaaaaaattttttaaattacctgggcatggtggtgcatgcttttagtcctaggtattcgggaggctgaggaggtgggaggatctcttgagcccaggaattccaggttacaatgaactatgattgtgtcactgaactctagcctaggcaacggagcaagactctgtctctaaaacaaaaaataaaccaacaaactaaggaaaagaattggtaggaatgaaaaaattacaagaattattagaggaagataggtttactttcaccatcaagaccaagacttaactcaaaagtcacctcatgtggaatgcctgcaattattattaaaaggtattgggcatgtcctgtgtttcagatagcatgttaaactctttacatgagttttctcatttgttccactgaacaaatccattttgcaaaggaagaatctaaagatcagtgggaggaaataacttgctgaaggtcatagagcaggagctggtagaagagctgattaactcaggggtccaggagcttgcagtctgtaccacggtgcgcctagccattcctcatttcccttatgcaccgacattcctttacccagttgttttcagctcaggggctcattagaaccatctgagaagttacttcccacccaccactttattcttggtcagtcttcaatagttgtaagaaagactatttctctaatgaaagcataattattacataacccaaccatttaaaatttgcaccagtttgtatggactgggcaaaagtttgcctttgcaaagcatttactaagcaaattaatagattacactgaagcagaagggaaatgtttttatcattaaagagcacaaattactttcaagcataatagaaaactattcattataaacaaattgataggagaacttcaggtcatttttagatttattaaatatgcttcttaggtgtgcatattcataacatattattagcctgattgatcacttgcttttaaaaagttgtttctaagaaaaatattctataattctaacttttaattgcataagagttgggatccccaccccccgcttagttgaaattaatgtttgctgtgtgatgcactgtaagtcttcttaatgtcatgttgtagctgggtgttttgtcctactaatgggatttgaaattttggaaagcagaatctcatctcttactttttaaagtgtccacaccagtttttagttctctgcaccctgcaggtactctatgaatgcatacccaaggcagtgactgcttgggcaaaataaaactttagttgaggaaaatgcagagttccattcatcctgtaggcaccagatggctggtcatactcatatggattgtttatgatccacatccatgggatccatccatgccgagccacaccagttgttagatagttgaatttgacttctgcgaagatgcgagaattcctgctatacaaatgataaatcctcaaatgtgtgctgggttttctggatggcttcaggacactaagtagggaagacaaagagaaagcctgtacctgttctactggtgttgactttgaacaatttcagaaaagccaaatggtctagtagttaagagctaagggtctgacatcagtggaatcgggttcaagacatcattctgccacttagcagcagcgtggccttagacaagacacttatcttgtctgagtatttcttcatctttaaaatgggggtcattgtgaggattgagttaatctggaaacatgattggaatagtggatggctaactgtaaacctcaatatgtgttatcttttattattattataataaaatgaaactaaaaagtttagaacagtggttgtcaacaggggaagattgtgccccccacaggagatgtggcaatgactggagacagttttgattgtcacaaggtggatgtgtgtgtgggaaggggcactgctggcagcttgtgggtggaggccagggatgctgctaaacatcctacaatgcacagggcaggcccctcgacaacacggttatctggtctctaatgtcaatgatgtcgaggttgggaaatccttatttagagcctaataaacacagtcaagtcaagataaattagccaagaaaagctgaaatattaaatcaccctggcatattatgggatgacaattcatgaagatgagttttttttttttttttttttttaaagaatctgaggaaaaactgatgattagggaagaaatatcactaaggaaggataaaagaagtcgcttttaggaaataggccactttaggacataaaagctggtggactaatcttgaaaaagccatgaaaaatcccctttatttggggattaagctgctaaaaggtatgtatctactgccatgtctggagctatctcataaaggagcattcaggtagggaaggaaattttgttgcttttaaaatacaactaagggccgggagtggtggctcacacctgtaatcccagcactttaggaggccgagttgggtggatcactggtcaggagttctagaccagcctgaccaacatggcgaaaccccatctccactaaaaatacaaaaattagcctggcatggtggcatgcacctgtaatcccagctactggggaggctgaggcaggagaattgcttgaacccaggaggcggagattgcagtgcactccagcctgggtgacagagcaagactctgtctcaaaaaaaaaaataataatcatatgactaagagtgtatatctattaacacacacacacacacacacacacaacataccacacacacacacatacatacgtctggcaaattgtatagaatattaagtttgggtcatttggaaatgatctctaatccatagctagcaatacaaggagcacattgcctgctgtactgacatatactgggccccttctgtatttcccaaaatgatcaagttcaaacatttgaggatgagtggtaatacgtctcatagtgagttgaattcatattatgttctgttctttgctgtaaatgcgcttggttttgaagaccagtgttacaatgatccttagtgccctaaaatgtgagcagaatttatattatattaaatatatatatatttaatttataatacagtactatatcaatgatggggcaatgttctgagaaatgtgacattaggtgattttgtcatgtgaatgtccatagagtatacttacacaaacctatgtggtatagtctactatacagctatgcaatatgctacaaacctatgtgatatgcttctaggctacaaacctgtacagcaagcgactgtactgaatactgcaggcaactgtaacacaatggtatctgtaaacatatctaaacgtagaaaaggtacagcaaaaatgtggtatgaaagagagaaggtaggagaaccatgtaggccacctaccatgaatggagtttacaggactggaagttgctctgggtgagtcagtgagtgagtggtgagtgaatgtgaaggcctaggacactactgtatattactgtagactttacaaacactgtacacttaggttatactaaatttattaaacttttttagcttactgtaaatttttacattttataaagctatacaaatattttccttatattcttactttatgaacttttttctgttaattttttttactgttttaacttttttgttaaaaactaaaacacaaacacacacattagtccaggcctgcacatgatcaggatcatcaacatcactgttgatgttgatgatcccactggaaggtcttcaggggcagtaacacgcatggagctgtcatctcctatgatgtcaatgccttcttctggatacttcctgagggacctgcctgaggctgttttacagttaaattttaaaaaatttacattgaaggagcacactccaaaatcaagataaaaagtataatatagtaaatagataaaccagtaacatagtcatttattatcattgctaaataatatgtatataattgcatgtgttatactcttatacaactggcagtgcagtaggtttgtttgcaccagcagcaccacaaacatgagtaatgcctcgtgctgctgtttcacgaaggcgatgatgtcacggtgacaggaagttttagctccattataattttatgggaacaccattgtatatagtgtggtgttccttgttgaccaaaacatcattatgtggtgcatgactgtatctatatttaatatataatatgtaaaatattataagtatctttacagtagaatccaacctctttggcgaggcatcccaggcgtttcacagttggatccctgcctacctgttgagccttgtcttccaccatgttcctcacccacactgtgctttctttacatcagaaggatgacaatataaactcacctgggaagtagtttttttctgcctctaaagggaacttgcctcgctctcagatacatcacttagcacagaataggcactcaataaacatttggtgactgtatgacaatagctccccttatagagcatggacaatacagccaggcactgcacctgtctatctttgtgcctttattcttccctcatcccaaatgattttctgttgaaattcatcttcttgtttaaaatatatttaaaaacctccttcacaggtcttctcttacctcctcttcaactctgatcctgtcacaattaatctctttttcttcagggatccaaaggactgtgttcttcttccatttgctcttttttatgacacaacattgtccttgtccctgtcctgtatatggcttcaggtaaggagccgtgactgtacatccttctattgccccaggacctctgaacacaggaaacacccaagtcctgatggaataattcagcggatctttttcccttgtcagcagcttgaggtcctctttgctgtcatgcgatttactctgtgttcactttgaaatgagtctaaagagattaagtctaagaacactctcagctccttgaaggtggaggctgtgtctaattcttcttggtagccctttatctagagtagcccagagaacatgcccaacagatgtctgggaaatgactgatgccttgaaattactgctaggtggtaaaagcttctttgttatatattgttcttggtgtgaaaggcaactgatggccctcaaagcatctgtccagtgaacttaatcagggtatacatggagtactctctgtattagtcatacagctagtgtgggattaatttaggtactaaatattaacttacaaaaagaagggtaaaatggagggtaaagagcttcctctagaagtggaaattagcctgaataagggcaagtgtgaaacgtatgtatatcagaagacttttcagctacatttagagatatcctacttttaggtcagtaaaatctaccaataagcatacattaactgctttttacttggtgccaggtgctgctgggagagtaagaccagcctacaacatggcctctgtgctctagggtcttatattttcttgcatagctcagcaaactttttctttctttgtttcttttttttaattcctcctttttttccttggaagaacataataattttcaaactatgcaagtttctcttacataagaagaagtttttaagaaattctagaatttaatatttcaggttccaagctttgagaattttacatctaattgttacttcaaattcattttaaaagttcctaagtattcattttgttatgagcttataaatgtaataaattatgcactttctaaattgctgctgtcatgtactttatttatttattatttatttaaatttaatttcaatagttttgggggaacaggtggtttttggttatatggataagtccttcagtggtgatttctgagattttggtatacccgtcacctgagcagtgtacactgtacccaatatgtagtcttttatctcttccgccttccatccttccccaagtccccaaagtccattatatcattcttatgcttgtatgtcctcatagcttacctcccacttataaatgagaacatttggtatttggttttccattcctgagttacttcacttagaaaaatggcctccatccaagttgctgcaaaggccattattttgttccgttttatggctgagtagtattccatggtgtgcatataccacattttctttatccatttgttggttgatgggcatttaggttggttccatatttttgcaattgtgaattgttcagcaaactttttcttaaacggccagatgataaatactgcaggctttgagggccattctgtctcttgtaattatttaatgctgccattgtagcatggaaacagcagccatagaaaatacataaacaagtgagcatgaatttgttcaaatacagctttatttacaaaactggcagctggcatttaacccatatgtcatcattagttgacccctgctctagcatgtaggtgagtgtgtatgtatgtggatatgtgtttgcatgtaaaactagtgttagagtgtgtgcttttttatgccaacatttgtaggaactctgagatggaagagaaaggtggtccaaagtagtaagggaaagactcggtgaagggggaactatctgtttctatgatcatatgtatagctctatgatctatgatcttatctctatgatcatatatacagaaattttccttattccaattttctatcaagaaagttgtttgtttgggttgatattctgtagtagatttgctgggttgaatggtagttttatttttagttctttgagaaatctccgcactgttttccatagagctgttataaatttacattcctaccaacagtgtataaggcgtaccttttctccacagcctcactgacatctgttgttttttgactttttaatgatagctattctgactggtgtgagatgatatcttgttgtggttttaatttgcatttctctgataattagtgatgttgagcatttttttcatgtgtttgttagctgcttgtgcgtcttcttttgagaaatgtctgttcaggtccttttcccactctttaatggggtttttgttttttcttgttgagttgagttctttgtagattctggatatcagtccttttcatgtctttcacagcaatatggatggagctggatgccattatcctaagtgaagtaactcagaaacagaaaatcaaatattgtgtgatctcttaattgtaagtgggagctaaacaatgggtatatgtacacattcagagggtaacagtagacactagggactccaaaatgggggagaggaaaggagagtgaggactgaaaaattacctattggatatagagttcacaatttgtgtgatgggtacaatggaaacccaaacctcagcatcacacgatatatccacgtaaccaacctgcacatgtacccctgaatatataaaaaaattttaaaaagaaagttgtttgtaaagtcattcgtttttccatttattctacaagtatttgctaagtggtcgttttacacaaatgtttattctagctttttcaagtttaatagctggatatgttttccatatttaaatgactcatttttaagcatatttttgtgtctctgaaattggactgcatctcacagttggtggtgctattacaagattttcttttctctgtgggtataaattaagatgcttcttataattgttggtgtcttaaattcagaagaaatatggtagatgatttagcactgccttaaatatttttttaaacagggtcatttactttaggtattttagtttttacatttacatttactcagcaacttactagacatgaagattctgagcacatttttaaacaaaaattgaaaatgcttttttaaaaaattactatcttcagtcctgactgagattagttattttacacatctcagttaatgttctgttaaataaacttctcccatcaagcatgacttttcatgtacacttttgatggttttggcttgtttcacagatttccttcttaaaggtaaaatgtggattgaaatttcagagatacaattctgtggcctggtgaagaagctggtcattgttcttcgtgtccattacttataactttccctttgttagaagcacaggatttaagaacaggtgttagaatatgtgtgttttcccctaatttatctcatttttatttcattgctcttggattttccaaaactatgaagctctttatgcaggactggcctaattaggcaaactcgggaaggtttgtaaaaggtttaatgttccccctctttcctgtctgtataaatcaattaaaatggactatgaagaaactcacactcaaatattgtgtaactctagatttcattgctctatgtttgttttctacattggaggaggaggttctgcttaactgtacttatgatttatggaagccagagatacatttcagccagttctgtgatatatgggaatagaacatactacagaaatattatttatgcctccgatcagaagggggaaagctgtttcttttactatacttgtttaagcagtgcgcgtagtaagcacatctgtctttgtaattagtataaaaatgagaaaaattaaaactcagattagtatttcacagttgacatctctaggtacttctaagttaatgctcccaagtaataatagtaaatacttctcagtgtttctagtctttatctgcttttagcatggctttcgtttattctttttatcttctttttattttattttattttttcagacagagactcactctgtcgcccaggctggagtgcagtggtgggatctcggcccactgcaacctctgccacctgggttcaagcaattctcctgccttagcctccagagtagctgggacaacaggcgcatgccaccatgcctggctaattttttgtgacagggtttcaccatgttgcccacgctggtcgcaaactcctgagctcaggcaacctgcccgcctcggcctccgaaagtgctaggattacaggcatgagccaccatgcctggctcgtttattctttataaagttattgtttggatgctgagtcttagggtaatctcttcataattttttccctttgtatattttagaaaggatcttcagtgctgggaggtggttaaggattaattgccagttgatcattagagtgtgataaactgtgattcttatgccacatggagaattttacagtgtagtatttgtggtattttatgtgtgcggatccttatgcatttcaaaccatagttttacttaatgacatcctttttatagggcatgcaacctgagaggtaggaaagggcaagccagaagctgtaattcatttaaagctttcttcttgaaataactctggaaaaataaattttagtttattatttttttctgacatcttgaattgcaatttttatgtcactttatcttaaggtacttaaatgaaaatataatgattttgtagagcaggtccaaactgtagagcaatttaattgagtcctgttatttttagagaaggaactagaagcaagttgctctagcattgctggggcctggagaagtgctaacagagacccgcagaccaaatatctaagtatgccaatggtccaattaagctatgcctgccttctctcctgggccctgcagccctctgcctggagcttcagtctcccctgggccagccctgcagactaaagaggctgtgtggcagcactgatctgctggggcagggctaggtgggagttggaaccacgcccaagactcctgggctcaccaaacctgagcaggtggtaatgacctgctcaagctccccagggaggcaagtaaggcagattcttcacttccaggccccacttgtctgactcaggccttccaggggttctaagtgcctctcagattacatcctctgaacaaggagaagggagacaacagagttatctgggggatcctgtctacttcaacactaaacacctatttcgtcttggtttccaaggacagaggctgtggttcattctctcatgggctctcagttcagcaccctccggtctggagtccaagttcaggtgagtccctcccattggcttagtcagttattaaattaagaaaacaaacaaaacttctatttaagattgaaaagaaaaaaccctgcattttggggtttgtcatgtgccctctaaagtccatggcccaggacaagagtccctctggcctaggtctaagagagattgaggagcttgggcaacattatgcagctcaatagtggtgcagatgtgacaatatcttctttagaaactacaaatttgttctgccaatattataatttgaatcatgcttgcttctgataaagtgcaaaaaaaaaaaaaaggaaaaaatagaaaggcagaaatcatttaaatagggtataattcacattgttatcatcccatcttaggttttctttccctgctgaataaggaacccttaaaactcacatgtacgtcgtgacttccaaagaaagaaaagctatcaaaacaccttcctgtgtgaaaatgtctgtttcttagggaattcaggtgtgtgaatcacttccttctgtcctgtcatagaaaaaaaaagaaagcaatgtgactttatagttcagctgaggaggccaggttggtgttttccagagaggattgcttaagaaaaactatgttcttaaatgcatttctacatagaccttgcaggaacagtttgcagatgtggacggcattcccaagaaaagatttttacagtgactgacatccccaaaacctgcccaggaaaaggaaaacgtgtcctttctcaatttcacatatgcttttctccctgatcaaagggtggatatatccatggtggcacctgaaaaataatttttttaacagagttgcttcatagtaaagatgaaagtataagcaactattaggccaactggaagggcttgagtatggaagattttagtttcttcttgcagtaaacacatgtggagtccaggaagggtgacgccgtcatctggtggcatgatggagatctccactgatgctggaaaaatactaggttaatgaagtataaaatgcagccttaggcacaggcaggcaggtattttgtgggttggggagtctgtgaatggaagtaaaatcttaaatcttattggtctaaaggatctgagagaggagagtgggcagaagggcttaggctgaaaagtggcaagttgggtctgtttttgcctcaaattctgcagctggatgtcctgcgagaggtcagtggaggaactgtatgagagatggtcttctgtaatttcatgttggctggacctgatgtttttaccaacattcgtgttggttgttcattcaacacttgttacgtatgtctatttttgcatcgattggaggaattgtgcttatgttggctttacctctaagctgtgaattttttagggcaatactcaggtatctgttttctctctattcccagcaaaactagtgaagccttggaaatagtttgtcacttagtagatgttagttctatggaagtagaaaagcaaggtgcctcttagtgcatagattggacctgctttcatattattaccatcaaggagcccaaaatacctcaatataataaatagaccccagtgcttgagaagctgttagcaaaaccttggccttcagcagcctaggatctgaaacaactctcaaagcacaccgttttctgtgaagatacaagttctcgaaaagccccaaggatgggatgccctcctctacaaataagtcaatctcctttagaaaggaaaagcaatttggtgaaatccactcaagaagagcacttgctgtcccagggaaatggcctgctcagcagatggccttcacattcagggcctggatggtctcaggatcggaaactatcatgctgaagtggagaggaaaaaaagttgattttcttcgagtggatatggtttctcaagtgatacttgaaaaaaaaaatgtatcgaaatgttatttgaagctccaaatctatatgcagccctctattgctcagctatgtgctgaccaaggatttaatttttttttaataaggagagatgaagtgagctaagatcatcaggaaatatttctataagcaaaatttccactgtaagttcccttgtacattgtttttgttgcctgaataactttttccccaactactgtcaatcaactaagattatcacatctttcagatcccacctttctggtcacttccacaggagagtgttctttgaattcccagatccaatttgatcctcccacttaaataattttatattgttatttaccagggctttcaaactgatatgtctgtaggattcaagtgaatgatgtaaaaaatgaaagggattgttgacagcagaactttctgtgatgatggaagtgctctatatctgcctgatccattatggtagccgctagccacatgtggctattagtacttaaaatgtggctggtgcaaataaggacctgaacttttaattatatttcacatttaattatgtaaaatttaaatttaaatagtcatttgtggttagtggctactgcattggactttgcaggtctatgggaaaaatagcagcataaatgggatgaaaaatggggtctggaacttggactcggtcagggagacagaagggagtgttgagaatggtggaaaaccagaaaccatatgccctatcaaaaaggggcagctgctactcagttccaatgaatttttaaaaagagtacaagaaaactcttattttattgtgaaatcttatttttcaaaaaagcattggcaactatctacaatgctaggccaaattttgccttgcccatgtgtattcattttgtccatgtgtattcattttgtgacttcactctgagttctacatggcaagtagcaaatatcactattacaactgtttgtgtaattatttcttttgtgttctcagtagaaatgaaagcttcatgtggacaggggccatacctatcttgtttactgttacatctcagttttcagcttggaattgagtaggtattcagtgatagttgttgaatgattgttgtatgcataaggtaaaaataaattaaaagtgggattgggggtagggggagaggttgtacagaccaaaggactctggacagggaaggctctttgtgaaagcagttgttctaccataaaccctaaagagatcgggaagcattgattgtttcaaggctatagggaaaaatgctgttgctgctaatacttgtcatgatgtctgtatcccaactgaaaccactctatcttaatacctgctatggtttgaatgtgtccccctaaatttatgtgttggaaacttgattcccagtgtggtgatgttgggaggtgtagtctaatgggaggtgtttggttagtggggacactgtccttatgtgtagattaatgctgttctcacaggagtttcttataaaaggatgagtttggtctctttatctcaccttccccctttgatctctttgtctcatcctctcggcccttctgcctttggacaatgcagcaagaaggctctcaccagatgctggcccctcaatcttggactttccagtctccagaaccaggataaataaatttctgttcattataaattacccagtctctgatattctgttataaccatgcaaaatgtactaagacaattcccattaaccatctgaatgtcccagaaattccagggttcatggtctaaaaaatgttaagaactgtgggccaagacctttgcctttagtaatagtttatctaatggaattgcatttttgggatgttgttatacaacttataaaatctaatggaattaaattcccagctctccaattacccatttgaacttataaaaaaacccactgaagggaaaagccatcctctttagttgtatgtgccattttactacattccattttttggctattaaggcagttgctttggattgagtgaatcatctgagatgtacaggacctgagaaatcatttcaagaaaagagtgaattgagtttatttcatgctgctactctttgtcttgcctgtacttgagtttttatagtgattctctaagatatagaattgtagtagattatcattcctattattgttgttgttattaggattcctgtaaggaaagaggcacattaaataaaacactttcaggcgtatctccctaaagatgaggacatctggatctccaaaacctgtgattatgttattttacatgacaataggatcttgtgggtgtggtttaattaaagattgtaagatgaggagactatcctagattatacaagtgagcccaatgtaattacagggttccttaaaagtgaagagtgaggcaagagggttggagtcagagaaggagatgtgatggtagagacagaggtcagattgatgtgattgctggctttgaagatggtcgatgcccatgagccaagcaatacgggccacctctagaaggtggggaaggcaaaggaacagattaacctctagagccttcacaaggaatgcagccctgttgacactttgcttataacctagtgagacccattttggacttgttatctccagaaacataggagagcaaaaatgtttttttttttttttggttgttgagacggagtcttgtgatcttggcttactgcaacctccagctcctggggtcaagcaattctcctgcatcagcctctggagtagctgggattataggcacctgccaccactcccggctaatttttgtatttttagtagatttaattttgtatttttagtagagatggggtttcaccatgttggccaggctggtctcaaactcctgacctcaggtgatctgcccgccttggcctcccaaagtgctgggattataggcgtgagccactgtgcctggacttgtgttgttgtaagctgttaaatttatggtaatttttaagtttatggtaatttgtaacagcagcaataggaaattaatacaatggtgaccaaaatgaagtctgtttacaaatgttgactttattttccatgacagaaattatgacttagggtctgacagggaaacccatccatttggcaatattgattgagcatctacaggcactgggaatttaacagccagtaaaccccattaaagtccataccctcagagagctgtgttccatggagacagacattaaacaaccagataaacaagtatttagttgtatttagttgcatacgtggtgttataaaaagaaagtgccaatgcatatctgaaggggtgttcaggagggttttttcgaggaagtgatttttgggttgagctctgaaggctgaatgagaattattcggaaacgggagataatgaggaagggcatgtttgaaggtctgaggcagaaggccctggtgctcttgaggaactgaagaattctagtgtgtagaaggtgcagcaaagagtgtggtggagtaggtcttggatgtaaatacagtgggaatccatggaaacattttaaattgggagtgaatcaaggactacagaggtgagggtatttctgatgatgtgtgatagaggatagcagagcaacatcatggccctggccacttcactttcagttttttctttgggttgctggttgagcattttatctctgtatgtgtcctgttgagattgtgacttgtagcacaaggatgaagtcccaggcattcatagacccagataatcatgcgtagacctggaatggaggctactggagcacacacaaggatgttttctgaaagataaaagaaggaaaattatagattgttaggaaaaagcccttagagaggcaccgtgcttggtttgggagactgtcccaaaactattctccttgaattgatctaatgtatctaggtaagagaggattatttatttatatatttatttttattttagagtggatttttgtttcttattttggattgttttggtttataattaacaaaatataggccaggcatggtggcttacatccataatcccagcactttgggagactgaggcaggaggattccttgaggccaggagttcaagactagcctgggaaacagagaccccagctctgtcaaaaaaaaaaaaaaaaaagccaggagtggtggtgcatgcctgtagtcccagctgcttgggaggctgaggcaggaggatcaattatacactgaagtttgagactatggtgagctatgatcatgccactgcactccagcctgggcaacagggcaagactttgtttcaaaaaagaaaaaaaaaaaactatgtctaggtcttacattctataaagatttttttttctagtttgttattgcttacctcattttgtgtggaggcaactgaagagttaatttatttagaatgattttcctttcttatctaggggatctatgagagaaatggtctgatgctcagtaactaggctgtgggtctgttagtgaagtcactattgacaattttaatattatttttcatgaagagatcagctgacggtagtgcttagctgctgaaattcaggctatcaggcatgacctggttctctatggctcaaaaaagaggaatatgttcagtgcagataaatgtatcataactctaacctctgtataattgtctcaagttcaacaactgtaatttataatgcattgtgtatacttacatcatgaactgtcatggagttctaattgtaatgtttgcatacaaggtagccagtctagatgctatccccacatgcatagttggttgagggaatgccacaatggcaggtggtggcttctgagccaggtctcagataatgtgttgcgatttgactggaaaagatgaattggaagggcattcctgagagaagagtgtgtacacaggtgaaaggcttggaaagtcttttgtatattgagaaaagaatgctcagtcaatgatagaagtgcaagagattggccttcaaagataggttttggggtcagggcagggagggttttgaatgcttggtaaaataattcttttcttaatgcagaaggagtcatccagggtattggagcaccacagtttagcgagcttaatctggcgtcagagcagaagctatgatacatgtatatattataatgcttaaaggcatgagccctggaatcagactgtcctagtttgaatttcaactaaaataggtctaagcctcagtttccatatctgtaaaatgggagtaataatagttcctacttcttagggttattgtgaggattgaaagaagataaaacaccatgtcatgatactttgcccttaggcagcacctgatgcatattttaatcctatttttaattttcttatcacttgggtgaaataggcctaaaaactatttcaataatatgtataagaggtaatgtgtgtcctggagatactgagagaagtggcaaagaacatgtgaatgccatttatactgttttcattttttgacacaattttgagtttatctttttctcctactctaacaataaaatgcttccaaaaagcacaaatgtttcatttagctctagctattaagaaggcaatgttttcttacatacataattctgcaatacataaattataaaattcttttttttttcctgagcaatgactttgaattcaagaattctaagggaataccctatttataataatttgaatgcttttaaaaccactttaggccaactgtggcggctcatgtctgtaatcccagcactttggtaggctgagacaagaagagtgcttgagcccaggagttctagatcaacctgggcaagatgacaagaccccatctttacaaaaaacaaacaaaaaacccccaatttaatgggtgatacatggatgcagtcctgctttatttactactggttttgaaattggctttatcaccttttcaaataatgggtttgataaattattttacttactaaatttaaggctcaatagtgtgatggatgctatttaagaacgatgaagtatattctcattttctatttatcatcagagatgtcttaatcagcattatgtcttctgcttaaattattaacgaacatcattgtaagactggatatttggccaggcatggttgctcatgcctgtaatcccagcactttgggaggccgaggctggcggattatctgaggtcaggagttcaagaccagcctggccaatatggtgaaaccctgtctctactaaaaatacaaaatttagccgggtgtggtggcaggcgcctgtaatcccagctaatcaggaggctgaggcaggagaattgcttgaccccagaaggcggaggtgagctgagatcatgccactgtaccccagcctgagcgacagagcgagactccatctcaaaaaaaaaaaaaaaaaaaaaaaaaaagactagatatttgccaaaggagaaaatgatctaacctatagagtttttagagctgagcctcagaatgttcctaattccatgtactagttagaatgttttcaattccttgcacaataaaatttactctcatttttcatttattattagagatgtctcaatccacatcatgtcttctgcttaagtaattaataagcctcataataagactagaagccttctggaaaaaatggcaaggactgcctcattatctttgattgctttagcttgttactgtttttcttcttgaatgattctctgagcaaagactaaaaccccttcagactttgtacttaagtatcatatctaagaacccttagctcttacagtttgtcctgttctgtatgaaagagtcctagttccattccggttggatatttattaacagtgtgacttgggctgctattatcatttctctgaaactgcctttatctgtgaaatccagaggttggccaaaagtgctttaagaatgatagctctaagaatggtagaagcaccttctatgtataatgcactgtgcttaggagtggacataggacagaacttgccctcatggagtttatatgccatgggggaactgttgataaataacatatgaatacctattaaaaacatttatctattagtgtgcaagcccttaaaaggcaaggcctttttgtctgttttgttcactgctgtatcctcaataaataggaataatgcctggcacttggtaaatatatgccaaataagtatatgttgggtatattttaaatattataacaaagtacgtgaagttctggaaaaaagcattctgtaaaattatgcattaatattaggattggggcttgtgggaaaaataggactggtatggactcttacccattataaccaaagcattaacaaaaacatgaactggaacccctccctgccctaccccatcccccaaaaagccataaaggcggcccaagtaggcatctaagtgcagctggaagatattttgggggatatttttgttgttgtcattgctctttagttattttacacttttaaaaatgcataacgtacaaatcagtaaagtatacacatcttaaacatacagtttgatgaattaaagtaatttttataccctctgggtacatacaccaaagaactgaaagcagaaactcagatacttgtacaccatgtgcatagcagcaatatttacagtagccaacaggtagatgcaactgaggcatgcatcagcaattgaatggcaaaacaaaaggtgatatagacataaaatggaatattattcagacttaaaatggaaggaagttccaacagaagctagacatggatgaaacttaaggacattatgctaagtgaaatcacacaaaggcaaatactgtatgattctgcttatatgaagtacttagagcagtcagattcatagagacaggaagtagaatgatggttgccaatagctggtacaagggtaggacatgagagaagggagaattattgtttaatgaacatggaatttcaatttgggaagttccggagatggatggtggtgacggttgcacaacaaagtgaatgtacttattccactgaaatctacagggaaaaatggttgagatggtaaatattatgtatattttaccacagttagaaatgacgaataaaaaaatttacatttatatcatcaccactcagatgaaaatataggaagtttcctgtccccagcagaccactatgcccctccccatcagtattgtctcctcgaggtaatcactcttctgccagcccttgaggttcacatacatggatttctattgtatctacttttgtgtttgacttcttctctcatggtcatgtctatgaaattctttcatgttgttatccatatctgtaacttatgttttattattgtgcaatttcccattatgtgaatataccacaacttgcttatccagtcccctgttgatgatgtagttgtttcctgcttttgtttattctatgtagtgctgctatgagcattcttgtgcgtatcttttggtggacatcttcgctcatttctcttgggtggaatttctggggcacaaagtagtttggtagatactgctaaatcgttttcccagtggttttcctgatttgcattcccaccagcaccacgtagatgttctagtgtcacatcctcaccagctcatggtgctgtcagtctcatgagataatacaaaggcacaagaaagagtagggtggaaaactagtttttgggtgcagaggcagtgcagatggaagcaaagcggagtcaggggggcttctgttcgggagggcacagggagaagtacaatttggtacaacgtgacatccagtaaacctggggtatgcccttgtagggagggaccttcacatgctaaagggatttttttttttaattaaaaaaaaaaaaagagcagagaggattttagccgaactgaaagctgtttgctttctttcctgttggaggctgtcagtgtgctcctataccttactccccattgctttagaaaaactgcccaggaaccgatgcaacttccacattatagtgaattcattcccctgttcaccaattacatttgagctcattggttttatgaaaacagatcttgtaacagaacacactgtatctgtatttaacattaagaatggaggtgaattctatgggacaagaggaggaaaggatgtgagggtatttgcaaaggagtggttatgatgagtgacttggaatccaagcagggccagtgggggaatgattagggagagctgatgagaatgtggtgggatctgtaggttacagagcacactgaggtggaggtagttgagcaagtaagctggaggtaaagtgagtttaaagagaagtgtgtttgcataagaattttaaacaaggggcagttttgggtgctgccaatgtctttggagtaatcatgggcatctacaatacagcaaattaaaacattattggagaagaagggtaaaaaataagaggcccagggagtttggatgagtctgtcgtaggaaggtggaggttgccaagaaggatgttaggagttaagacggagaagagagctagtgagtctaggacttgtagacaggagtgtttatatgctctttctccctggccaccagttgagagtgtagcctgggagtagggtggagacccatttgtcattcccgtagtgccttgtactatctcatcatacctctaaaacttcaccttttcacatctctttcctgtctttttatgtatatatatagagagagagacagagagagatgaggtctcactctgttgcccaggctggagtgcggtgacaatgtcatagcacactgcagttttgaactcctggactcaggcctttctccggcctcagcctcctgagtatcttccctgtcttttaataaccacttttcgtgcacttttaattttgtacaactacagaacgttagcaaatattttgagcctctgttatatttctagcaccactaggcatggtgctaggtgctggggagatgatggcaaacaaaactcggttccttgcagaggattaattaaaaacaatcaaacagaagcagtcttcttgcatgtgggctggaagtattttctctaagttaccaaatgagactcgattgctcataggaacaattataagtgaaatataggtcattaaatcttttgtaggtaggtaatttgtatcttggagcaaataacagatttcatttgcttaggatccgagttcttttcactggctgaaatattacatattttcactggaaaaatagtagaatagtagaaagcatctctgtcgcgatagtacttcaataaacagaaagatgacacaagtgcatgaggcgcagttctgattgccataaatgctagtgcttaggaaggcagattgttggttctgaggatgtgaagttccagctggatccctgtgagctgggcatgagtgtttgcctgcctggtcattggtgggctggaagcatcaataggatgacatcctatttttcttcagaacataggacttcctttccctttgatgttagtgtcaatgctacctaaacacagagtaccaggaacacacctgttgttgattatattggttttatcacttgttgtaatgagggagaacatgcatcaatgcagagccttagtaagaaggtgttagacaaaagcctaatttaggatttcggtttgggttgggtgattcaggcaagggtctaaagaagtgagattttgctgcagattagaaattgggcacaattctatgattgggtatctcaataaatgttatctatgatgaagacaagagagcaaagataaaattttcattggtaaataagaagcagtcacttattttagccaagtgaaggaagtgtttggtattttgtgggtggcacagtgacattattgtctgcgcttagacaaagttatgatgtggccttatcatggtctcagtgtaaccttgtctgaagttgtgttctgtgagaactattatgtccaattgtggattatcatggcctggtgtgagtgccaggccagctttgagatgtcagataatgcttttttcccccttttttcattttttcccccttagtagtgtgctgataccttcagggatccttttgaaacagttaacaaatggggaaaaaaggagggggcacatggtgggagtggagaaaatcttgagagattttactaaagaaacctaggaatagggtagaaggcaagagtgagagcaggagaatatgagaagagctgggtgttgatgagaaaggacttgcccgaggacacatggacagggggaacaagggaataggcaggaggtatatgaggaatgggagcaggtcccctcttatcagaggccaagaaaagagttgataggagataacactcccagtgagaaagttaactctgggtcacctgccaacattgtgttggtggtcatgtaaatcccttagcatgttcctggctcataatgggtattcagtttctctgatttttattagtatttacttattttgattagtatctcttggggcctcccaggaagtggaatgtagaagagaataatgtgcagttgtctgtatgtagaatacatgcatgtttggtttgtaactgtgggtattcttgcatattaaaacccgtgtgtgggtgtttttcttggaaagccttgacccgtgtttcagtgtttgcatggtgtgtctgtcttgcagccacaataataatttcagagttgctcaaagttctatagttaaatttgtcatatgccatgacaaaggatgcatagactgtggcactgttcccttacaataataaacaagtactctcctcacctgctctgtgttccttttacccccgccatctctatttccatcaccatgaaaaacccctcacccctgccactcaagctgtagcttgaactcctggtcatttttatctttcttatttcctctttattctggatttggacattttggtttttttgtgtgtgccctgaataatgctgctatagacatcctttaacgtaaacactaaggtccttgtgtaaataattcactggacaaattcctagtagtgggattggtgggacaattaattaaaattttaccacattcccttataaatgagttgtgctgcttaagacatccacccacagagcatgagagggctgacttttccacactctagccagcctttggctgtgctaaacttgagcattcttgctgatctgaatctaaaaatatgattatacataactctgtgagtatatgaatatattacttagtgaaactaattgacagatggtggacatacacaaactttaaaatctatatgtcattttttgtttatattctaagttgctatggatatctctttacatattattcacttgaagttatgtaagaatatatcattgaaagatgtgattgaattaacatgtagaattagcagcttttaacatgtggagataatgttttgtagaatgtattttaaaaatgtacttagtggagaggaaaatactgcaagtaatttttagcatagaaatagtcactcagagaataaggatcctaagataaaatgttggccccctgctttattactagggctgggtcctaattagtcactacagagagtgccaaagagaggttcagtagtcagggtataggtgccaagaagcagggattttaaaaaaggggagagttatatacattgcagggctaaagtgtcagcagaaatagtgtggttatcctgctaagtcaactagacttaaaatggttgtcattttttttttttttttttttttgccatttttctttggtagcctttgagtttgttgtccttttattaattcatcctctctgcatttgacaaatgtggcttccactttcttgcgtatgttgccttcaatttatgtgccatcttggttttggggaaaatatttttccatctaagaggcataattcaatcagtgtggtgtgaaatggggacagtggttaacagaggtcccaccacaatgccagcaagctttgctcttccagcaaaggaatctcctccagtgggatcattcatactgacttacttggatgctctattcctggttttcaaaatgttcattttagaaacaaagattcctttgaaaaatggaacatgaagagatgaggacagtccagattccacagagctacatttgtctacagacatggtcagctgccctgtttttgggagggaagtggttaaattcttctctctgagcttggtctgtggtggcacagtctgtgttcattcctgtcatgagaagaggcacccagctggggatggctgctccctgagcagatagagggaggagacaagtatgatggtctcaatacgaagccaacgaagggaactgcttgttcccaggatggaggaaagatacaggcattgcctgaagctctgccaggcttgagggagtctgtctagaggtctccttttttccatttcacatgtcgtggccaggaggcttttgtatggttttgtgacccatagaaacaagatgactatgatgtattttgcatctagctatagcggttgtatagcatttgtttatcattcattcatctattcaatatttgttgagcatttactatgggggaggtgtggagtatattcattgctcaagatcgacatggtgactgtactctgaccttccattctaggggagccaaaaattagataagtacttatgagtagatggttcagaaagggggaagacagaaaattttgggcagtggtacgcaagagcacccaagcttattttaaacagtcagacaaggcctcaccaagcaaatggtgttgtagttgagaattgagagaagaataacagttggccaatggatgatgggggagcaggaggtggtggtggtggtgtgtccatggtgttccatgaagggggacattctctgcagcaggtcagggaaaaacagaaattgtttgcatgggaaactaagaggaatgtagtgtggatgtggcttagagaacctgggttcaagctgtatgttgtggacatttctcacaaacagaagatataatctataactttaatctgctctgtccttccaaccagtatatctcatattatctgcctttctcagcaccaataattttcacatggatgtagtaccctcagtaattttcagtatctggagtcctatgttgctagtagcattgcctttgattactaaaaacattttaatatactcttgacagtacctgacagtaaaatggtatctcttcttacactgatgagtgaattatctgagtcatcaattacttcttgtatcctcagtttttattttttaatcagaagatgacagagcttctcattgtactattgtgtagattgtttcaggaattttgaaatgctttttagatttttttttttgttttgagacggagtcttgctctgtcgcccaggctggagtgcagtggcacgatctctgctcactccgcctcctgggttcacaccattctcctgcctcagcctcccaaggagctgggactacaggcgcccactaccacactctgcaaattttttgtatttttagtagagacggggtttcactgagttagccaggatggtctcgatctcctgacctcgtgatccacccgcctcggcctcccaaagtgctgggattacaggcgtgagccactgtgcccggctgctttttagattttatgcagaaatgacaggatgtttacatggaggtaggtagtacaccttggaattgagtgtggctttgggcaagttcataacctgccctcagtgttctcttctataggaggttgcaagattgctgtgcaggactctgtgtaaagcatctattattattctacagggaatgctgcataaataaagtcaatgagcaagaattactttttttttttttttggtgagatgacaacttttgtagactctgaaataatatctcttgaattctataaccaaaaccagaagaataacattgtttgaattcaattcccagttttgcagaagtgggtggcttctgcattattgacacttgctaatgcttagtcagtacctaatgttagcctgacaaaaagcagagagaaaaagagaatcatagtaatagctgtaaaaatctataatctaatttgaaaattttcaattttcaaattagattatagattttgaaattccttacttcactgtgtgtctctaacagatgtttgtttatgtgtgtgacttctatcaggttgcttcatctatcatagtattagagtattatgtatatttaacttagaaatatgtgcacatatactaagggtgcatgctcaattattttcattgataagagtacctgatcaaaacatttggagcccattgatataatacacattcatcttttttttctttttttcagtatcagaacctcctttctatagttggtggagaggattctcgaccttaagagtcttagtaggaagcagaacttgactcccaccaaataactaggaaataccagatgtgtacttcccaacttcccagacaaccatcccttgagcacgtgaccttggctttgccaatcagatgtgttagtctagaaatttggacagcagctagtgatattctctgtggcagtggtgaagtctgaagcacacaggctccagggacaattgcagtggagccagcggcactgttcagtggtcagtgctggagatggttgtgacaggcacgccagctacagtggcattgctgactgatgagacagctttatgttgtgctttgggccgtgagtcgactgagagacatctcagcctgattctccatccctctcaatgatcctgtgagctgccctgtaacctttcaatacatttctgcttcagtcagccaatttttggcttgcaaccgaaaccctgattgtaggcagtgtttccaaaacccagcagacccatattgtaggcagcgtttccaaaaccatttttctgtgtaacctgtttttttaataaagcatttcatggcatcagaatattggaaaatcttttgggaaatgcagaatggcatgacgtaacagaacctgaggatagtgtctaattataacacatagaaataatcatgattcagaagtccctgtgtgtgctgctggtcttatctgcataaagccctataatcacagtgtaagatattgtaggggataaacagaaggcaattactgacactgtgactggaggccagacccagtctttgtgccattcagaggcatctgcttttgtttgtcgtattaatctatttatgataatgataactattgtagacaaccaatttattatgcttttatcatatgcaatgcactttccgcaattttcattttaatctccctaacagccacgtgtgggcaatggtatctgtattttatgaatgccaaaatgggaggcccagcgagatgaaaaaaattgcccaaacttatcaggagtaaagttgtggtttgaacctggaaatcagtctttggccactaagccattgaagtaataatatctctggaagtagggagcagctcctctcttacttccttggtttccaaggcagcatgtctttctggtgggttctctgagcccaacactctttcccatttctttttttttttttttttcgcacttgagccttcttgtccttcaattctcagcctaaagtcgcacctgtaaagaggcagtttctgacctctcagtactctctttttctatcagagcagtcttcatgattttcaatagtatctttgcttgtgtggttatttgatttacgtttgtgtccctcttggggctagaagctttgggaaactcaggatacatattggttttgttcaccactatacacctagcccctgcacagtgtgtagcccacagacattccccagatgtctgtttaagaagtaaatgaatggctccatcacttgctggaggttagaccagagtttcttagtcttctttttcattattgtcccacctaagaagaaaaattttattaaatttattttattttcttaaatttcaataggtttcaggggagcaggtggtgtttggttacatgagtaagttctttagtggtgatttctgagattctggtgcatccatcacccaagcagtgtacacggtacccaatgtgtagtctttttttacaattttattttatttattatactttaagttttagggtacatgtgcacaacttgcaggtttgttacatatgtatgcatgtgccatgttggtgtgctgcacccattaactcgtcatttacattaggtatatctcctgatgctatccctccccccaaaccaccccacaacaggccccggtgtgtgatgttccccttcctgtgtccatgtgttctcattgttcagttcccacctatgagtgagaacacgcggcgtttggttttttgtccttgcgatagtttgctgagaatgatggtttccagcttcatccatgtccctacaaaggacatgaactcatcattttttatggctgcatcgtattccatggtgtatatgtgccacattttcttaatccagtctatcattgttggacatttgggttggttccaagtctttgctattgtaatagtgccgcaataaacctacgtgtgcatgtgtctttatagcagcatgatttataatcctttaggtatatacccagtaatgggatggctgggtcaaatggtatttctagttctagatccctgagggattgccactctgacttctacaatggttgaactagtttacagtcccaccaacagtgtaaaagtgttcctatttctccacatcctctttagcacctgttgttccctgactttttaatgatcgccattctaactggtgtgagatggtatctcattgtggttttgatttgcatttctctgatggccagtgatgatgagcattttttcatgtgtcttttggctgcataaatgtctccttttgagaagtgtctgttcatgtccttcacccacttgttgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttgatgttttagatgtgaagtccttgcccatgcctatgtcctgaatggtattgcctaggttttcttctagggtttttatggtttcaggtctaacatgtaagtctttaatccatcttgaattaatttttgtataaggtgtaaggaagggatccagtttcagctttctacatatggctagccagttttcccagcaccatttattaaatagggaatcctttccccatttcctgtttttgtcaggtttgtcaaagatcagatagttgtagatacgtggcattatttctgagggctctgttctgttccattggtctataaatctgttttgataccagtaccatgctgttttggttactgtagccttgtagcatagtttgaagtcaggtagcgtgatgcctccagctttgttcttttggcttaggattgacttggcaatgcaggctgtttttttgttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtatcctcttttattttgtcgagcagtggtttgtagttctccttgaagaggtccttcacatcccttgtaagttggattcctaggtattattctctttggagcaattgtgaatgggagttcactcatgatttggctctctgtttgtctgttattggtgtataagaatgcttgtgatttttgcacattgattttgtatcctgagactttgctaaagttgcttatcagcttaaggagattttgggctgagacaatggggttttctagatatacaatcatgtcatctgcaaacagggacaatttgacttcctcttttcctaattgaataccctttatttccttctcctgactgattgccctggccagaacttccaacactatgttgaataggagtggtgagagggcatccctgtcttgtgccagttttaaaagggaatgcttccagtttttgccccttcagtatgatattggctgtgggtttgccatagatagctcttgttattttgagatacgtcccatcaatacctaatttattgagagtttttagcatgaagtgttgttgaattttgtcaaaggccttttctgcgtctattgagataatcatgtggtttttgtctttggttctgtttatatgctggattatttttattgatttgcgtttgttgaaccagccttgcatcccagggatgaagcccacctgatcatggtggacaagctttttgatgtgctgctggatttggtttgccagtattttactgaggatttttgcatcgatgttcctcaaggatattggtctaaaattctctttttttgttgtgtctctgccaggctttggtatcaggattatgctggcctcataaaatgagttagggaggattccctctttctattgatgggaatagtttcagaaggaatggtaccagttcctccttatacctctggtagaattcggctgtgaatctgtctggttctggactgtttttggttggtaagctattaattattgcttcaatttcagagcctgttattggtctattcagagattcaacttcttcctggtttggtctcggaagggtgtatgtgtcgaggaatttatccatttcttctagattttctagtttatttgtgtagaggtgtttgtagtattctctgatggtagtctgcatttctgtgggatcggtggtgatatcccctttatcattttttattgcatctatttgatcttctctcttttcttctttattagtcttactagcagtctatcaattttgttgatcttttcaaaaagtcagctcctggattcattgattttttgaagggttttttgtatctctatcactttcagttctgctctgatcttagttatttcttgccttgtgctagcttttgaatgtgattgctcttgcttctctagttcttttaattgtgatgttagggtgtcaattttagatctttcctgctttttcttgtgggcatttagtgctataaatttccctttacacactgctttaaatgtgtcccagagattctggtatgttgtgtctttgttctcgttggtttcaaagaacatctttatttctgccttcatttcgttatgtaccgagtagtcattcaggagcaggttgttcagtttccatgtagttgagcggttttgagtgagtttcttaatcctgagttctagtttgattgcactgttgtctgagagacagtttgttttaatttcttttcttttacacttgctgaggagtgctttacttccaactatgtggtcaattttggaataagcgcagtgtggtgttgagaagaatgtatattctgttgatttggggtggagagttctgtaggtgtctattaggtctgcttggtgcagagctgagttcaattcctggatatccttgttaactttctgtcccattgatctgtctaatgttgacagtggggtgtcaaactctcccattatttttgtgtggaagtctaagtctctttgtaggtctctaaggacttactttatgaatctgggtgctcctgtattgggtgcatatatatttaggatagatagctcttcttgttgaattgatccctttaccattatgtaatggccttctttgtctcttttgatctttgttggtttaaagtctgttttatcagagactaggattgcaacatctgcctttttttgctttccatttgcttggtagatcttcctccatccctttattttgagcctatgtgtgtctctacacatgagatgggtttcctgaatacagcacgctgatgggtcttgactctttatccaatttgccagtctgtgtcttttaattggagcatttagccaatttacctttaaggttaatattgttatgtgtgaatttgatcctgtcattatgatgttagctcgttattttgctcgttagttgatgcagtttcttcctagcctcgatggtctttacaatttggcatgtttttgcagtggctggtaccggttgttcctttccatgtttagtgcttccttcaggagctcttttagggcaggcatggtgatgacaagatctctcagcatttgcttgtctgtaaaggattttatttctccttcacttctgaagcttagtttggctggatatgaaattctgggttgaaaattctttctttaagaatgttgaatattggcccccactctcttctggctcgtagagtttctgccgagagctcagctgttagtctgatgggcttccctttgtgggtaacatgacctttctctctggctgcccttaacattttttccttcatttcaactttggtgaatctgacaattatgtgtcttggagttgctcttctcgaggagtatctttgtggcgttctctgtaattcctgaatgtgaatgttggcctgccttgctagattggggaagttctcctggataatatcctgcagagtgttttccaacttggttccattctccccgtcactttcaggtacaccaatcagatgtagatttggtcttttcacatagtcccatagttcttggaggctttgttcgtttctttttattcttttttctctaaacttctcttcatgcttcatttcattcatttgatcttccatcactgataccctttcttccagtttattgaatcagctactgaagcttgtgcattcatcacgtagttctcgtgctgtagttttcagctccatcaggtcctttaagggcttctctccattggttattctagttatccattcgtctaatcttttttcaaggtttttaacttctttgccatgggttcgaacttcctcctttagctcggagaagtttgattgtctgaagccttcttctctcaactcgtcaaagtcattctctgtccagctttgttccgttgctgcattcctttggaggaggagaggcgctctgagttttagaatttacagtttttctgctctgttttttccccatctttgtggttctatctacctttggtctttgatgatggtgacgtacagatggggttttggtgtggatgtcctttctgtttgttagttttccttctagcagtcaggaccttcagctgcaggtctgttggagtttgctggaggtccactctagaccccgttttcctgggtatcagcagtggaggctgcagaacagtgaatactgaacagcagatgttgctgttcctctggaagttttgtctgagaggagtacccggctgtatgaagtgtcagtctgcccctactggggggtgcctcccagttacgctactcgggagtcagggacccacttgaggaggcagtctgtctgttctcagatgtcaagctgcgtgctgggagaaccactactctcttccaagctgtcagacagggacatttaagtctgcagaggtttgtgctgccttttgtttggctatgctctgcccccagaggcagagtctacagaggcaggcaggcctccttgagctgggatgggctccacccagttcgagcttcctggctgctttgtttacctactcaagcctcagcaatggtgggcgcccctcccccagcctctctgcccacttgcactttgatctcagactgctgtgctagcaatgagcgaggctccgtgggcgtaggaccctctgagccagacacaggatataatctcctggtgtgccgtttgctaagaccataggaaaagcacagtattagggtgggagtgacccagttttccaggtgccatctgtcacccctttccttggctaggaaagggaattccctgaccccttgcacttcctgggtgaggtgatgcctcgccttgctttggctcatgctcggtgcaccgcacccactgtcctgcacccactttccgaagatccccagtgagatgaacccggtacctcagttggaaatgcagtaaccacccgtcttctgcgttgctcatgctgggagctgtagctcatgtgtagtcttttatccttcacatccctcccaccctttccccaaagtccgcaaagtctattgtatattcttatgcctttgtgtcctcacagcttagctcccacttatgaatgagaacatagaatgtttgtttttccattcctgagttgcttcacttagaataatggtctccagttccatccaggttgctgcaaatgccattattttgttccttttcatggctgagtactattccatggtgtgtgcatgtgcatgtgtgtgtgtgtgtgtgtatatgtatatgtatataccatattttggtgcacacacacacacacatatatatatcatattttctgtatccacttgttgattgatgggcatttgggctggttccatatttttgcaattgcaaattgtgccgctataaacgtgtggcaagtatctttttcatgtaatgacttattttcctctgggtagatacccaggagtgggattgctggatcaaatggtagatttacttttagttctttaaggaatctccacactgttttccacagtggttgtattaatttacattcccaccagtagtgtaaaagtgttccttttttaccacgtccacaccaacatttattattttttgattttttgattatggtcattcttgaaagagtaaggtggtatcacattgcggttttgatttgcatttccctgattattagtgatattgagaatttttttcatgtatttgttggccatttgtataccttcttttgaaaatagtctgttcatgtccttagcccactttttgatgggattatgttttttcctgctgatttgtatgagttccttgtagattcttaacattagtcctttgtcagatgtatagattttgaaaatttttctcctactctgtcagttctctgtttattctgttctctgttttctttattacttttgttgtacagaagctttttagtttaattaagtcccatctatttatctttgttttttttgagtttgcttttgggttcttggtcatgaagtctttgcctaagccaatgtctagaaaggtttttccaatgttatcttctagaatgtttatggtttcagatttgagtctttgatccatcttgagtcgatttttgtataaggtgagagatgaggatccagtttcattcttctacatgtgacttgccaaatatcccagcaacatttgttgaatagggtgttctttccccactttgtgtttttgtttggtttgttaaagttcagttggccgtaagtatttggcttaatttctgggttctctattctgttccattggtctatatgcctgtttttataccagtattatgctgttttggtgactatggccctatagaatagtttgaaggtcaggtaatgtaatgcctacggatttgttctttttgcttagtcttgctttggctatgtgggttcttttttggttccacatgaattttaggattttttttttctacttctgtgaagaatgctggtggtattttgatgggaattgcattgaatttgtagattgctattgtgtagaattaatcatgatattgattctacccatccatgagcatgggatatgtttccatttgtttgtgctgtctgtaatttctttcagcagtgttttgtagttttccttgtagaagtctttcacctccttgcttaagtatattcctaagtattttattttaattgttcacagctattgtaaaagggtttgagttcttgatttgattctcagcttggttgctgttggtgtatagcagggcacctgatttgtgtacattgattttgtatcctaaaactttattgaattcatttactagttctaggaggtttttggatgagtctttagggttttccaggtatacagttatgtatcagcaagcagcgacagtttgacttcttctttaccaatttggatgccctttatttctttctcttgtatgattgctctggctgaaaaattatattaaatttaagttctacctaatgagataaattttatggaatagggtttagctttggaagtctagcaactattgtaatatctatagtgttttcatcccctaagaaccaacttttgcccccttggtggtgatatcactcctattcagaaagtatagtttaagcttttagtttcttgtttcaacttctgtaaaatggagctaggaacttctaatttgtagggttgctgtgaagattaaaagtgtcagtatatgtaactttcttgtcatatggtagatattcaaatgtagatacaggttgtcttctattaaatgttaattgaatatcagggatgactaaagttggtcaaataattttatgtttatattacagtttttaaaacatgcagatctgaaagatgagacataaacaaaataacacttactgaaaaggcccagcagtttatccaagatttctgcatttaatggagatttttggctttgacagtttacttagcttaattcaattttgagtcttcagttgtggaatttcctaaggaatgcctgatagtgtaacttaagcacaaagtaaaagcccacacctacagtgtggatgcattattcattttatagcataaaatgtagtatttagtacaaagcacacctatatggattccctcaagaatatgccatcaggcaataattaaattatgtaaaaatagtttatccctattatatatgcattctccaggcttaaaagcagattttgagtcataaatattaaactctgccatttttggcctgttcccttcttttcaattagatgggctcaacaaattgtttttcccgtggataataatttttattaaaggaaacacaaatgcacatctccatagcaactgactagaatcccttgccaagttctcttctttatgtctgatttatcagcccccaggtagttcgctcttgcacaaaagagaactattgtcagttaggaggaagaaatgagatcaggagttttacttgcaatttaatttactacaatatatgtttacatatctcccactgatgatattgggaaaatgtctgctaatcataaaagtactttaaaggtttctgcttggggtttgtttgtgtgtaaagtatgtatttttatactgtagtatgttgtcaagggcgaagtaagaggggaaatgtggttctctcaactccacaaagcaatgctcctctgcctgaagggactgaatgctgtgactttatgaaactttcagttgtatttttcatggtcaactcacttgagaattttctgaagcctggaactgctgcttgtctgtaggttaaaaatgaggaggatgctatttgcgcttactgacactattctctgtaattaagagtcagcagccaaggtgggcctgggtccccagacagacccttgttttacctacctgtgagaggactttgggcaagacccaatgctcttccttctgaatccctttgaacgaggaacaaaacagtttatgggtccacttatttagtgaatatttccttagcactggctatgtgcctcagtgtgctgggcatgggaaataaagcaataaattgacagaaatggtctacaccctcatggagcttacagtctaagagggaacagctaagggaatgtcccaacctgcctgttccctctggcctggctgacatctcaaaggacatttccagaataaggactgtgaccaaggagagttgtggtgtatattaggagagggcagtctagtctgggaggtcaagcaaggcatcttgaaggcctgaatagagtcaggaagcaggccagacagagggaggaggagcaaatagatgggaggtggagcaggggtgcagattcaagacaaggaagggtatgaatgacactctcatgcactggcactgaaatcagcagtgatctgaaactagtgagaaaaagggggtggtgtgaaaggaggctgggcagagtggcaaaaaggcctcaagtgctgccttgagatgcttggacttgatccattgggtgctgaggagcctttgaaggggttcagcagaggaggggagtgatcagatttgactatgtctatactgtagaaactagatggaaggtgaaatggactctggggctcagctaagtcaccaggcccctcatttctcattttctgggcctgagttcctaagggagttggtgtctgaggctgtgaccattctgcagtttctcagcctgaattttcccctggcctagttgtgacatttcttgctttatctcatagatgccccccttgactatagagcacctcccaaccccagtaccgctagctaggcactttctttcctgctggagagtttacggtctggcctttgcctgtgtctaatgaggcaccaaaatgtcttttgtcactgagttaacttctgagaagttagcagcccctggacacagcccaaggacaagaaagatcttcagtgtgaagagcagcacaaatgtcccccttcttcaggaattgctacttatttttgactgctctgaacactggggatttataatatcttggccttgtgtttgctgttaaatctgtaaattaataagatagggcaaagcagtgctttaaaactacaatttgagacaagtataagtaaaacaagcaggtatcctaaattcctaacctgttgactaaagtggaacttaactgtaaacaaagcaagagcaaagctagaatgaactttgtctaaattgagagcaaaaagcttatttttaagtaaatgttcaaaatccctctatgaatgttagaattgccatctttttagtcgaaggaatgaatgtaatattcctggcaacagttaatggtccattggtggcagccctatgacatctttatgatttgataggatgaatcatggaaattctaccctgcccaagcttatgtcccaggaagaatgattggaaaatctggttgaagatgcgtcagtttattcccacattgtctggatctgataaattcttcatgcattttggggatcaaattactacagtcgactttgctgtgttgccagctagtttgcatgctgcaaaatggaagcagtttacgcttaacacaaatgccatctacaagacaggaaaacataatgttttactgtcttttcttcctgatcaccatttcatctagtggcagcttatggtgattggggaattgagaagttttctagactcctgaagtgtgcagttctccaagtataaccttcaaacttcaatgcctagccatatgtattttccttcctttaaataaatattcattgtaccagggactctcctagaccttgaagatatggtagataaggcaaatatggtccttaatctcatggtgaagaggttgcatgtatccttttgtttgctgtttaccaagttacatttaacaccataaaagttatttttaaaaggtttttttcttcttgagaaaagttcccttctgccatgttcatgtttctaaatgatagtaaagaatcacaatgataattatctttaagcctgtgagatggaatattttaatgccattacttatgtttttgaggaatagttaatgggaaatatctcaatatatgatgctaaatgaaagaggcagaactaagctttatatatcatatgataccagttttagtaagtacagaaatataaggatatataaatagttagaaaaataaataaatatatgggtaagagactgagtgaaggtaatgaaaatgttaatagctctataatgtgtgggtaagggcattatgattactttttgccctaaactattgtgtgtttttttaatttaaaaaatcatgttacttttgtaattagggaaaaggttattaaaaataatcccttgttttgaattgaaatagacataatattatcataaagatgcccacagcaaacatattagagtctctaaaatcataatattatcataaagatgcccacagcaaacatattagagtctctaaaataacagtgagagccgcaactaatgataatcttcctatctccatgtttctcgtattctaaatgctttacctctctccttaaagtcactctttattttgctcatctccatccagctctgataattatttaattgaattattattggcttatgggagaaattatatattgcagtgatgggctgatttatgtaggtagctctgttgcatctatttaaattcctgcctaggcaagtacttaaatatgttaaaaagtggtgaaattaagtaaagatatgcataacatgtgtatttggaggtgcagcatcctacggatacactgttcacaaatgggaggaaggggacagctaagggaatgtcctggaataccactcagtgaaaagttgggacctcaagaggagttcctaatctgggatgtgtgtgtgttttataaggtctgcatattcatatgtgctacaagtattttttgtattcagcaaatcacatatagtaccctcatacctatatttatacacacagagtactctttttgtctcagatgaatgtaactcttataatggataaaaattaactatttcataagcatagttatcaatgcatcctgaaagtacaattgctatcctggggtcccttgtaacaatgctatggtgacaactcacctaacatttcttgggtgttcagtatgtatcagattctatgctgagcttttcatatgttgacttatgaaatgttttgtcatttggaaaggtgtcttcatcattggaaaattgggaactactgaatgaaaatgtctggaataaattctaagacccaaaagctttggaggcatggataagaatcctggtgtcagagagacctgggttcaaaccctggcttggtgtgtatgtgagtgtgtgtgtgtgtgtgtatgtgtgtgtgtgtgtgtgtgtttttctggctgtgtgattttgagaaagttactaaacattccctgaccccattctcatttgtaaaacagaagttagttttataaggacaggcaaaattcttaaccatgcctaagtagtgagggctcagcaatgatacctattccatcatgaacttacagtcacaggttaacttgaaaggacaacggtgagtaacagttgctatcagaaaccccatatatgatttttgtagtgttgagtcttatggccagaagaaaggagatataatttgtctgagatttaataattttaagccttgttcaaggttaaatttggcaagaaaggagataaaatttcagagagccattcagcagggttaggtaaaggatgtggagtgctacatctctcttaccagctattgattctccagaccttgggatttgctgcccagtgctctcctgtaggacacaagtggatttgttttctcaagtgggtgttccctctgccttttagtcttcttcctggcatctgttgcatctggttttgtgacctggtggtagtttcggtggccatgcccacagctggcaagacggttgttattttaatgcctttaaatagtttgtctgaaccacagcccttggataccaagaatcaacattgtaaaagataataggccctaatgatgtgggttgttaggtggttagctgagttacagagggtcttgttacggggcaagagtttggacagacattaatcagatgctagagtaattggggtcctgctcagaatgcaatgcactccagtgacccaaattgtaaaaagatactcctctttctaagagtgcaccctggacttggggacaaacatttgcagatgggcttaatgaggaaaatttccatagcaattttacgtattgtcacacatgattatggaacacagggtcctgcttgctctgatcaagcatttagtcgtccatggcctgaaaaagaaaatcagatgaaacctggttatcatattccttgctgatttcttcagtgaaggagatgtcaaagcctgggtggcagatagtaaggactgggtctgctttttgtccaaagaagttgagattctacatgaggcaagcagttacattaggaaaaggcagagttttatggagtgttaaaagagtttatgtgaaagtacttttgaagagaaagaattcaaagacaacttaaatccagcatgtggctttataatgagacagacagacatacacacacacacacacacacacacacacacagacacgtcccatggttaaaaaaaaaactttttttctgagtgtaagtggctgttttggggacaatcttgtatcttattgatgtgactgtgaagatattccagtgttttcaaaatatgcatctaggctgggtgcggtggctcacacctgtaattccagcactttgggaggctgaggcaggtggatcatgaggtcaagagatcaagaccatcctggccagtgtggtgaaaccctatctctattaaacatacaaaaagtagctgggcatggtggtacacgactgtaatcccagctactcaggaggctgaggtaggagaatcacttgaacccaagaggcagagttgcagtgagccaagatcacgtcactgcactccaggctggcgacagagtgagattccgtctcaaaaaataaaataaaataaaataaaataaaataaaataaaataaaagcatctaattaaatgtttgtgtcacattaaaaactttaggagaactaattacaaatgtttgtgtgtctcttaataaaagtgagactttacatagttagcagagcaaaagtaaagttaaatcatgcatccaacccacaagtattttttgaatacctactgtgtaccacgcaccatgttgggagatgagagtactctgttgtgagcaagacaaacaacccctgtcctcatggcacttagagcaacctgatgcactcaaagttgtattgttagcattttcctttttgttttgagacagagtctctttctgtctcccaggctggagtgcagtggtgtgatcttggctcactgcagcctctgcctcctgtgttcaagcaattatctgcctcagtctcctgagtagctgggattacaggtgactgccaccacgcccggctaacttttttttgtgtgtgtatttttagtagagacggggtttcaccatcttggccaggctggtcttgaactcctgacctcgtgattcacctgcctcggcctcccaaagtgctgggattacaggcgtaagccaccaggcccggcctgttagttttttcctaaagcaatgtaagacatctcttgtcaggtcctctgcacaaggtggttctttagattaatctgtgatcttattttgagatatcactcagttagcacttatccagtaccttcctccactcatatggtcctcccacgtccactgtaaatagtatcatcattcctatttccagggtttcaatttgacctttgtatattttgtttttaatatgcttcttttctggagaatagtcacaaaataattgggatgattcaggggatactcaatccctgatatgtcataaacacaatttagataggagaatgtgccttttcctcatacctggaacattttaattggtattttatttattaagtcatgtagaaaacgtttgatgcagattttagtgaaattgctgtaaaattatagacaattggagagtatacgataacttaataattggggttttctccagtcagaaataattctttatttttgccttaatcagcatgagtaagacctaattgtaccccttttaagccaaaggtcacgaactacaaaagtggacgaaaaatccggtctccttcagcttctacaaatagctcttagagttactttaaggtcagaggctgtcaggccactgtccatctctcaggcacttaatgatagtttaatcaaatcaagaaggagatactgggtgatcccattcttgatggtctctgataagctggtaatgggcagaaatgtttccctaagaggtttatgtttcagctgcacaaagaaacttctatactgtctttcaggaaatacgagcccaggtacaataccaacttatcttttacccaagagctttcttagcttgaaggcccatgattctttagacctaagacatgtgtgatttcaatgtcagtggttgtggaatgcattttattttttctaaagaagttaatagcaaaggcttgttttcttaagagcttgagcttaccatattcatcacctcacagttacctgcctttttttgtggttagaacacttaagatctacctcttagcaaatttcatgtatgtgattatcattaactgtagtcactatgctgtacaatagatctctagaacttattcatcttataactgaaaatttgtccccttctactgtctgtttttatgagtttaacttctttaggttccatacatatcatatatatctggcaaatttcacttagcctaatttcctctaggtttatgtatgtttttgcaaatgacaggatttccttgtgacaatcatttcacaatgtatatctatattaaaacattacattgtataccttaaatatatataattttttggtcatttatacccccataaagccgcatataaatacatctataaataagcaaaaaaaaaaaagcttgagtttagagatgctcagaataccctattatgtttgcaaactctcttttgctgtagattgcagtgcagttgcatttgagttcttgcatatgagttaggatgttcctggagactctataaatgcaaaatcattataattaaattttggaattttaacttacctttatagctatttataaacgtgtttaatgtgttttggataattaagagaaattagtttttatcctcaacatgaataatttttatgccctgctaaaatgcactgcaattcatggataaggtaatttgaggctttcaaaacccaaatgaggtttttacctggggatgttcttggggttattacgggttactagggaaagtgactgcagactttggatgttgcagcaagctaaaaccttgtgctgtgctcagatggcctgcggtattctgcctaatggtggaatacaaagatggccaaaccaacagactgatgactattttgattcaggaactggaagaagttatgtttttgcaatttgactctgagttaatggcagcatttgcttctcatgtagctaagcatgttaataaagcatcctttctgaaactgatccagaaaacaggcttccagaaggaaagaagaattcgctggaaacatagtaagatgttgctctcctactgttgtaaagaagaaattgttccatgggaactattttattatgaataagagcatattcttaaccttttattctttgctgatagcaacatttatgtgtccgatagttatatattgtcttgtgtttttaaaaagaacttgcctaacagtttgggtttctactgagggtgtagcctgttgtacccactgaagcaaatggctttgatcagtccttccctggtggctgggctgcatatgtataaacagaggattattgagtgttgggaatgaattctttgccagacacatattttaatgagattcttagaattgcttcaagctctgttttactaattctattcctagttccttagaaaggaaaagacaattaaggaaagagggcttgggccttgctgacttttcacactccttggaataaagttttggtttccatacagttcttctgagaagagtgaactgaccccagaagggctccatcatatgttttataagtaaaactaaatgggcattttcacataattcaagtaattaacgtccatgagacaagtctgtatgtgacacagaagggatacagaggagcaataattctgtttgcttggtatatggtagatagtttgctggatttaattcttgaggaattcagcaaaggcttcctaaggggagctgtgtcagatgttagggagatggtagtgaagataggatggggagagaagggaaaaccaggcagaaggactgaagaaagtttagatgaggtgggatgagacagcaagatgagtaccaagaactctgacaaggtcagcaaactgggggttgctgagcagagggaggtcacatgagtaaggtacttagcacagtgcctggcacatagtaattgcccattaaatggtagcttaaaaacaaaagctgcttcccatgatgtgctggtaaacgtttaacaaccggctgtcataatggatggggaatgaaattcctgatttgtagtatttgcagatttctctggcatagttactcccaccatggcccatttcaagctaccgacataatttcttttaatggatagttggggatttcagctcctgagctggtacgacctggttccaacaaacacagacggcttccttcttttgtgtaatccttgaagtctttgcaattcccccttttgtatctatggagtattctcctcaagtcaccttagcctaagcagcagaaagttgactcagttactaaaagacacatggtgttaatgtgaggaatattattggaaataattgctaggctctcagatatgaattttgcttgggggcatttctagactcacatctttggacaacagccacttggagttttagacatgaggataggaacactttctgattcacagttgggtgagggtggccctggtgggaggaactgattaatctgagtaacttgttagagctgggaggaaagatatttttcttagtaaaaagatactaggtagtttttttttttttttcccctgagtatttgagtaggcaaactgtgtgggaaaaaagtgaagagaatagtcctggattctgtgtgatggaggtgagtgaaaaatgaggacagagaagtcattaaacctgctctgtgtgagggtttcttgggggaagagtaatgcagtaatggtgaggaagcctcctgtttatagccactcacctaatgtactggccctggtgctgggtgatgtataaatattatagtctgaattcctcacagtaaccctaactcttgagagataggtattcaatccattcagttgctgaagctggaaacttagaaatcatctttgattattcctcatacccacacatcctatttataaccatgtcctaaagactatacctccaattatatttcaaagccatttgactcctctgcatcacccctacttatcctcttgtatagatcaccatcatcattcccttcttatctagtgtcctgagtccacagtttctccttcatccattctccacatggcagccagagtggtgctcttaaaaagcgtatggctggccaggcatagtggctcacatctgcaatcccagtgctttgggaggccaagatgggaggattacttgagcccaggggttccagagcagcctcggcaacgtagtgagaccctgactttacaaaaaaattaaagaattagccaggtgtggtggtatgcatctgtagtcctagcttcctgggagacttaggtgggaggatcacttgagcccaggagtttgaggctgcagtgagctatgatgatgcccctccactccagcctgggtgacagaacaacactctgtctctaggggaaaaaatgtgtgtggtgtatcatgttattcttctgcttgaacatattcaatgtcctttagagttaaaatcaaactccttctcatgatctaacccttaattaccactccccttgttttctcagctccagaacacttacctgtcagtttttcaaacatccaatctctttcctttgcctttgtctagaatccagttcactctgcttaccattccccactgggttctttttcacccttgaggtctccatttaaatgtcacctgttaagagaaggcttctctaatcttgtattctcagtagatccttccccttccccagcattcttggcctcaacaccctgtttgtttccttcatagcatttcccaacaatttgagtgttaaaatttgcttccttgttttcagctgccttacccaacagatcatgcataggtaccatgtctttcttgtttaccgtggtttctttagtccttagcacagtgcctgtcatataatagatgctcaataaatacctgttgaatgaataaagaaactgagccataatccagggtcacctaggcattaggtggtttccccttatgtctggtgggcatctaagctcattcctattcgccacttctgtggtacagtgggctggcggccccaaggttgggagttgttgtggtggcctgtgatcttgtatagtctggacccagtcccagggtgatcctcttactttaaccatcattcatttgataataattctcaacctgagtctacacagcactctttccttacctccagtccacgctcccactgccaactgggcatattttgactgaacgtcagaggcctaagaaacaacttgtacaaaaattggattcatcaaattctctttttctctttctgtgttttttatctcaacaaatagcactttcatgtactcagttgtcccaagtcagaagtctgagcatcctatctccaaatcagtcacccacacctatcagtttggacatctgtgtattctctgattcagggcccttctttctctacctatcatctgccatagctcaggccgcagtctcctctgacctcctccctggcctccctgcttcaggtcaggccagccacagtacaaccctaggtatccatctgaaatgcacatttgatcatgtcctacccatcttaaacccttacactgcctctgtgactattcaaagcaaggtcaaattccttagcccattaagaaggccagggaagaacattgaactaacttatgcacaggttgtgaggaatttctagggcaaggagctgaggagcaagacctgatgcatcactggttcattcattgagaaagcagtacctggtgcttcctctgttctgggctctgtgccagtgttatgtgtccagaatggacaaatttccctttttcttgccttggctctttctcctttatgtctcctctggcctctttttgttggtcatcatccatttgtatgcatgcaacatgtgtgtgtgtgaatgtttattcctcttagttcctacaatgtatgattatagttaactacgtgttccacaggcagcctaggttccaggaattgatcagtgtttctagatgcatatttctgactcctaatacttgaagtcaaaactagagtatgtcatcactgtaaagtcttgtgaacccaaacactaagaatttttggaaaaatttggaagtatctagtttatccttttgctcactgccactaccattgccaatgacaacagcaaacacttgttgaggaaatagtgaattgtgaaatatcagtggattgtgaaaatcagccagttgggtgaagaccaatgtgttttaaatgaaatagattagtatggaatggaatggagtaaaacagaaatatcaccctttctcatgtatagtaagtggaggagttgtttcatgaaactttagtttctattaaatgtgtgttgtacagacggctattgctaccattattgtgttcccctcttcttcactgtgtacacaactggactatatttcctggatacctttgcatgtgtggtcatgtgactaaattctggctaatggaatatgaacaaaagtgaatattccacctccaggcttggcctataaaacccttgactcaacttgtcccttaagtgtttgctatggtaggcgtattctaacgtagtttcagaaagctgtgatcaggaagtttagaagcatttatattgtcacatttaactcttttatccctgtgaagcaagcattatcaccattcccattttacagatactgaagctgagacacagagaggccaagttacttgcccgaggccacacacctagaaatgagaggagccagattttgaattcaggccactggggctgcagagctggggctttccatcatgacattttgctatttcttaggatcatgcctgtatctcaggcatgtgcaaagccagtaccaagagcttttttcacacctgacatggctggagttcagtttccagttatgtttttttaattgttttgaatctgtttttataaacacggactctgcagacactgtgaaaatactattgtgaaatatgactctgaaggcttcagagtgtcatgctggggattagcagtgttattcccagggattctaatgtgagtctggctgccaaaaatcccctccactgttttggaaaggacaaagcggggtatagtcccatttataggggtgaagggtaatttctaacatatggctcatgatttactatcttgaagaaacatttatctgtggctcagtagctaggcctcgtcaagccacagatgatgaaagtgtttatgaggaatggacttgccagttcaattattatttcaagggaaatggctaacaggaaaattataccactgtagttgttagaagctaaaatctatttgtgtctttgtggacaggttgatggtttttaaagcagtttattcagtttcccttatatcttctcaataactcatctcaagaagttttggtctttgatatgctaaaaaaaaaaaaaaaaaaaagaaggcaagaaagtcatctgtcctgtgactcagcagcgagtttagaggggaactgcttgactgtggataccattgcctggacttgatggaaaatgggctgtatttttaatatacttaaatttacctattctagtgcttttcctctcaagatcacaaaagatatagtggacattatctcatatgtttaatcaagatctctgtgaggagggagtgtgggatggttttctaactttgtctaatgagcacgtagtgtgtaccttctgtcgtgttgccttctggtgaagcatgcccatcccctgccccacccaaaccaccatcttccctggtgtagcagcttgccaaggggaggtggtggatgcagcccacctaggagcagcaatagtagtgtggattatctgcagaagacctagaacagtaatttttagctggctaaaaatcagtatgcatatactctcctcgtgctttggtgtttctaaacaatgcagtgatacaacactctgtgctgtggtgggccactcctactgctcccctggcctcctttgtcccctgctgtcctgatggtcaggtttacacaaaggatcaggttattaggattcaatgttaagtgcagacagtagacttcctcacagcatgtatggtattgacctattttttttttcttattttagagacagggtcttgctctgtcacccaggctgggatgcagtggcacaatctcagctcactgaagccttgacccctcgggctcaagtgatcttcctgcctcagagtccccagtagctgggactacaggtacaccaccatgcccagataatttttgtattttttgtagagacaaggtttcctatgttgcccaggctggtcttgaactcctggactccagcaatcctcccacctctactccccaaagtgctgggattacaggcatgagccactgcacctggccagtattgtcctattttaattggagagaacacacacacacacacacacgcacacacgcacacacaaacacatccctaaacatacatatatatagtagttcccccttatccacgatttttctttgcatttttttcagttattcacagtcatcattggtcagaaaatattaaatggaaaattccagaaataaacaattcataagttttaaattgcatgccattctaagtagcatgatgaaatctcacgctgttctgctttgtcccacctaagacgtgaatcttccctttgtccagggtctccatgctgtctatgccaccttcctattagtcacttgtagccagccatcttggtgatcagatcagttgtcatggtatcgtagtgcttgtgttcaaggaacccttatttacttaataatggccccaaagcccaagagcagtgatgttggcatgttgttataattgttctattttattattggttattattgttaatctcttactgtgtctaatttgtaaattcagcttcatcataggtaatataatagtatatacagggtttggtactatctgtggttttaggtatctattggaggtattagaatatattctccttggataagtgaggactattgtacacacattcatgtagaaaagatctagaaacatgtctgtgccacaccgttgactgcagttatctctcacagtgggattagaggtaaatttcacgtttttttcaagcctgctgtcatgcactgcataatgatgtttcagtcagctgtgggccacatatgacaatggtcccataagattataatggagctgaaaaattcctatcccctagtgatgtcttagctgttgtaacgctgtagcacaattactttattttaaaaaataaagtcagtgtagcctaagtgtacagtgcttataaagcctacagtagtgtacaataatgtcctcggccttcacattcactcaccactcactcactcactgatccagagcaacttccagtcctacaaactccattcatggtaagtgccctgtataggtagaccatttttcatcttttatgcctttggctttctttgttttaagagacggtctcactctgtctcccaggctgtagagtacagtggtgcctgccgtttctcttataagcacattggacatcattggatcgggcctcgccgcataatctaggattatctcatcttgagatccttaatttaattatatctgcaaataccttttttttccaaataaagttaatccacggattctggatggatagatcttcttttgtggggtggtggcgggaggagggggcactattcaactcaacacatactgttttttagttctattctttcactcttcaaaaaaatctttatatgagtacctactacatgttgggtatttgtcacatgctagggatatagcagtgaataaaacagatgatttacttgtcattagggaccttatggcatgatggaaaatgtagacactaaagcaatgaataatttgataagagctgatgactagcttattggatgatcttcccaaactaattaacctccctgagtcccagtttattggtagccctgtctaactcaccagaaaagttataaagaccaaataggaccataaacatagaagtgtccttaacctggctattttattgccacgcttttactcatgctgtccctatgagatccagcatttgggctgtggaatttggctttcggattcaaaccaatcacaaggttctaagactttgggcaagtgatttaacctctctgggcctcaggtttctctgttgcaaaatggggataataatagtactggtctcatcagtttcttgtcatgatgaaaatgagctcatgcattggaagttaaaaaaactatgcataaattcttatgcaattaatgtgtgctcattttaggcaatttagaaagtacagatttacaaaaaagaaacttgaaaattactcacgatcttgcctacaactaatttctggtaacattttgattttttttttttttgagacagagtctcgctcggtcacccaggcttgagtgtggtggcatgatcttggctcactgcaacctctgcctctagattcaagcgattctcttgcctcagtctcctgaatagctgggattacatgcatgtgccaccactccctgctaatttttgtattttcagtagagacggggttttgccatgttggccaggctgatctcgaactcctgagtgatcctcctgcctcggcctcccaaagtgctgggagtacagacgtgagccagcacacagtttgatatatattctttcagtcactttttcacacggtttatattttcttattaaaacaaggagtacacactgttttctaaactactcttttcatttaacctattgtgaacatttccctgtattcatgaattttctttcccaacatcattaatataggctgccaatctaccatatacctgttttgtaaattgattaaacagttatacacaaaggagagtcaaaatcgggtaggtagtttatggacagtgcagctcaaataattcctctgcctttgggacccttttcattgggatgattgctggccttagtggtactacttagtgggagaccttatggaaaactgatacccattgtcaaatgaatgtgtttcctgtggacttggttaagatctgctgggatcccagtatctaaagatcttcagttccccattgggccatgactgaggccaatgggtcaccttcttcaggcttagctccattccaagaccccattgcccctctcattgaagacaattcacctggtacaggtgacacagcatcaagtccatcttatggtgattcccactcctgcctgggtcccagcctgagtctcttgtaatagaaagcatggtctctgtgtttagggaggcctgggtttaaatcacatcagctgctcaccaaccctgtgacttaagtaaaatttcatgaattctctgaccctcagtttctcagctgttaagtggggataataatatgccccacagaggattgatgtaaggcttgctttaaacttcttctggaacactatcgagtagaaataaatggatagaatataaatgagattatgtacattattttccaggagttattttagttatttaatagacatttatctcatgcttactatgtgctaggccctgttacaactattaacctcattttaaacatggatggaacttaaagaagttaagtaaatttagcaaacaatggggagtgtcaaccttgggtgagacactgtggagtcatgttagagagcagagtgccacattctgcccaaccctcccagagatcctgtgggagacataactatattcatgcatgaagaatgttggagagatgtaggtaataatggctaagaggaaaggctggagattgaatctgaattgtgttattttaggccagtcacttagttttctcagttttcttgcctataaaatgggaacaactgtgaagattaaaggacacagaacatgtatacttaacatgtacctgctacatggacactattaatacctgaaatattgactatagttatcagtgttctaatgcaaataaaagcaaagtacaggatgggaggaaagaattgagacatttgtgcacaggtgtgtgtgtgtgtggcctgtgcagcagatgagatttgagttcatccgagttcatgactgaagggaatgtaatagaagggacctcctgggtaagtgtgaacctggtgtctggggtgggggagtgtatgtgggtgagtgtgactgcagtcaggggaacatcagggtagttaactggctggggatgagattggagggtgatgtgcaacatctttctaggaaacggttttctgtcttgggtttgcgacagcactgcaaccttatttcatctacctgcccatctgttcatctatccttcatctgagcacttaggcaagtcacttcacctctctggaccttactcccctcctctgtaaaatgaggttgattgcaggatctcatggagttgtgagtgaaggttgtgtgagagagaccatgaagaagacctaaactggctcaggcatagagaggacacttggtgatggatattaggtgctgttatttcagccgtgtgccagagggtatgctgcatgctggggagctaggtcagagactcagacagtttgcagtgtgcctcctccaggggtagtacgtggctgaggactctatacctcttgctccaacactgaggcctggcatgttttccctggaccccctgaaaaccacagttctcccctgggtttccctcccactgcctgcctacctacctctggctaccagcctgcctagcaaggtctcttccagggcctccccttggccagctctgcctgtgcctgtaactccacctgtgcccttctgctcaggttgcctctctgttacattttgctaaagagaccacctggcatcttggagcaacctctctttgtgactattcctggctccctgtcaggatacacaccctttttctagcaccctgctcttcctgcattgacttatcttggtgccctctgtactccaggctgttatgaggatgttatcttttcacttgggtcatactattacataaatgttaaatagctaacacttggctgggtgcagtcactcatatctgtaatctcagcactttgggaggccgaggtgggagggtctcttgaacccaggagcttgagaacagcctaggcaacaagatgagaccccatctctacaaaaataaaaaaaattatctgggtgtggtggcatgcacctgtggtcccagcctcttgggacactgaggtgggaggatcacttgaacccaggaatttgagaccaacctggtcaactaagcaagacctcatctctacaaaaaaattttaaaaagttagcagggcatgatggcatgcacctatggtcccagcttacttgggaggctgaggtggggggatcgcttgagctcagggaggttgaggctgcagtgagctatgattgcaccactgtactctagcctgggcaacagagtgagaccttgtcttaaatgaatagacagatagctaacacttattgaactatgttccagatactctcctggcaccactgctggctggctttacacctggtaaccacttcattctcacaactcaatgaggtggttgcagctgtcatccccatttacagatgaggctgtgagccacagaaagggctagcaccctgcccaaggtttcacagcttgttggtggcagagcaagaagaggtttgcaaataaaatgttcaaaagtcagtaattgtacttacatgttttataggaggaagggaccactgttaccagagatgtgaaaaaaattctaccatccctaattccatttcattttttagatacagcctttagggatccccttctggcagccttaacaattttgtcgcttagcctcatacttgaggcctggcttaaggcatcatattcatgctaaagatgaaccattttgaacactataaaactcactaatgccacctgtctcagtccttgggctttcatgtgttgtcacttatgtcagtccttttgcttcagttttcctctaattttaataaaataagggcaaatgccataaaatattccagagttgcttggacctggctgcagagattagatggtgaggtttttgagcaggtggagggttggcttgcagagagtgccagcgggttgtgttcaccatctgataccctaaagctccaattccatgcatggataatggcttaaaaggctccatgtgtggtgcctgcaagccaaatgttggaaaattctatgggggatgccaagaacagccctcacagaaggcaattctctagggggattggcccggacttgttcactgtgagccccttgatacagaaccccttactttgtcccacacatgtatggacacaccatttctgattcaggaacatcttagtttgatgcagaacagcatcattcacagctgttcaaattctgaccagattttcagcggcctgagtagacccagaaggatggactcaacagatgctgctgttgtcaggctgtgcgtggaatggccagttcttgacaccacattttaggacaattagaagccgcagcttttccacagaagagtcaccaggatggttcttatttgagctcttgcattccatcaagaacagttgaatgacctggaggtatctcacgtaaagaagaaaagtccttagaagagagcagtggtctggcttcccatacttggagaaccgtcttatgaagaaagaaacagattcattctgtggaggttatgctgtgtagctgtcaaaagcttgacggatctttggagaatgacagatgtgggcccaaacctcagttttgctttccagtggtctggtcttaggctgctccattaacctcttcaagactctggtttcctcctgaaaactggggataagattggtgcttacctcctaagtttggggtgtgggttaaatgaaatatttcatggcaagttgttagcgcaatgcttggtgcatggcaagaccttgatgaatggccagtaagatgttattaaattttgtgtaatgaggaactagaccaaagaggggagagtcggacagcagattttggcttaacatttataaggagagaactttccaactatcagagctgcgtcacggaggcatgactgccccaatctgaaatctttcaggcttcagcccagtgacccccatcaaggatgtgaaaagatttaggctgggagagagaagctggaccagcttgttcccatggtgctttccaattctgtgagccctcagcattttatactacaaggcttcattacagacaagtgtttgaaatgaaaatctgcagcaaaagaaagaccatgcccttttctgtaaaaatgtcaccaccaccaccgctgccaccaccaccaccaccataactgtgttctctcatggtctgaagtgtggcacgtgtctgcagccagggaagttgtctgtgtaggagccgccctctgctcctgcgatctgcagccatctggaccgtgggggtgtgtagggaacacgctgttgattcatatgccattccttgctggcatctctaaaatgggccctctggctggagctgtgaagcagccagaccctccctctcccacgccttctccacgtactcgagagagaaaggggtgtgagggaagatgtgtaaagatccaggaatgtggaatgatgtttgggtggctcctgagggcaactggatggagagccagaggctttcttcaatccagttttagactctgggactcaaaatatgatgcccagaagggtggccctcaagttgtgttcagaggaaccttagagtttcaagaagacacctcagggatccttgcagtggacttagtggatggatgacaggccctttcctccccctgtcaccctattaatcagagcaaatccacttctttcctcttcctgttccctctgccttgaccacgttccccacaggtgtttgcgtgctggttcctgctcatccttcaggtcttggtttgagtgtcatctcctttgggggaccttgcctgactgccagcttaaagttagagtgggatgataacaggggaagatacaatgtcttaattggtactgcactttagggctagcgagttgacatttatactacatgtttgggaggcagacctcatatggatcctataattccctcccccatcattctctatctcagcatcttcttattgctgttgtttgtaaagcacttattacctgtatacatttacaatttttaacttgttgatttacgtatttctgactgctgtctataacagacagtaagcctcatggtggtagcagccattccgtcttaattccttcctgtctgcaggacctataacagtgtctaacaaatagtagatgcttaattaattttagtgtgtggatgcgtgtatgtgcgtgcatctcatctggggacaaaacaagcttgaaggcttatactgctaaaataagttttaaagccacttacctaaaacaaaaataatggagtcctaccctatttactccatgctggttcagataaaacctggagttctgtgtacaacctctgaatcgtagattgtaacagatgctcattttgcccaattcagacccctagcaacccttttgctgggcagatgcacccatcctccagtggctgtgagtgctgttgccaacagctcatatctgtgacctttcctggaagtgtgcctttcatgactagaattgccaaactttttcctgtccagaagtgctgggggaacccacaggcagaggctgactggagcgagggtacagaagcccagcccccttgcctcaaggggaacagactacagcatagcttactctctagagctccctgcaagtccaggctcaggttagatttcctatacaacacccttgcttaacttccctgtcttctctatatggcatctttccctcccttaaagctttcctgaagagccctctcttaataaaccacttgcatggaagtccttgtctcaggctctgcttctcaggaattcaacctgacatatagaagtagactaaggtaagtgacccaggggttgctaatagcacctgatatcgtgccatataagaaacagtaggactggccgggtgcggtggcttatgcctgtaatcccagaactttgggaggccgaggtgggcagatcatctgaggtcaagagttcatgaccagtctcgccaacatggtgaaaccctgtctctattaaaaatacaaaaattagccaggcatggtggcaggcacctgtaatcccagctactcaggaggctgaggcaggagaatcacctgaacccaggaggcagagggcagaggttgcagtgagctgagatcacaccattgcactccagcctgggcaacaagagcgaaactctgtctcaaaaacaaaacaaaacaaacaaacaaacaaaaccaacaacaacaaaaggaccctgtagtaagaaagacattggacttggatactgttatcatcggagatgaacctgatttgttctttatgcccttgaatgagtagaacaaaggccagtgtatggaagcttcaggggaattatttcccctcaatgcagaaaaaaaaactctccaacagaggagtgcaaaggagagattagctattcaatattagttttctattgcagccatgacaaattaccacatgtttagcagcttaaacaacacagatttattagctcacaggtcagaagtatcctggtatagcacaactcaactagattttttgcttcaagttctacaaggtcaaaattaagtatcatcagggctgtgctcttttttttttttttttttttttttttttttaaggttcttgagatgtatatgctttcaaatcatttaggtggttggccaaagccacttccttgcatttgtaggtccaaggtcctgatttccttgttggtcatcagctgggggccaccctgagcccttagaggcttcctgtggtccttgcacatgatgtggcccctacatctcagaatcagcaatgacacatcaaatccttctcacactgagaatctctctgacatcctcatctgccgcatctctctctgcctccagccagagaaagttctcagcttttataaggcacatgtgattagattgcactcacccagattatccaggataatctccctattttaatgtctgtaatcttaattacaaatacaaagcctcttttgccatataatgtaacatattagtaagttttagaaatagaaagtggacttcttttttattctgcccactacatttcaccctctgactcccaaagattcacattcctccaaagtaataaatacattcacctcatcccagatcttcaaagctctcatcccattgcagcatcaactcagtccaaaatctcatctaaatctcatcagttcaaaagtcccattgtctaaatcgcttatgtatggatgaggctctgggtataatccattaaataccactcctggggacacaatttccctcttttagtgggcttgcaaaatgagagaaacaagttatctgctctcaatagataatggtggtagaggcataggataacagttacagatgaatataatgttcaaataggtaacaaggaaggtaagatggagccactggtccattgcagttttaaaatccagctgggaaatccatgaggttttaaagtatgggaataatactccatggttcttgcctctgcactcaaagcctacagcacccagtttttccagctgctctctcaccccaatactaaccaggcccaatattgcttagcttctgagatcagatgagatgagatgcataggctgaggtgagtgaccaggacactctgtcatgtaagaaatagaataatgattctttagtaagaaaaactttggactagaaagctgtcacagtggcagattggcccaatttgttctttatgtccccaaatgagagggacaaaggccagtgcataaggttcagggaggtgtattttagctcagaaatggagtccaacagagtagtgcaaagctggttgaagattaatcacccacatgtactcttccatgaggttttccaaagccattcttccctcatcaggcctggatgcttattttgcattctctctcatagcatgtcattcaaaatgagtggggttctatcagggaactgagaaacaaaccaagagtcagattcagatccctgttaaaatactagatgtttgcagaggatgaagcaactgcagatagcaatataaaccaagtgttatgttagtaattaaaagagcgagtttagacctcagactgaccgtgcttgtactcaggtcttaccacccttgcaatcttgggtatgttacctaactctctcagtctgagtggctgcaccttttccatggggcggtaagtcctatgtggtggaatgctgtgcagagcaaatcaggcactagatgggaagcatggggctttacatatgataatcattgtgtaagttatagctgctgttattattgttgaaattaacatttgtggtcttatattccaggaaatatattcccttttccattagacagtcaagttccttgagacctgggatggtgtttcatttatctttgctgtctctgcattgcttaacatgtgttaggtgtccaataattattgaactacataactaaattttattgtttctccctatgacattgctaacataacacaactggccaaatattaatagaatttcattctattaatttctgtggtttccaggaccataacatctaaaggaccaagatgaatctgtgaaaaagtctttaatgcagattcaccaaaaggagcacattatccattaagacaaattaaagaaaaatgtacatgcacagagattcagatagcatagttttaggctcccaaatgtccatttacttgtgacagctgaaaaataatttactaataacttcctactgtatttatctatttccatggaaactgtttccctgtctctctagaatttgaagccttctgtgtatgacaaatatctttataagaatataaagatatttttatatatatctttatatatgggctaatacattctgccccctctgcagcccttacctcttggatctcatctctcagcattctcctcagcattctttccactccaacaaccctgggaaacttgccgttccccaaatcctctaggcatgacgtcaccctcattgagaatgcatgcactagaacataagctccgtgaaggcagggattctctgtgtgtcctacctggccaatagtggatttttgctaaatgaaaattattcaattagacccagtgacagtgtattaatgctagccaatgtcagagcacagaacaaagaggcagggaaggcattctgccagactgccttctttaatgtgctgtcgggaacactaataatcattaaagagcaaaaacagtcataaggatacatttcaatgatgattgtatgctgtgtgtcagtccatatatttatcccaacctctctacgcgatgaaatagctgtgacatccatgaggaaactgagtattagagaaaatccagtaacttgcccaaggtcatgcacctagtaagtggagaggacaggatctcactctagagggtaaatttaaagattttatgagctttattttccaaatagtgaggttttattttcaacttttatttttaacttcttgctttattgtgtatggacaaagaatgtagcctgtatattaacttttgccttttggaatccatctgaggttttccttggtggcctggtatggggtcaatctttaaatattccattgagtcttcaaatggaggttattggatccaaagttcagtgtaactgtctattaatttaggcttattaattctattatgtaaatattttaggttattatttataaacgcttgattggtcaaagattgagaaggttattaaaatttgaaagtaattgtggtttttttttgccccacttcttctgtgtgccaaccatgtttgccttttaagttttaatatctaatatggacattggtctcagacaactgctactatgataaaattctttcattttcaaatactgaagaaaagaatgggaaatgagactgaatcaaaggagaaatagggaagtgcctataatgaaagaagccaatggaggtgtcaacttcaaatatcaactcaaagccaagtggtgaaacgggggcagtgtagggaggcaattaggagcagtggctctggagtcagactgcctgggataaatttctgcagtacagttcagtaaggttttcttgagtaagttaataacttctctatttctgtttcttcaagtgaaaaatggtgataataaaatggtgataatacctacttagggaggttattttggggattgaacacattaatatttattaaatacttaaaagagtgcttagcgcatagcaatgtgtaagtaactgttagttattatcatccttcacagcagactccttttggtcgaaagtactgtaggacttccaggcttatacatacagtgtcatttgtacggtttcatttaatcaagccatcagtgtttgttgagcgcctactgttggcaggcactgtgttaattactgagcatgtaatgggcatagagtcactgttctcatggagtttaccactccatgatatacacagacatggattaattaattttataaattagtgtaaaattgtggccatgttcagtgacatggaggaaaagtacacaatgctatgagagtatacatgagtgtatggaatgttagactagtctagagggtcagctgttgaccttcctgtgatatatttgcaatatatggctgcataacacattaccccaaatttaatggcttaaaacaacaaacctttattatctcacagactctgtaggtcaggaatttgggagttgcttagctgggtagttctggcccagtgccccttatgaggttgcaatcaggctgttggacagggctgcagtcatctgaaggcttgaatgggactggatgatccacttttttgatggctcattcgcagggcttttggcaggaggcctcagtttcctgtcacacaggcctcaccataggatgtcttgatatcctcatgatgtggcagctgccatctaccaaaacaagtgatccaagaatatgagcaagaaagaagccataatttcttttaaacctaggcctcagaagtcaaacatgtcacttccaccttattctatttgttagaagtgagttactgagtccagtctacagtgaaggagaagacatttaggcttcactttataaagagaatgttgaagaatttgtggacatgatttaaactaccacctgaggagtaattctttttcctgagattggctagtatgagttttgaagatatcctagaccaagggttgacaaacttttctataaagggccagatcgtaactattttcagctttgcagggccatatgttctctgtcacaaccactcagttctgccattgcagcatgaaagcagccataaataatgtggaaatcaatgtgcatagcagcgttccaataaaactttatttaccagaagagatggtgggctggatttggtctgtgggctgtagtttgataacctctgtagacaaaagggaataaaagggtggagtattattccaaacagaaataacagtatgttttagaaagaagagaattattgcgcatttaagatacctaaaacacatttgattctccacgcctccatgtactgagaggtttattgaaacactgtttgtaatggaaaaaagagtaggaaacacttacttatagaattacttaatatcattgataaagtttgaaaacataaatattgttgggtaaaacccaaaatgcaaaaaagctttgtgcaatagacagctggtatttctgtaagttaaaaaatagcgtactgtattgttagctttatgttatttatgaggacatacatacataatgaaagcacaaaaacatgcatgaaaaagatagacaccaacttcaagatgatggttactctccgaaaggatagagatgggaacggttgtgggtcttcaacaatttctgtttctgttttagaaaaacttttaattgtggtaaaatacacatgatataaaatttactgtcttaaccacttttaaatgtacagttcaatagtgttaagcatatttacattgttgtacaaccaatctctaggactttttcatcttgcaaaactgaaactctgtacccattatacaactcctcatttctgcctatcaccacccctggcaagcaccatttcactttctatttcgataagtttgtctactctagatacctatcataagtgagatcatgcagtatttgtctggcttatttcacttaacataatgtccttgaggtctatccatgttgtagcaggcattaaaatttccgtccttttatggctgaataatattccattgtatgtttacatggcattttgtttatcattcattcatctatggacatttgggttgcttctacctttttgttattgggataatgcagctatgaacttgggtgtacaaatctaaagcagagttttgacaagatgaatgattggttaaatagcccactgtgcaaatatagtaacctgagggttttctctcctcctgttcttccacagcacatgctagttagactttcactcctgccatcccccaaactgctctagatgaggtcactaatgaccttgactaagtccagtggtcaattctctagcttcatcctattgatctctcagtagcaattgatgtgatggccacgctctcattatggacacagctgcttcacttgatctccaggaggccatgctcttcattctcttcctacttcactagctgtccttctcaggctcctttgctgcttgctcctgacttcctgacccctcactcttggagtacccctgtcctcaatactctgatctctcttctttctatgctcagtccctggttgattcatctaggttttaaatactgtctattcactgatcccaaagttgtcattgtagttcttacttctcccctcaaatctagactcatctatttaatcacctactcagcaccttcacttaaatgtctaatatcattacaaacttaacacatacaaaaccaaaactcttagttcccataactcccacctttccttcccaatcttccctgtcttggtggtccacttccatttttcctgttgttcaggctaagaggcttggagccatcttttgcttctctctttagtcctcaggcaatctatcaggaagccaagtccacctcatgttcaaaacatatctaaactcaactttttctccttgcctccactctgctaccatggtccaaggttctatcatgccttgcaagagttattccagttacctctaactagctctgatgggtctgtccttatcaccaccaccccgaaaccatgctgcaatacaacattgggagtaatcctttaagaaagtgcctcatgtcatggtttgcctttgctcagaccttccaatgtcttcccatttttctcagagtaaaatcaatgtcctcacgacaaactccaaatgtggagctcatcctctcattcccacccacccctgcacttctttggctttctacttaccccatccctcatgcaacttcagccacacacttagccttcactgttctctctgcctggaatatctacacagcttgttccctcgtttccgttagatgaagcttgtccagtcagtggtctatgggctgcatgccaccacgacggctttgaatgcagcccaacacaaattcataaattttcttaaaacattatgagtttttttgtgactttttttttttttttagctcatcaactttcattagtgttagtgtattttatgtgtggcccaagacaattcttcttctttcagtgtggcttaggaaagccaaaagattggacacccctgctttagatctttgcttaagcgtcaccttttcatgaagctttctctgactatcctattggaagttgtaattgatccatgcctccctagtatttcccattctacttctctgatttattttcctttataacatttataacgatgtggtttagtctccttttaaaattatcgtgccttttcctccactggaatctggaatttaaaaaaaaacaaacaactatgaaggctgggatattggtctgtttggttcactgctgtatttcttgtatcccctgtatcaaattattatttgaatatctgaacctcccatgttttaagactgacatgagttgatgtttgagattttagtgttcctttcctattgattcctccaattggtgttggtccataatagtggcaattttaaaacatggcttcaaattctttggcactccttcctttaggaagcaggcttgtgactgcttcaaaagagcatgacagaagtggtgctataggactttcaaggttaggtaataaaaggccatgtagttttcttgctcttgtgcaagaaactgacctagaattcatgaacataatacaatggtggtggtctgatgccattaagtttggggtggtttgttatacagtaatagatttacagaacaataatgggaaaaggccagataaatgtaataattacctttggaatgaaagttaagtttttacttgttgttattattatttggtctgttgaagaaagtatgtggtgtgtgaacattattctgacaggttcatcttggaagctagtgtccatccagattaacccactgactctagactctcattaacgccaagaagtatcattctgatgaaccacttgagatttcatgctcaaaattctaggctcttcatgtacttttatgttgatcagctgaaggagctagcaattttgcactagctaaagccaaccttgtcatgaaattacaggaaaatatataatgtggggtttgatgtcacagtgagatgttaaattttgtgatgccaccaattttcttcccttatttttttctgttgtttttaaaagtgagaataggtgggactagaaataccagctagaggtcctcatttcagtgtcagctgtttattaaaaatctggataatttcagagctggaagagcattagaaaccaattcataaagctcctgattctgctgatcagagaggggaagcagcatacccaaagtctcaggctgggactgcaggctcctgacttttggcttctagtacagtgctctttcctctcaataagtggttatcagcccaaagtctggctcaaaggtaaacttctggggtgctgatccaggctctgtgaaccagctgacatggtgcacaccattttgcttgcatgtgcttttgtgtccatttccagaaagaatccactcctcctgtttgatttttacagagatctgtgacgcagaaaaatttaagtaccattgcacttcatgatttaataacactgtcatgtgaaaactatcacagtaagttaaatcttatactcagtcatacctatatgagaggacatcaaatgctcctggggaaattcattagttgtttaggattagtgcataatgggtgcatcgctcagatggttaggggcagttggagcctccagcaaccaattcatcctactgtctgtttagaaaatttggcaagcaatcacacgttaaaatcactttggtgattcaaaagcaacaaacaatacaggactaataaggtattaatttgccttgtagccattgcagttcttaaagcagagagagctgagatctctgtagataaagcctgaaagctcataggcttaacttaatagaagtttatttttatttcatatcaccatgtgatgtaggtcttcagcagcctttcaaatgatgtttcagaagtgtgggctttttctatcttgaggctacaccatcttcttggatattgaagtccttcacttctagctagtagatagaaaaagagggagagttgaggactagttaggaagtttttatgaaagttgatcgcgttgctcatttctaaccacattccactggacagaaataagtcccatggccccacctaggtagtggttgtggggcctcctagcaacaactctattgtatggaagaggagcacaaaccttccttgggcaactggtcctctaccacagagtgagtattgtaataatctcaaatctcaaagataggtgaagtgtttgagatgggattttcagacagtccatgttgtctggatatagattacaattttcatttacctgacaccttaggaatcaagatgagcctcagaatctatgaagtcaggattgaaaaatattgtaattaagaaaattacaattcttgggtaattggagattttattttatttttaaaggagtgacacagagggtaagggcccaatcaggatttttagctggtttgtattataatataatttgtataattatagcaaagagaactctgtttccattattgaataactgttgctacaagtttagcttttttattgcatgtttacccttgacaatgttttcgtgtttggcagaaattacaacagcacctgcctttacctatggtttttattttcactgtgttgcttggttgcttcttcattatttttccttgttttatacaagcttaacctctctcctcaagttataatttttattctggaactaggattggttatggtatgaaattattatgaattgcattcctggcttttaataagatgattttgatgccacctggtatcagaatgggtgatctatgaaatgaatttcttctaacacttactaagagaaactctgacaagtgacttactttctgttttcttgtccatgagtttttattggtacagtgaactccagcaatcttggaagtaatgttgaggaccaagtagattttttctttgtggaatttgaaatctcatgggatccacccaatgctgtgttggcactggattgtagtgacctatgaaagctggaaaaaaaccatcacattgactccaaattgattggaaacttcttctaataactaatgttacaaattaaatgtacaaactcacaattaaataaattatattaaaaactcataatttcctaatttcttattacactttactattatctaagatcttgaggttgttacatttattgtgtctgtgtggtagaaaataccatacaatgggggtgctattgtgtctcccttcccaattctgcattcagggatgccacttgggtaacttgatattggccatgggggtgcaggttttttaatttccagcagcctactgtactcaccacacataacatcttcttcatttggtagtgctgaggcttgaatgagacaagcagcgctagggacatcacagatgctcaataaaggacagctgcctttagggtccttccttcagaaaatctctgccatttccagagagtccaaaaatggtagtgttgccagatgattgcagtccagtgcctctagagggacacaggatctctttctgtttctgtattcataaatgtttggtaatggttgacttcatcccttcccagggatatgttaggggaaaaaatatcctgactgatgtgagagcattttgaatagttaggaagtatagttctcaaattggaggttgagaaagagctttgtacagggttgctgatttgtgccagtgatgagttggagaagaaaatattcttttcagattcctggtccagagctgtagcattaactcccccacactggtccttggacatgtgccctatggtccacctgtaagatttcttgggccactggcaaatataataagaacagcataataggatgtgggcaaaagattgcctgcttatcttatcctggataggactatcttttattgtgtgtcttgagtgttctgacagcttttacattaacatgtcctatctttttttttttttttttagacagagtctcgttccatcaccaggctggggtgcagtggcgtgatctcggctcactgcaatctctgtttccctggttcaagggattctcctgcctcagcctcccaagtagctgggattacaggcacacgccactatgcccagctgatttttgtatttttagtagagacagggtttcaccgtgttggccaggatggtctcaatcttctgacctcatgatccacccacctcggcctcccaaagtgttggtattacaggcgtgagccaccacacctgatcccatgtcctatctttttgaagtgacagtgatagtagatgataatggtggaggtagagttaattttaaatgcctttacttgcagaaagctagaaatgatattgatcctcttttttaactccttttttaaaaaaagtaaatgtttgtgatccagtggttctgaaagtctagaactaccccatgttgactctaaattgatttttgtggaagcagaagtaagtactgatagaattattccataggtgacctgaatcaccagcatgggtatgtgtgagcacttttgattactcctgccattgctcactctcctaaaactgttgatagttaagaaaatccaagtgtgatctgaacacacattgtccttatctcttctcttctgctaagacaacttttcaaagtctcaacagaactgttcttttgaggagaagcatataaaaagtgaccttcaagataaaagttgtaattatgttgtttgctttttacctaaagaaatgttcatcatcgttccaggggtttttgggtccacatctggctttaacaatttttttctcccctgtaacactgttgatactaatgccaattttaatttcttggcatcatgatacataaatatatcacccacagatgtgattttaaacaaggactgaaactgtaaattcggaagcaagagattcacagggtttcatcagatcactctcaaaagtgacacagttgtactgaaatggttttaaactgctcatttcaaacctgcctcggtagcaaaatgccatgcgtgcagcggatttgcaaccacgttagtcattttctttcctctgtttccttgctgtgtttgtattgggagcacagagtaatgtaatttagtaaattatgatttgatggctgggcatcagccccagtgttgaacagtatttggactatgattacttgctggctttgtcacagttgacattaattattgatggaagtttcagaaatagcgcatgtgccaggagcttttcaccggaacgcaggctccaggcaggagggatgctaaagagtgtgggggaagagacacctgtggcttgtttatgtctgtgcaaggggaaccaggacccagcaggctgtgtagtacctgtgtaaaggttgtggtgtaacggaaggatgaaccgtcaggcttatttctatcgtgttcctccccaggaattgcaccgaagaagccaacttcagccggagccagccaagacgaaggctctccagactgtcatcgaaatgaaggtaggaactgtgcacttttgtcagaaacagttatgccttgggagtttgttctaacttggtggtgcctaatataaacatgaaatgaaccttgtgtttttctctaggcaccctgctggatgctttacttctggattttttttaccttcctgggcacatttaatgtattggtcctttaattaggatgccttttctgggcaaaagaataaagggctcgagaatccattggctgaaaggagctgggttccttttcaaagcatgtctaatcctagggaggttttatgtgtgttttaaaagtaaaatttttaaactacaataattcttttcctcctattcacatcacaataaaaagcacctttgagaaattaagagttggcaaagggaagttattttacatgcagtggtattgttaataattaaaataatgctatcagcaaaatttacttttcaaaaaatgatactttctggtgaccccagtattttctcctaaccaagtttggaagtaataacactttactaagtacttgcaaagtatcctatttagctgtgcaggcatagagatacactatttaaaggaatagaaaaatccttctgagagaatttagggcgtttaaggaatcatgaagtaaatgagcatgaccaagccatgatccatgattaagaaactggtctaaatgaaactccatttctttgctagtatctagaaatttaaaatctttttatttacagtttttgccagaaggatgcaaatagtaaagtatttatctcaataataaataattcttgatttaatgtgttccattaagaaacaagtttataatcaagatgtttgcaatctgaaaattccacgctcaagtgtaaaactcagggagtttgctggtcaccgtgggcctgcaagagaattctaaagcttgctgataggataatgcatcttctcaatccttcttgcagcatatgattttgaattatctgcccccaaattcccaaattttgagggaaaagaaactaatacgagctcttgaattcttggcatgtgcaatctgagtagggattgtttttcttattcaatgacaatttcttaatccaagtggatttttgtgaaaataatataggtcatttgctttaaaactatgtgtcccccaaatgaggttacatgagtcaaggcactcataatgtatgtgtagcatatgggtttgaaaaatatctttgaagggaccaaatgccaataggattaaacaataattattaaccctggctcatcagttgttttaaacttatataatttaaacattttgaaaagaaactgaacattctacactggggaatggtaggccagtggttcataattcagagtttatcctcacttcacattggaatcaaacctgatacttggttaaggctttaaaaaaaaaaaaagaggaaaaatgaaaagacaaaaggacaaaagacttgtttttttttttgttttttgtttttgcaaagggtgactcagtcccccttccatccacctccacacccaccttcccagtcagcacaaatagtaatggagaagagaatgtatatacaatctatttccaaattatcatttaagaaaaaaaaaaaaaagagcgagtttccaaggcctttggaaaaaacaggagaaacatctcttctaatgtggtgggtagtttcctggtaaatgtctccatacaaagataattggtacctttttttgtgactttttaaagtagaaaaatctgtttgatcctagtttgttgtttttagcattatgttttattataaaaaaatttataaataaaaaactcacttaggtcatctacatgggaaggcagagaaacttgaattctagggcaaattcatttctacttattatcactaaattgagcctagagttctcctttcatggatgccagtgttgctaatttgtaggcatgaggcatttgtatttttaggacaaatgaagagcaatataattttcaggaaacggaaacggatcctcaagtttttctgttgtctttttggatgcctattaacttacaaaagcactgccttctgtcttgtcaacagagaagtctgggtcccattaacatctatcctcaacatacctaaattgagttagggaggcagctggtggagggtcatcccagccatgtgtatagctcaggctggaggctgtgatctcatctgattttgtacattacacccctgtgaaattggtgggaatattggaagctcatattgtacaggctttagagttgactaccaaatcgaactgacccttaagcctagtgagtggaacttgagaccctgttgtattttagccctgggtaaacatcaatgtcatctagtgccttgatagaatttaaaattaagaagagatttcttggccaggtgcattggctcaagcctgtaatcccagccctttgggaggccgaggcaggcggatcatgaggtcaggagatgagaccatcctgactaacacggtgaaaccccgtctctactaaaaaatacaaaaaattagctgggcgtggtggcacgcgcctgtagtcccagctactcgggaggctgaggcaggacaatggggtgaacccaggaggcggagcttgcagtgagtcgagatcgtgccaccacactctagcctggaggacagagcgagactctgtctcagaaaaaaaaaaaaaaaaattagccaggtgtggtggcgggcagctgtaatcccagctactcaggaggcagaggcaggagaatcacttgaaccctgggcgtggaggttgcagtgagccaagatctcgccactgcactccagcctgggtgacatagtgagacactacctcaaaaaaaaaaaaaaaaaaaaaaaaaaaaacagaagagatttcttagactaaattggactcagagattatccctatttgtttcttgctttttagaggaactaagggtgagcttcaacccccattgtccccatatacacactttgcataaactcgcaaaagacatttgttgtgaaagtctgtgaaatcttgcctaaattcaagcactatttagatccacagtctggttctagatttttgtgtaccccctctggactttggagttgtgaaaatatgtttttctggggtgaaccttgggaaatatcatctgcctgcatcaaactgggggcagttcttttgcagacattacatccactgcagccagttgagcctgggggctgaagttacctaatgaaaaatgaaaggaagcaaagtgaataaagttatttgtgatttatcttcttgcaggaagcttcaagttttaattttgatcctgatttggtctggcaggtatgttccaagtttgcacttagaacactgtgtgtgtttcttggaaaattagtttcttgtagatattgcagtgctcctctttctcttgcttttgtgtctaaagattctttgctaagctcctcttttctgctcttgtggataactgtcaataagaatgacagttgaaaggcttgttttctcttttttctttctttaatgctaatttctttgaaagaatgtgtaacttatttttattataaatttgacatgacataaacatgatgtccaaaagttttactttcttgggtcattcataaagccatttgtttttttttttttttaagaaaatgaatgacagtaatggtagttcttgtcaaataatctcaaccccctttttcattgttagctagaaattttaagtgaaggaaaatctatttcaaagtggctgaagtcaaaaggaaatttattggaaaaaaatttactggaaaaaaacaggggtattgcttcaggcacagcttgatccagaggctcaaaagatattagcagatcccattttctctcattccatcccttatcttgtcttccttcatgtgagctctattttcaggcaacctctccctgcctgtgagcaaatggctacagcaactccaactatcacaaatggaagggcagggagaatgttgtgttttttaaaaaatgtaaaaacacaacccttagagtaataataattactgagatgacacataaagcttcactccaaacttagcagctgaagctgaaaagaaaatacatagagttttctagagttcatttgcttaaaacattaaatgatattctttgggaaaaacaaacattttgctagtatagcagaaactatcaggttttcagcagaatttatcaaagaagacatatatgagtgacataagggttttagtaaaagtttggtgaacttgttaactagtaaaaggtttttagtaagggttttagtaaaagtttggtgatttggtgaacttgttaactaaagtggattaagaagccagaggcataatgtgaagttaaaagcagtatttctgtggtaattgaagtggggattgtgggtatttagctttccagtcccacggtcagcgagggcacttgtgtgccttgagttgttcctcttgagtgacatttgtccccaccaggctttttttttaattggaaataagtagtaagcaaagcaagactgagctccactaagttgctgaagtataagtggtactattggtgaaagtatatgattttgcattcaggtgcaactttaatgcagaggttaattttttgttataaaaataagacttcactttgtctttgtgcccaggcagataactgttgttctgcatggagctgacctgcagctgggttaagtttcacttaaaaggtatcttggtatttggtcaaatttagcctgtttagttccacagaatatgaaagggatgtactggaacactgtgaagtcaagaactactacttcgcaactttaccaagtttcatataactggaaaggggagagagttcaaaggcaaacctagactactcagcacaacccaatacccattatgaacttgtctgagtcctggaatctggtcagagacactatgaagtagctgccacttctttgactgtagggcctacctaggtttatttcattcatcttctccaaggatgctgtgttcatatgaaatttgtgccaatcccagtttttctagtaaagcaattatgatgatggcttttaggccttaagaatatgcccctgctccttttgtggctattaaaaacaataacagcactaacaacaacgatgtcacctgcacccccagtaatacccaatgacagcaacatcactaccacacataagggctacagcacttgatgtgcaataaacctgtgaataggcagagttatccccaattcacagatgagaaagctacgggttagagaggataagcaacctgcccatggtcctgcagctagtcagattggcagctgagatttgaacataagtttctcctcaaagctcttgcactctttactccttctttctgccttttctaaagatagcccaaaggttcaaacgttttttctttcaacatttactttggaaattgtgcattgaggtttgcatcctagaatgggtagaggcagctcatgagagatggagtggcttatgtgatatttttggaaaggtgcagagctgtattttgtgctaaaaggcaaaactcatcctttttacatgcatgtgttatcatggctccaaatagggctccaaatatgtacattacagccaacatatgccctgtttctccccctgcattttaagtcttgctctgaagtctttttttaacagcctggtgtgataacttgttcaaacttgtaaaggactgtgtgttttgatgtgcagtgtgcatttacaatattagaattatcctttagcttacttttttttcttgggaaatttctctatcttctcattttccaactggaccccccaatataaagcaacaacaaacccctttatcccatttaactatttgccttaaataatgggcaaaatgtgatttttaagtgatggtcaagtcaaatgttagttctagatgatatatggttgtcacttagaagcaagtaagatttttttttagaagatgagaattatttccctttccccccaaactcttcttatgatatatttgactctacatgtttgactaaatgttgccagtcaataattcctgctattacccaggttagtttttgtgaatctaactcctgaagttgcataataaacaccagtgtttactgagcaactattttgtgtacagcaccatgatgaggctttcaggaaaaactgagttctaagtctttaaggagctaatggaatgaagtacataaaccaggttataaagtgacttaagaagggcaaatgagctatgaggagtcaaaggatatcaaataagagaagaagacagaatgctttttggagaaggtagcatttggagaaagccttggaaaactggcatgattttggtaaaggggaatatggtttataaacagtgggaactataagagccacgagtctagaaaggataaggagtgtctttggcagagcaaatcattcagtttgattgagagaagacattgtaaatttaaaaggtgtggtagatcgcattaaaccagtagaaaaagaaggtggagagaaagaaataataaacataaaagctaacattaaataaatagagggtaaacatatactagagtggagcaccaaaactaaatgctgtttttttgaagagattcacaaaaatgacaaatcctggttagaatcagcaagaagagtagagacagcaaaaataaccaatatcagggatgaaagtggggcatcactataaaccttattaacattaaaatatgagaggattttattagcaactttgtgataataaagttgaaattttagataaatgaaaaaattctttttaaaaacacaatttgtcaaaacttgcttaagaagaaatagaatatctgagtagtcttatatgttaaaggaaatgattctataaattaaaatcttaccaccaaaccaaaaacctaaaaacccaaaccaaacagaaacaattagaggcccagatggcttttttgagtgaattgtaccaaatgtttgaagaggaaatgaaatcaatcatacagaaactcttctagaatagaaaaagagggagcatttcccatcttgttttatgaggccagcatatgtttgatattcatacccagcaaatatattacaaaaaaggaaaattacaagcaatctcctgagtaaacactgatggtagaaaatatcctagtgaattgaactcaatgacaaataaatgacatgaccaagttgtgtttattttaggaatgcaaagttggactgatatttggctatcaatcatgttatccaccatattaagaggataaaggagaaaatgaatataattcataggtacagaaaaagcatttgattaatgcaacatccatccatggcccccaaaaatgtttttcagaaactcagaagtagaggattttcttaatctaataagaatagttacaagaaagctatagctaatatcatgttcaatggtaaaatgttgaaagctttctctatgatataaggaataagacaagaatgccagttaccatcacttctgttcgataatgctatggacatcctaggtataaaaattagaaagaaaaaaaaaacatttttgttcacaagtaccataatcgagtctgtagaaaatatcagtgaatccatatatacaatattagattagtaaataaatttagccaaatggctggccagtattttaaaatgaatcttatttgtacatactagttataaacaattaagatatgaaattgagaaaacaatatcacttacactggtattaaaaaaccccaaatatataagagcaagtctaacaatagctataaaagacctaatttaaataaaaaggtataacacataactaaatgtagaataactaaaaactttaaacaagtgaaacagctgtcagcagtagggtggataaaacagtagtggaatattcatacaatgaaatgctatatggcaatgagaaggaccaagctattgccatatgcaggggggaggggggagggatagcattaggagatatacctaatgctagatgacgagttaataggtgcagcacaccagcatggcacatgtatacatatgtaactaacgtgtacactgtgcacatgtaccctaaaacttaaagtataataataaaaaaaaagctattgccatatgcaatagcgtaaatgaatactatccccaaaataatgttggaagaagccagccacaaaagaacatatataatatatgttctccaaacaagctaaactaattgatagtattagatatctgtatagtagttaatttgaagaagaggagggaaaagtgaaggttgggagggccaggaaggaggtttctgaagtacaggtaatattctatttctattatgttctgttttgtgatctggttggcccaagtgtgttcacttgaccacaattcatcattttgaaagtctatgatttgtgtactttcttatattaatactttaattaaaacgtttctttaaaaataaagaaaaaataattcatcaataaaaagataactgaattacaaaactgggcaaaagatttaattagacatttctccaaagaagacatacaaatggccaataaggacataaaaaatactgaacatcattcgtcattagggaaatgccaatcaaaaccagcattaaatacaacttctcccacactaggatggctaaaataagaaagacagacaataatgagcgttggggaggatgtgaataattagaattctcatatgttgatggtgggaacataaaatggtacagccctctttggaaaactgttagcagttcctcaaaatgttaaacatagagttaccacatgacctagaaatttcacttgtaggtacacacccaacagaattgcaaacatatgtccgcacaaaacactatccacaagtgttcacgctaccattatttataatagcaaaagctaaaacaacccaaatgtctatcatctgatatatgaagaaacaaaatatggcatatccacatagtagaatattattcatcaacaaaaagtaataaattactgatataggctacaacatggatgaaccttgaaaacattatgctaaatggaagaagtcagtcagaaaaggccacatattatatgatactattaattaaatgtccagtgtaggcaaattagggacagaaagtagattagtgattgccaggagctagggggaaggaggaaagaagagttactgctaatgtgtactggattttgggtgatgaaaatgttctggaattaaatagcagtgatggttgcagaaacctctaaattatactctttaaaagggtgaattttatggtgtgtgtattatagctcatgaaagctgttattaaaaataaagaaaaatattataaaggaaatgattaataactttgcttacttaaggcttacaagagattcttaagggcattctaaatatggatacaaaagaatgatacctgctgccacaaaaacacacttagtacttagcccatagaccctataaaggaaccacacaatcaaaactacaaagcaaccagctagcaacttcattataggatcaaaacctcaaatatcaatattaatcttgaatgtaaatagtctaaatgccccacttaaaaggcacagagtgaaaagttggatcaaaagacaagatttatctgtctgctgtcttcaagagacccacatcacatgtaacaacacacataggctccaagtagagttggagaaagatccactgtgcaaataaaaagcaaacaaacaaaaaaggagcaggggtcactattcttatgttggataaaacagacttttaaaaccaacaacagttaaaaaggacaaagaaaggcattacataatgataaaggataaagacttttctaacctaaaaatgtatgtacccaacactggagcactcagagtcaaaaatatgaatttgtaagacttacgaaaagacttcgacagcaacacacaataatagtgggagacttcaaaaccccactgtgagcattagacagatcatcgagacagaaaactaacaaagaaattctggacttaaacacaacacttgaccaattggacctaatagacatctacagaatattccactcatcaaccacagaatatatgttcttcccacctgcacgtggaacatactccaagatcaaccacatgctcggccataaggtgagtctcaataaattcagaaaaattgaaatcatagtaaccatactcttggatcactgtggaataaaaatagaaatcaataccaagaagatctctcaaaagcacataattacatggaaattaaacaatttgctcctgcatgacttttgagtaaacagtgaaattaaggcagaactataaaaattatttgaactacatgaaaacagagacacaagataccaaaagctctgggacagagcaaaagcagtgttaagaggaaagtttgtagtgctaagtgcctatctcaaaaagttagaaggatctcaaattaacaatctaacatcacacctagaaaaactagaaaaacaagagcaaacttaccccaaagctagcagagaaaagaaataaaaaaaacagagcagaactgaacacaattgagacccaaaaatgcatacaaagaatcaatgaaactaaaaattggttctttgaacagacagattgatagaccattagctagattaacaaagaaaaaaagatccaaataaattcaatcagaaatgacaaaggtgacaatacaacttatcccacagaattacagaagatcctcagagactattatgaacacttaaatgcacacaaactagaaaatctagaggaactgggtaaattcgtggaaacacacactctcccaagattcaatgaggaagacttagaaacacggaaaagacgaatattgagttctaaaattgaataagtaacaaaaaacctaccaaccaaaaaaagccttgaactggatgggttcacagttgaattctttcaaacatacaaagaagagctggtactagttttactggaactatagcaaaaaggcaaggaacacggactcctccctaactcattctacaacgtcagtatcaccctgataccaaaacctggcaaagacacaagaaaagaaaactacagggcagtatccctgatgaatgtagatgcaaaaatcctcaacaaaatactatcaagccaaattcaacaacatcaaacaattaactcaccacaatcaagtaggcttcatttttagaatgcaaagttggttcaatatatgcaaatcaataaatgtgttcaacacataaacagaattaaaaacaaaaaccatatgataatctcaatagatgtggaaaaagcttttgataaaatccaacatcccttcatgataaaaaccctcaagaaattaggcattgaagcaacatacctcaaaataataagagccatctatgacaaacccatggccaacatcacattgaatgggcaaaaagtggacacattccccttgagaactgaaacaagacaaggatgctcactctcattactcgtattcaacatagtactggaagtgctagccagagcaattaggcaagagaaagaaataaaaggcaactaaacaggaaaagaagtcaagctatatctcttcactgacggtatgattctatacctagaaaaccctaacgactgccaaaagacttctgaaaccttcagtaaagtttcaggatacaaaatcaatgtaataaaatcagtaacatttctatacaccaatagtgttcaagctgagagcaaaatcaagaatgcagtctcatttataatagccacacacacacacaaaatacctaggaatacatctaaccaaggaggtgaaagatctctatgagaagaactgcaaaacactgctcaaagaaatcacagatgacataaacaaatggaaaaaacattccatgctcatagagtggacaaatcattattaaaatggccatactgcctaaagcaatttgcagattcaatgctattcctatcaaactaccaatgtcagttttctcagaactagaaaaaacttttctaaacttcatatggaaccaaaaaagaacttgaatagccaaagcaattgtaataggctgtcctcacattgctataaagtaatacctgaggctgggtattccataaagaaaagaagtttaattggctcatggtttggcaggctgtacaagcatggcaacaacaactgctcagcttcttgtgagggcctcaggaagcttacagtcacagcagaaggcaaagcaggagcaggtacatcacatgaaaagctggagcaagaactgggaggagggccccgactctttttcaacaaccagatctcatgtgagctaactgagcaagaattcacttagcagcaaggggatggtgttaaaccattcatgaaggatccattcccatgatccaattaccgcccaccaggccccacctccaacattgggaatcgtatttcaacataagatttggagcaaacatccaaaccatataagcaatcctaagcaaaaagaacaagcctggaggcatcatattacccgatgtcaaactatgctataaggctacaataaacaaaacagcatagtattggtataaaaacagacacatagaccagtggaatagaatagagaacccagaaataaatacacacatctattgccatctgatctttgaaaaattgacaaaggtaaataatggggaaacaacttcctatttaataaatggtgctgggataactggctagccatatgcagaagaatgaaactagacacttacatttcactatatgtataaagcttaattcaagatggattaaatatttaaatgtaagacctcaaactctaagaatcccagaagaaaatctaggaaacaccatgctggacattggccttgtgaaaggatttatgactaagtcctcagaatcaattgcaacaaaaccaaaaattgacaagtgggacctaattaaactacagttcttctgcttagctgaagaaactattaacagaggaaacaaacaatctacagaatgggagaaaatatttgcaaactgcacatccagcaaagatctaatatccagaatctatcaggaacttaaacattgaacaagcagaaaaacaaataactccatgaaaaattaggcaaaagacatgaacagacacttctcgaaagaagacatgcaagtgtccaacaaacataatcatcagagagaagcaaataaaaaccacagtgagaagccatcttacaccaatcaggatggctattattaaaaagtcaaagcacaacagatgctagtgaggttgtggagaaatggaaacgcttatacactgttggtggtaatacaaattaggtcagcctctgtggaaagcagtttggagatttctcaaagaatttaaaagataactactatttgacccagcaatcccattacccaaaggaatgtaaattgttttaccaaaaagacacatacacttaaatgttcatcgcaacagtattcaccatagcaaagacatgcaatcaacctaggtgcccattaatggtgtactagatgaagaacgcttagtatgtatacgccatgggatactatatacagccataaaaaagaatgaaaccatgtcctttgcagcaacatggatgcagctggaggccattatcctaagtgaattaacacattaacagaaaaccaaatactgcacgttctcacttataagtgggagttaaacatcaagtactcatggacataaagatggcaacaatagaaactggggactactagggaggaaggaggcaaggggacaaaggttgaataactattgagtactatgcttaatgcctgggttatgggatcatttataccccaaacctcagcatcttgcagtatacccgagtaacaaacctgtacatatactccctaaatctaaaataaaagttgataaaaagcgcaaaataaccaactatgaaatgtatttttaaagtttatagtagtttagaggtttagtattcttaatgtgtaaaaaggttatatttatcaatgtagaataacaacttcggggaaaatgtactaaaatgttgacatttgttctgggaagagagattataaaggatttttttcctcttctttcctcccatattattccattctcacatttctataatgaaataccaaagactggctaatttataaagaaaaaaggtttaattggctcacagttttgcaggctgtagaggaagcatgatgctggcatttgcttggcttctgaggaggcctcaggaaacttacaattatggtggaagttgaagagggaggagtcacagtcagatggccagagtaaaagcacaaaacaggtggggtgggggggtgccacacacttttaaatgactcgatctcatgagaattcactcactattgtgaggacagcatccagcatatggtgctaaaccattcatgagaaactgcctccatgatccagtcacctccttgcaggccccacctccaacattggggattacaattgaacatgagatttgggtggggacacggatccaaaccatatcactcccctaaattttcatgttttcaataatgtgcttttttctaaacatagaaatgatcaggaattattattttgaaaaaaaacaagtttgttaaaagaaaagccataatcagaaatcttgaaaatgccctattttttaaattcttggttttttttttgtttttctgaactgagaaggttccaaagaggagaaggttaggttatttatggaaattgagaattttgcttgctgcttactgcttctctatgcttcagctttcccatctgggaaatgggtccatgatactagcctgtacgggttgtggtggggattaaaatgagttaaggcatgggaaaatcctggcacataatagaggatcaaggaatcctttgcctctccatctcttccctttgagtttgaaaattgagttttatctgtaaaaaagaggttgtgcctttgagcaaggaccaccagagagaaggaactaaataagcctattttaggcagagagagtcttagctctgaatacacacatagtttgcatgttgaaaagactttaaaagtgtctttgaaaggagaaaacagtggagaaaaaatagcaagtctcaggaggtctatgggataataaatgacctaggaacttagctttctggctattgggcatttggcaagtcacttgtccccactggctctcactcttcttatctgacaaatgaagggattggactaactgtcctactttaaaaattctgccaagtctgaggcttgatgactggcaatttggactctcagggggccctcctggggagtctgaattgacatgacattcttgcaaagtttaaatcttagctttgtttgctccatcttggccagccctgcccaggccagcagtccctgccctctcccttgctggtgctcaggttcccagcctaccgtttatttagggattgcaatttccttactggcgtgtgcccctgccagcagggttgagaagtcaaccacaggcctcatgtgaacttcccctttcaggtttcagtaatgacagcataccaaccatcacatgcctcatccctgaggcatggtccagtttccacatccatcaggccacattggtgacttggggtggcctgaattccactgctgcctgttgcttttttttttttttccatgagacaaactggttgaatgtagaatgatctgtggtatgtttcggagattctaagaggagacaccaaacccaaccaggaagtgggttaaaaggaacgggaagagcaagttcagcttgctagaaggctaacaaggagagagagcttcctcactcaatcttttcctaaagaacactggaagagaaatggagtggtcagatgtccatctttttaggctccctaaaatgcattcactgtgttgcaaagtagtattccctgaattgctggcattctcaggatgggcagctggaattcaaaccctctttccatttagatgtacatgaaagatgacatgcaacccattgttgaggggatggccctgcacacatggagggactgcccactcatctggaagcagttgctgaaaattttttcctccctttcctctctccccagcctctttacttttttcttttgaccttgctcggtgatctttagaggctaaaattactgtggaagaaagaaccagaatagcatacattctctgaagccagtcccttctgaggttggcctgtggacagcaaggtcccaatatgtggcctcctgtcttctattcaaggcaggcctatctattgagggaacgattccagtttacccagggggaaaccttgggcaagttatttaccatctgtaagtcttctgacctgttaaatgggtaaaataaatccttaattcataggattatggggaatattaaatgagaatttcctagcacagtgcttgtgtaggtaatcaatacatagcagctattgtttttttgttgttgtttgttttcttacccccaagctgaggagcttacaaataaatatggatttttgtgttccccaatcctccaaaagagaatgtccttgggtgaaactaagtcatcagtagttttttgctcactctctagatgattttgatgcagttagtgttcaggttggcattagggaacctttgctttagtgtgtgttacaggcacatggaaatgatttttaatcagccagtgctcccttccatgcactagggatgtagaaagctcttgacattaactgaagcagttttctttgcagggccaatactcagatgagaggcacaggtacagctacattggttgctaaaatattgcaacacttctacagctaccccaaaccctcagagtaccctgcacccaactccaccccttacctaggggtccccaaattcagctactaaagagttaatccttggccctgcagtgacttcccagacctggttccagtgcttcaggaggtgtccgtcttgtggggatctgagtctgttccatactggttgttgagtgactcgggaatcactcctggctccatgggatttaaaacactggggttcagtttccaattatggcaacacaactccgatgaaactaccctcatgtcaccaatgccatcttaacttttttcttagtctttaggctcttcaaacctttgactcctcttccttcttaaaactattcactcattttctaggacttttccataatttccatgatttttgcccctctttcttttggtgattcttctacccttttctctatccttgattctcaactatgtctgagaattctttcaccactaagtgatggttttgtcgtctccacagttttcaaatttcatttcggcatctggttttattactaactgcccaaagactatcttgttgccttcttatttaccagtatatgactcgctttcagaacctagtacaaattcctagcttgattctgaagactgattatcattctgcagcaccttcctttcatttccaactcctcagcagctaaacatgatctatattatttgaacaattctgtattctactcttccttgatacatacatgctctgtattcattctgtttttctttaaacttacatttattaaatattatatcctgggcacatgctgagtgctcttgattttgtatgtattattacttctaactggaaagaatttcatcttctctgtgataatattatttttattcatctccaaaccccacgttaggctcctgtgccttctggagatttcttgactctgctatggcaatcttacccattcctgacttctctatatatagacttatagaacattacatattttggcattacctttcacgctatcacttgtgcattatattttttctgttataggtaacagaaaacttactctcatatttggtattctggagagtggatggttcaaatgtagctatatatagctgttcaaatgatgttataagggcccaatcattcagataggttctcaatacatgatatcaaagaaggccacatccagtcatgcggttattttcttttttttttttttttcattttccttactcagaaaataagagagagatcttttctcttctggattaatgttagtcccctaaaagaactctgattggccttcctagagttaaaagtttacccctgaatcaatcattgtgttcagaagacccatggtacctgtctctgggcagggccacacaatttaaaactctattaaaaccatggggatgttgcgaagatgcagttcccaaaaggaaaggaagctgggcagaccaaaaaagtaatagatatgtgcgatagctggaaacaagagggacgctaacatttattgagcactactgtgttttagctgttattctggaaacttccatgtagccactcatttaattcttgtagtaaacttaggttataggattagcaaggttaggaacatgctcagaaagtttaacaggatgaaataaaaatggaagctgtcttctaattgtgtaagtaacaactggggaattagtagggacttactacattgtttttggcttatgataataatgacaacttttcactctcttagggtaggctctgtgataggcactttgtatgcattatacctcacttgtaattttcttaacatactcaggagcatagtcttattgtaaaagcctgaactaggatttgcatccaggtttgtgactctgtaaaggtcagatgttttatcttcatgtgcggtctgtctggattgctttagatttagctctttttcttagagctgagtccattaacaacaagaacaaattaatatatggagatcataacttcaaagatcacacagtgtcaagcaagaaccactagagacacatctgctcatgagtccttagtaatatgcacagagacaggatgacaggaaggatgtgttccaagggcatgggtttcatgaagaatgagtcagaagcaggcaaataagaccaggaaaagaaacatcaaagcaccctagttgcttttcatttgatctagtccaaccttttctgtgcttgtacattttgccataaagaattagataccatctaattctcatgtcattttctaatctaggtcatcaccttttatagtttgacaaggcccaagaaggcgagtttttgatttttttggtattcgttctttttactaatatgtcttaggcctaagtcaacttctttctggagtgtctaacttgggctcatataaccacggtcatcccacacagtaaatccttcccaaggcagggccttactcaggtagcctaagatccagggctgctcagttgtgtttgcagctatgactagatgattttttaaagttaagctgttaagagcctctgtggtatccagtaataacagtttcaaattttattctaaataaagtgtaatataattatgtaggtatgtttcctgaacattagatcacatcttttaaaaaccatattggccctaagtttgttgatcaatgtccgtagaccaatatgtgatcacagtgaattcaatgctctgtaaaaactgcttatgtcttctttcttggcctgatattaaaatgaaaccagtaattctcacggtatttaaaaggaaagcacattgtgacactcagcaataatataattgttactttttgtgactaaatgatattgcttctttttgatgttccacccactcaccatttcagtattcacagttcctggagagggattgaaatctgtttcttgctgtttaaggggaacatactgtttgaaaacacaaaaagagtactaatggcatcctgactagcaaagatactccagaaaatttactcccagggttgctgtacacttaatgttaagttggatggctcttgaaactagattcatgtttttctaaatgtatttggaaaatagagttaccctagtgtcttctgcattggtcagtcttggcccttgtgtcttctggacatgtacagtcatttagaacacccgaatcacccgaggatcttgtgaaaatatggatttggattcaatagttctgagttggggcctgagattttgcaagtggaaaaagctcccaggtgatgtcagtgccgctgatctgtgaccacactttgagtagcatggatccaggctgtccttcatgttagagagggaaggatgcccatggatcttcttgagatctacctggtatcttactcacctggcaaagtgactggttcccaataggtgccctatgtatttgttgaattaatgaatgaatgagagaactccttgtctaagtttactattaatctatagcacacatgttctagagaaatctagagatagatttaaaaaaagagagagaaaaggaagaaataaacttatttcaatcttcccatcccactttcatcctcatttctataactatagccgtcatgggctagtgctagtatttaaggctggcttagacattagtgcggtgggcctagtgggtaaatggcttctggggttcaattccagtgttttatttattagttgcccatcaaatacctattttgcattttttgagatggtagatgtaaaatagtcttgggtatgaatctttaattagaagctatgatctgcaatttatgcatcaaatttttataagtattattttatgaatgtgtagaaagaaatgattgaaaagagacactcaattgagatcttttttcctaactgaagcaaacattgtttagatgtttattttttccctgaaaatttttttctacatctttacaatccataaccaaaatataatataaagacaaaacaatttcatggttgccctatctcgagactgtttgaaaactattgcctgagacgtgaggtgctaagttccaggagtatgggggtccatgtctgttctttcactgatgttgtcttaagtgctgggcttagaacaggagctcagtaaaccacttttgagtgacagaagctggcaggctgatctagatatttagcgccccccccccttcattttaaattggggatgattgtggcaagttttcccttgaagaatccaaattgttgttttgactcttcaatttagtaatattacccagagcttaatgtgatcattacaagcctaaattttttttcaggaattgacttctagaggcagtaatactgtgataaataaaattaaatagaatattttgcttcaggactttccagagccatttatgttaatgcgcattgaaaattcctaacaagcatttctcaaacatacttgaccctgcaatccccttttcatggagcatttgggttctgtgaactttgggaaaagctactctacattatatttcactttccccgtctctaaggaaggcccacgattatctgcttccagagcttgtttatttgtgaaatataatcaagatatgtgtttgaaaatcactacatatattgttttaaaatatcagtcataaataacttgtaaaaatgttcagatgaagaaagctctttggcgattagggcgtaaaatgttgctttactttctgaaactccacttttctggaagttacaacatatgtcttcatatatgtattttttttctctattccagattagcgcgtcgagtttctgagccatgtgcatttagcatctcaacatccgtatgtcacattcagccacatcaggacttgatatggacttccatagtactccttacatagattaggttttagtcatgtatcttagtgttagcgatttttaaaaaagaaaatgataaaattccttccctctaaattctttggactgatgcagttgaaaagcggtagacatgccagccattttacttgctttttattttcatgcttatattccctctgtccttctctggtttggcgttttgaatatcttcttgggcacaacccaaaaccatctgatatatctgtattttttgtgtcagttttcctttgaatcctaatgatattctcctacctacttttccctgtgctcatgatgtgagatatgagctcttttgcccttgaaactgacttgttatataagaacagaaatattggctgggcacaatggttcacacttttaatcccaacactttgggaggctgaggtgggtggatcacttgaggtcaggagttcgagagtagcctggccaacatggtgaaaccccgtcactactaaaaatacaagaattagttgtacttggtggcgcaggctggtaatcccagctactcgggaggctgaggcatgaaaattgcttgaacctatgtttgtgagcttgtctgacttagcaaagtactatagactgggtgacttcaataatggagatttgtttttctcacagttctggaggctagaaggccgagattagggtgccagcatgataaggttctggtgagggctctcttcctggcttatagatagctgccttctccccatgtcctttcttggtagagagagcgagagtgagcagcttcctggtgtctcttcttataagggctctaatcccattctgagggccctactctcctagcctcatctaatcctaattacccaccaaaggccccatctccaaataccatcacattgagggttagagcttcaacatatatatttctggggaactcaacattcagtccataacacttttcagaatttaaactggtagtatacaatatttccagaaatggcatctaaatagaaaaatactggcagaatatacatgaaaacattaatggtggttatttctagacagtaggattagaggttttctccattttctatgaattcaaagtatattgcttttataactgaaaaaatacaataggtattatttttaaaggaaaatgaaatactacagaatgttccatttcctaataatcttggaattttcaaaatctttttatttcatcttcttgaagtttttctgagaattaataaaagtatctacagaacttagagcactcagttcttggtacataatagagttgcataaatttactgctccttcttttcctccttttaacatgatgacaatgttaatgataataacaatgataattactatattgccataggagatataccactgggcatagattataggaaaataaagtagacaatagccacaaaatcaggacagacacatttgttgcaaggtttttaaaaatgagttacttataaatagaatagcctattcattgtctttacttttggagttcttagtctttttgattctgagaaaatgaattggttaaaaaagttgatagattgttctgtattagcattcagttatacatttaatatgagctccttaactctgtgcagtaaaatggcaggcagatgggacactgagaaaacttgaagtcagttttcgatgtgtcaaactttcatttcaaagaccgattgaagcctaatacttactgttgtggaaaaatttttcgtcattttttttgttttgttttggttaccctataagagctctctcttctctactttctaatgcattgtttctaatgctctaccttgtgtatagagtctgtcattggtaattttttcccaattaattccacatctgagtgtaatatttctagttgttggctccataaatcaataggttgaactgccctgcaaggtagtcatgttttttgttacgtagggacctgactgctcgccaaataaattatgacattgtgatgtattatttccaatcactataaattttcaatatttagtgtatcagtcataccaagtcaagattcagttatttagtttcacttacgtctgtattttagatgagaatcctttttcccattagtagatttgaatttctttctctctcagagtcaaattccaaacatgccttataaaaccagccataaaatatacacataaactgtttttgtgtttataagtagattcaaaaatatacacaggtaaactatatcccagattaaaatctgtccacttaaatggtgttctgttttgttttttaacacttagattacttttatcactgttgctttggtaatttgattcccagatattagataaacatatctagataattctctgtattgtattgacacatggtcttgattgggagcttaaactatcatctcacaaatgaccctcagctgtgaaaaaaaataagttgtcctaaattcagggctgtctataccatggttaatatgtgacagcactaccaaaattactttcttaaattctgttttgatgatcttaaaaataatttttattctttatttttctttttcttttcttctttaccaacaggacacaaaaatcgcttcattggaacgaaacataagggatcttgaggatgagatccagatgttaaaagccaatggtgtgctgaacactgaggaccgcgaagaagagatcaaacaaattgaggtttacaaaagtcactccaagtttatgaagaccaaggtacggtccagggttataaacttttatgttcttaatgtgactagaaagttacagtttacatacatactttttccaaatactccatataatatgctttatgtgatattatttaatatatggacaacaaagtagaatgcggaagatttttagttcagacatatagattccaaaaaacaatcagggaaaacctttgatggaattttccttactgagaggttcaggctttaattaggagttcctttggtattcctcttccttgggaattaacatatttatagtccactctcttccaaatttccaccatcatgtaagtttgctattttttttgaagttgctatcgttgtcaaatttcttgcctctcctagaaggtgattgtctcaaaatatttgtgattacaagccagtttaactcatttaaatgttattaggttgggaggctgaggcaggcagatcagctgaggtcaggagttcgagaccggcctggctaacgtggtgaaaccctgtctctacaaaaaagcacaaaaattagccaggcatggtgacatgcacctgtaatcccagctactcaggaggctgaggcaggagaatcacttgaacctgggaggtagaggttgcagtgagccaagatggtaccactgcactccagcctgggtgacagagcaagactacatctcaaaaaaaaaaagttattaagctattttggttttagcatagtgtttaagacataaatagttttgagtcccaatgctgctctttagttaaattattcaacttccctaagcctcagtttctttatccgtgaaatagggataagaaaaatacctacgtcattgggttggtctgatgattccaggagattattcatttaaagcccttagtcccttgtctgattaagtatccattgaatggcaggcattgttgttgacagtggtattcatgttattattgttatctattgctaggaatctttataaaatattctagagtaacctgctctattagtttatattgttattgtcagttttaaagattttggattgtattttttcaaaaataaatttgtggctttaaatggaccaagcacctgaatatttattatttttacatatgcataattattaaatttacgaatagcccaaataggtcttttgagactgtgagatgcttttatctgttcctctgtttaaatcattttgcttctgaaaataataagtacaccaattaaaaaaatttgttttcttttttctttttctaccacttgctcttaaatatgcctgttctcttgttctaggttttaattttgtttgttgctttatgaaatgcagcagagttagagtaatgcagacctctgtgagaaagcagtgggagaggagagaaaaatgtgtaaatgatttttatcagttgtgaaatatgtgcatactccttgctgagtttgcaaattatagggaggaaattatatttatccagtgtttacttcatcacaacgtgtgtgcgtgtgtgtgtgtgtatgcaagcatgtatacacaaggaaaaaacacaaaactattcatacttctgtcaactttccatctctaactagatgttgagattgtgctgaaaacgtggatcaaggagtggagatatgaggggactgtccagtggatttgaatgtaaccagggactgcctcaaagtttagaataagtttccctgcgcagtccttcctctggtttctttcttgcagtccctccctctcagagagttaagccgaggttcggcaagcacagtactagggtgacctgcagacagtgcccaaatcattctgaaaatgaagaccagaggcacagatatgagtgaactcaagaagtttgggggaaattattgttttggcttaaacttttccctcgactctgttattccacaatgggagattgttcaagccacttctacagctgaaaatgtcatgaaatttgtaaactctgcccctcatcatggactctgtccaggtgaataaaacatttatatgatcttcagcaagtcatgacctttattagcccacgtttgtctgagagaccatcaatccttgagttagatttaacttttaatggctagttacttttaatggttccagaagtggtcaggtcagaagaatgtttgaggaaagtagtggagtgaggtggaaagagtgcaggctgaagatgaaagcagactccagcaagtctccagcctgcctttgccagctgtatagggagtgacttgaggagtgaccaaagtcacttgaccacacattcttctataaaataggggcgacagcaccaaccttacaggatggttcagatggactaaataagattaaaatgcaatagtgtagttaaagtacctggctcaaaaatctagcttataatgataaacattattattgaagaggtataaccaaataataatcataacaataagtgctatatttaacttgactaatgagaaaaatggatttctaagaaatacaaataagatgaattcttatgtcatgcagacacctcttttattgttaaaaattagctaaaaagtactagtaagggtcagtttttaatattttctccattgaaagaatgttcttattggattgaactataacatttgttgctaatgtttcctatcattaattacttacgtttcttaattcccctacttggttttttttgttcgtttgttttgaggcagggtctcactctgtcacccaggctggggtgcagtggtgcgatctcggctcactgcagcctctacctcccaggttcaaccaattctcccacccagcctcctgagtagctgggattacaggtgcacaccaccatgccagctattttttgtatttttttggtagagatggggtttcaccatgttggtcaggctggtctcaaactcctgatctcaagtgatctgcctgcctcagcctcccaaagtgctgggattacagatgtgagccaccacacccagcccaattctactttgagtgatgagtgtgattcctcatttaagcctgggaatactgcttgcattactattaaaatgaataaatcatgtagattggagggaaagaaaatattttaaataggcacatggaagggtgtgcacttccattttgatccagagcaggtagttggaattggtagggtctcttgaaagttctttgattaaattaagtgtcagtgaatgcctgaattgcttttacaaacatgacatcatagaaaaaccatgatataacatttttggaaaggtagaagatgggttgcaaaactcagcttgtgcaaaggcaggaatacaaaacatagtcagccagggtagaaatcctggcatcttgcaagtcctttggcacatgaacattgtctctgagaactgagcctctgggagatctcagatgtgtaactctcgtctgttggaaactccaattcctaccccaacactgaaggattagaggaatcaaactgtgagagctgaatcttggaggccatggaaagcatgaattactttcaggagctccattaaacctcggagaatggaacataccaaatacataattgtttttctggtagggaaagaataatggcatttcctttctgtataaggctttgttcctagtctagcacatttttcatctactcattccagtatttctatattagctgctccctctgtttccagtgtttgccaaagatgccgatctgctgtcttagatctcctcctttattctgaatttgtaacacattttcttataaacctctgatagattacaaacctcctaacccaaacttcatgatagtaagcatatcactttctagacataagggccatatctgcagtgaaaaagaagctgttttccttggcagagtgtttttttcagggtgtagtttgtgtcacagacgtaagtgggggaagaattttcagacgggatgaagtgtgcctgatgtccacatggacttcatataaagcatgtgatgtaattccgattggcttttcttctggctgtcacagagacagaccttccctggcctcagttctcatgtatgttcgattgcatcactttccatttttatggaatttatggctgtaaaagaagcaaaagggatatttttatgggagaatatgattttttttaccctgtaactatgttccccttagaaaggctcttttctgttattgtctacataaatatttatttaaaatttaccttatggcagcaatgcctgaaagctatttagagccactgcctatttaatatttatagactgaaatagttttatcattatcaatctatttttattgactaaaggaggtgtatgtagaccctgccatgcccttcctcctgactaaaccctattgtctatatccagttgatttccttttcatttctctctcaatacaccaaacccgacactggctttctactgtggtatttgtagaagttagcacgaatcggttttttcactataaacatcatctttgcttaggtgtgtagagttgaaagtttttgagtgtcaatttcagatgaatcagtttcatatgtggaatcaactataaactgtgctgtcagctacagctggatataatttggggccatacccccctgagaagagtgttgatcataacagattttagtatcttttatcattttagataatcctaattctgattttccctgtttttatttatactatattcttgttatgtatgagagagagagaacttcttacttttgttccacataaaaatgaccacacactcatgattcattaaattataaagaaataatgtgtttcagaaactgcacatatctgagcagtgctcacttgctcacatatacctggggcacattgataagcagtcatgattctttcccagtgaatatttaaacatacttaggatccttctcaagaccgttttttgtttagccactaccaatcctttagatttggctagcaagatgaagcttgtttgttccctgacatagtctgacttcttgcaaatgggatttccattcatatcaacctttctactaagttatgcaacctgaacccttctgaacatgggagtctcactcctgttcatgctcagctaatattgtcagtagcttgttattgtttatgtcagttttcttgctgaaagcaacaaaaaatactgaatgaaatatatttttaaacatatattttaaaatgtacttatgagctcttgagtaagaaagaacctcaagagtcaaagctaagccatagcaggaagcctgtgtgataagtagagcatgggttatgtatgtattagtctgttctcatgctgctaataaagacatacccatgactgggtaatttataaaggaaagaggtttaatgaactcacaattccacatggctggggaggcctcacaatcatggtggaaggcaaatgaggaacaaagtcatgtcttacatggcagcaggcaagagagtgtatgcaggggaactgccctttataaaaccatcggatctcatgagatttattcactatcatgagaacagcatgggaaagactggcccctcccccatgattcaattacctcctgctgggtccctcccatgacatgtaggaattatgggagctacaattcaagatgagatttgggtggggacacaaccaaaccatatcaggttatttattcttgttggcaattttcagatagatgaacttgagctctggttttcatagccacaaggacactgaagaaaaaagacagaagtctgggcctacttaagatgagggattgtaggaaccctattaccaccaccacatgaagctgggatctcagacagctatactgctagtgcagaggcaaactaaaaataaccttaccatattccccctcctcacacttagactaggggactccagggaagattttctgttttaaagctttgagccaagtaaaagatgaaaaaatttgttctcagaatccataaccacagctggctgttacatggatgtgctgtgcaagatgatcggaaaacttcaggtagataatgtagcttaaagcagctacattcttggttggtagtgtccccaggtattggcagaggcaaattctctaaaggaccacataagccttaaagtattttttcagataaagttccaaaaaaaaaaaactagtacacagtaccaaaaaaaggagaaaaatcacaaaatctgcaagaaaacaggccaccataaatgacagccagtagaaagaataaatagcagaatcagaaagcaaagacttcaaaagttggaattataagaaaaagactatgaaatattaataagtgtgtttaatatgtctaaataagagattgaaaatatgaataaagaacaagagactataagaaaccaagcaaatttaaagataaccaaatcaagacttatagtctgaaggattatcttaggaatgaaacaaggctgaaaattagtataaacatccaacttaaaaagttaggaaaagaaaatagaataagcccaaagaaagtggaaggaaggaaatatttaaaagcagcagacatgaatgaaacagaaaataaaagtgtaattgcataatcaatatagccaaaattggttccttgataagaatacttaacttgacatgtgtctactgagattcatcaggaaaaagagtggttaaagctaaaataaaacttgaaaaaagagaggttaataatgtagaatattagaaatgaaaaggaagacataatcataaatgctattgatataaggataagtgggttttttagacgtttcctgcaaataagtgtgaaaatttagatgaaacaaaaaattctttggggaaaaaaatgtatcaacactgactcagctaaatagaaacgtgaatattcctgcagccattaaaagtggattagtaagtaatgttctttggaaaaagaaaataacagctctgaatggttttgctggtgatttctaatgaacattagtgtaaaaaaaaaattccaatttcacaggaaccatttccaaacacattaaaggaaggaacacttcctacttcattcggaaggctatattgatattaaaacctgacaaggacagcataggataggaaaattataaaccagtctcagtcataaacataaataaaagatccttacaaaatattagcaagctgaatccagtaacatataaaaaatatgtaatgatcgagtggagtttttcatagtaatgccaggggagattaaggttaaaaatttcattaatgcaattcattacaataacatatgaaagttgaaaaatggcgataaaccatgagatatagaaaaaaatgtttggtaatgttaaaaattcactactgattaaaaaatacttttggtatagttgtaataatgcgaagcctaataaaatgtctataaaaaaccaatgcagacacaaaatgtaatgatgaaacattgaaattcttccctttgaggcctgaaacaagacaaaggggccaccatgaccacaggcctccctgtctttctgcatggcctgtccatatgtctggtatggtcttcctcacaccatggtggtcacagggtggttgagcttctagaacatggtggctggcttccagtgggtagaagcagaagctgccagtccccctgtaggctagggctataacaggtatactgattattttgctgcatttgttggcagaaggaagtcacagtccagcccaggttcaagaagagggtaaataaacttcagctctagttgtgaggagcgacatttgtgtacaagtaggaaggaatgaaggaatgggtagatgatgtctctgcagatcatctacctgcacaacgcatatcaaattggcaaaagtgtaaaagaccagtgacataagttattagtgaagaggtggagtggttggcatacttgcaaggtgcttgtgatcatgtaaattaacagaactgttttggaaaacatttttttgtttttgttttttgagtggagcctccctctgtcacccaggctggagggcagtggcgtgatctcggctcactgcaacctctgcctctcaggttcaagtgattctcctgcctcagcctcccgagtagctgggaatacaggtgcctgccaccacagctggctaatttttgtatttttagtggagagggggtttcaccatattggccaggctggtctcgaactcctgaccttgtgatctgcctgccttggcctcccaaagtgctgggattataggtgtgagtcatacatttttgttttatctagtgaaattgaagatgaatatgctatgtggttcagcaatttaaatcttagatagacacttgagaatattattgctatgtgaactaggttatatgtataagaatgttcagaatagcattttttatagtagcaaaaaacctaagaacagaaccgaatttctatcaacagcagagtgggcagataaattgtggtgaagtcttacaatggaatactctacttcagtgaaaatgaatgaactctatgtacaacattgtgatttaatcttcaggacataagattgagtaggaaaaaaagcaaagtaggaaaaaaaattgtagcccaaataaagtttaaaaacatgcaaaaccaaatagtgtatatttatggatgcaaaaatatatgatcagcctaaaagacaagcaaagaaataataaacacaaaatttggggtggtaattatttccaaatggggggaggagatagaaatgggataggacatgggtaattctagtgatcttttttggtgaattgaattatggattttttgggtcatttttcctcatacctcacgtatattttatgttctttttgtatcttctcaatatttaatgtaagcaaaaagatgatccccagtgcttacttgttttttaggattcttttgtcaaatgatgcccttgaatgattatttgcactgtggagttatgccttggtttaattacccatgttagatccctattgactctcctcaggaccatggtggtaatatacttggtggtttcacagatgagtaggtttggctgggaaggcttcattccattgtgaaatttggtccacagtgggatggagggcagtctgctgacctttccattcctatttcctatactctcagtgacctttacagattttcctccagaacccaaagactgtgtgattcccaaggccatcttttttaagcaaattcgtggcctgccttgttggattattgatcactggctgctgaaatggagagaaatcagtagttgtccaatgtaaagtgtaggggcagcaatttctaatttcttgcaattttgttgttgttttgcagattgatcagctgaagcaggaactttcaaagaaagagtcggaacttcttgccttacaaacaaagcttgaaaccctcagcaatcaaaattcagattgcaagcaacacattgaagtgctcaaagagtcacttactgccaaagaacagagggctgccatccttcagactgaggtaaggcactctctcaggattctagacagcagagacattgaattgatagaaattgccctacctgaacaactttcctccaaagaccctttatcctaacccttggggccagatgtattttgaaattcatatttgttgggctttcagaaaggtgagatgcattgtatagattgtgtaacactgcaagtgaagttgtagcaacaccccataaacaaacacatgcatatttttgcattaaaaaaatttcttatactaagtgggataaataaagactgtataattagactcttgtcagtttgtgtcaagttgtgccaccaaaggtgtttggttcacacttggaatttctttttttcatacttcggagcattttagatttggtaaatccaagtcaagggcttggatctagaatggtttcattttatcaaaaatcataaaataactggaatgtcatctgccttgctttgctgtgcatcctctgtatgggttccccttctggcacccatgtttccaaagggttcttgtttactaaggagtatcttcaatttcttttacccattgaagaaagttgatattgtgtgagtttctcaaaggaaatattggtttgttatctcttattcatgcttagaagaacaacaaaaatatgttactatcctatttccttgcttttcctccttggattacatctttgggtctgctaagaaatgcaaaacacaagctagttattgtgtaaataaaatagttatcaaatgcagcaggcaatagggaaaaatgtggtgaatcttgattttgtgttgaggcactgtgctgtgtgcattactttagaaggcattctaatcaacatgcatgctctctcttgggctctttgagctgtgtctttgcatgtatatattttagcatctgtggggaggtttggattggccttaggagttaatgggactgttgagtagatctgtgctttcagtcaaggtgcacgacagtgtccagaggcggaagaaaatactttctggattggataggtcttagcatgaacctgactcagcccctatacctttgaccattggctgataggcagctacctgaatgcttcaattcgaaacaatcaccttggtctcaatgatgtagatatttcacatttaaaaaataccattttcaggctgggcgcggtggctcacgcctgtaatcccaacactttgggaggccaaggcgggtggatcacgaggtcaggagatccagaccatcctggcaaacacggtgaaacccagtctctactaaaaaatacagaaaattagctgggcgtggtggcgggtgcctgtagtcccagctactcgggaggctgagataggagaatggcatgaacccaggaggcagagcttgcagtgagtggagatcgtgccactgcactccagcctgggtgacagagtgagacttcgtctcaaaaaaaaaaaaaaaaaaaaaaaaaagaaataccattttcagttgtgtatagttccactgtgaatgcaaaggtatgggtattttattttttaaggcaaacatttaatctatactataaattggaagttggcttctatctcctttgaggaggcagcagtgaatagtatctagaattgtgtgttaacactgtagccacatgtggctatttaaactaaaattaattaaaatccagtgaaattcaaactgtagttctatagtcacattagccacatatcaagtactaacagttacatgtggctagtggctgctgtattagacagcacagctagagaacatttctaccatctagtacttgtctcaaataggggtcaaccaaaactatggcttgtgggccagatctggccctgagcctgcttttgtaaataaagtattattggaacacagccatacccattcatctacatgttgtctttggctgcttttgtgctacaacagcagagtcgagcagttgcaatagatattgtatggcccacaaagctgaaaatatttactgtctggctttttacagaaagtttgccaatttctggcattgtgattttgtgggaagaggattgagtgggcattggaatgcccagctagtcttctctctggctgtggtaccctaaatggagaaagtttgctgacagctgttctagagcattcatttttcttcactgtattattcaaaaagcaactgcttgtacccatattttgtcaataataccaggattaccgataaagttagtgtaattgtgttgctgtgtgttgttgggtaggagagaatttgagaagcaaggcagtctgcttacccaaaccagcagtcaggtttcttgatggtttctctccagagaaaatgaatgaggagccaggtcagaaaggcttttcttctcactatcttatactgatggaggctatattccttgtcctctttcctttctcattcccctccctgtattttacctctctcaaattaatgtagtccaaattagacctatacatatttcatgaaaaagacagtggtgacattatgtggatagcttccgtcccatgttcaataattaaaatgaccaaataaagagttggtgctttgaagtagaaaaaaattattctccgtgtgcagagaaagtgagatgattttctaagtcttctgctttgaagttgggagtatgagattactgattttatcagctggaaacggctgaggaattttcttttgccttttttttccttttaagatctctttgtacatggaaacagaggagaaacttatctaattacgtctgtctcttagggggagcaatttaggttgaaattgctctaattgttggattgtgggcagaggatttttggcagcagtgtagaatactttaaagtgatttccccactctttgggatagcagaggtaaataagagtctttctacctgctgtgtggtgtgttagtgggtgagtattcagaagatgagatatgttgtgtttcattatgccctacaatgaaaaatctgaatttaaattcatatgaaataatctgtacaccaaacctgtgaaacacaatttacctatacaacaaacccacacatgtatccgtgaacctaaaataaaaggttaaaaaaaaaaaagatatggtgctcatcctcaaaggaggttacatgtgatagctccttgcaatttgattcctgagtcattcctgaaagttcttgccaaaacagaagggggctctctttgtaatggggagagtcctgctatatctgtgccatcaactggctttggctgctcttttagaatagtataaatgacagacgtcatggcttaacggttcatctctgtaaagaaggttttgctaccagggaatttgcatttgggagttggtaggatgaagggtggggtgaggtgtaggaggcaagctgtctcggtttgcggctatgtggcttggctctttggttggtttgtttgaacttgtacaaatgcccagacactctgacatgtgtgcaataaatcaatagaataataattacatacacagagagatacaccacatagctcttaacataacattttactttttaaaatagcttcaaaggactctaaggccaagtttcttattttgctactgcccttgatgtttcctttgtaccaacttaccccatccaccaacacatgaattccacagcagtagagaaaataatgaattggtgttctctagcaccttgatttttctggatttcagtgaataattaacaacatatccataaactgggaaggattaaggcctaacatttattctgtgatctaaagtaaaatgtcaaacaaaacacagcatttagaagtgggagatgtgtggttatacctcagcctccctattcaataactgtgtggcgtggacaagacttgaacttctctgagccttcatgtcacagtctatgaaatggcagtcattgtatcagcctcatacatctatgtgaaaagtgctttgattatagtcaagggttacagctataaattatggtatcaccattgctgttattattatcattactactattatgtttatcagggatgtttgggcaggtcacacctgaatactctacttcacttgtcatcttcacatctgttctgtgtttcactttgtgggtctcttttgaatttttggtatgtgcatttatagacctcggacttctatacttcaattgagtcacttttttatgtcttagaatgatatggacaaataaagatactatgaaagtgaccatctcttttgttctatctccaaattaagatttttatttctggccaggtgtggtggctcacacctgtaatcccagcactttgagaggccgaggcagggggatcacttagggtcaggagtttgagaccagcctgaccaacattgtgaaaccctatctctactaataatacaaaaattagctggacgtggtggtacgggcctgtagtcccagctcctcaggaggctgaggcacaagaatcacttgaacctgggaggcagaagttgcaatgagcatgagttgagatcatgccactgcactccagcctgggtgacagagcgagactccatctaaaaacaaaaacaaaaacaaaaacaaaaacaaaaacaaaaaaaaacaaaaaaaaagagagagatttatttctgatttctggcaagtatacttttctccaactcggcatggtttgcaaactgccaggcaacatttttgcatgtgttttccaagatgtgttatatgacagtggtacataatgctaatttctgtcccaaataagccagagaaggattctataatacttgtctaagagtaaacacttgagaacccgttcattaacaaagaatgcaggggttttgtgtttatgcaggcaagggcaacatagtggcagctgcaaagcaagggttcataacttctaaaaaatataatcaacacagatgagaatcttatgcaattaaacccccccaccaaaaaaaaaatccacatgggcacatacatgctaatattcacatgcagtagtgtatataatttcaggtagtttatagatgctctagagcatttccaagaacttcacattaataatctttgctctctgggcttcatgcattttttcatttaacacatactttttgaatgcctactatgtgccagatatggtttctgctatcattgagcaaacgttcttttagacacgtggatatatgttagagaactgatttatggtaccataaactcccagtgatttcattatcattgattactaataattccacaccgaatcttgatctttcttttgttgtttaaaagcagataagtaaaggaaggaaagaagacacgaagaaatagatatttcgctcccttgaagactaaaatatgcaactgttcaaagtgtctatttgtatctcttataattgaaggctaatattgctaaggtggttaccctaataatattgagactatcttttgattaaagctgatcctctttgaggtcacactcaagcaacttggttctccttcttgagaaaagagatgatatttatggagttgcaggcattctgctagcttcattatttcgggagttcctgcatagacttggaaatgctttagctggtggtatgtcacacagacccttcccacaatgtgtccaaatcagtgaggtgtcatttgataatatttgataatattgataatactgggcatctatgctgtgcaaggtgctggacaaggtggggatccgtaatttcaagagctgatagtcttagccttttaaatgtaattttattactgagtgtcttatggctgctacactgagttccaggagatgcagctgagtgttttccatgtgatattttaaaactgactcaccacttgtgaagttggtattgttgcccctatttttaagatgatgaaatagaagctcagaggatgtataacttgctcaaggtcatacagaggtaaatggcaatgtctgggttcccagctccaaatgcctttaactaggaatctagtgatttccatgagagtcccagtggactgagggctttcttcatgtcaggaagatgacttatctcttttaatctttgttttattttattttattatttttttgcagcggggtcttgctctgtcgctcaggctggagtgcagtggcatgatctcggctcactgcaacctccgcctctcgggttcaagcaattctcctgcctcagcctcccaactaactgggattataggcatgcaacaccatacccagctaatttttgtattttagtagagacagggttttgccatgttgcccaggctggtttcgaactcctgggctgaagcaatttgcccgcctcagcttcccaaaatgctgggattacaggcgtgagccaccatgtctggcctcatttaatcttaaaggcaaaatttgtggcaagttttataattctgtcttgacaggtgagttcacggaattttcaagaatgctttctaggcataactctgacatggctaagaagggggataagaatgaataactctgaggcttaaatcctcgtggtaacattatggctataataatagtgacactatggccataataatgaaggtcattgcccaaactctagggagggtattgttttcaggaagtttagaatcctagtatattaagaaaagtttatcatataatatttagtttttatttccttaaatatgtttaaagacgtttatatatatacaaacatacacatacatacacatatattcatatatgcatgcacactatgtaaaaacaaataaaagaatggatggctgtgtatgactttgttctctctgattgttggatacccaggtgatctttaaattttctatgatgatgcacatgtcgtacatttatagtaaaaaaaattaaatgctttttttttgagacggagtctcgctctgtcgcccaggctggagtgcagtggcgtgatctcagctcactgcaagctccgcctcctgggttcacaccattctcctacctcagcctcccaaattaaatgaatttttaacagaagcagcaatgataatttcttcagggaggttgtgtaaggtgctggtggaggaggaggtgttttctgagcccgtggcagcatttttctgtctctgagtcacagatgactcagtgtgataacacaaactagagagcagacttgggctgtcagtttgcaagatgaatcataaaaaccaaacttttgagaatgaaaatgttgttacatggagaaaagaacacattttacatggccttgcttctcagtttatttgccttgagatgggccctctgtcccccagttcttggtaaagctacaactcttgggcattaaaggtaaccatgacaaggagttgggaatgctttgtggcctccagggactgtgggactgtatgcattcacacggggctttgcaaactattccaaatacttaaaagaactacttattcattgggactgacccatttggagcaaaagagttttttaaatggttggaaatagtatttgccatagcatataaggtgggatttacaagaagtgatcttttacttttttaattgacgtgtaataattgtacatatttatggggtacggtgattttgatacatgtcaacaatgtgtagtgatcaattcatggtaattaacatatctgtcaccacaaatgtttatcatttttttgtgttgggaaccttagaaatcctctctagctgtttgaaagtatacaataaattattgttaactgtggtcaccttacagtgctacagaacgctagaatttattcctcctatctagctgtaattttgtatctgttaaccaacctttccctttcgcccctcacccctcttctcctatcctttagtaaccagtttacttttaaacaataatttcaggtttttttcaccccttgccataattgactggcaagcagtaaagtcctttttaatcagttcagccttcaaaggataatatttaaatgtcctttctgagatagctttttgtttaatgcccttcatagtcactgcattcaaaattaagatgctttttagaaaagttagtagcatacaacaaaatcaacttttaagactgttaaattaccccagtgccatttaggatgcatttatctcactttcaagacttgcaaggaatgtctttaaaactaatcaattaagggacttggtaaaagaaaaatatatatacaaaacaaagccctggtgtcatttgtatttttcctccctaatcctgctgttggcttcacattttaaaatgtttttatttgacgggaaaggcttcatttgaaatttttattgataacacttctaactacaagaaaaagacataaacctgcaaaacagtaactatcatggtggccacaattgggaggtctgcaaaatggtttattaccagtaggaaaaaaaatgttgggaaccatagtcgttataggggtcaccacctcgtctatgtgcattttatttttttccctttccattttgagagtatggatgatggtagtgccaaacaacacactttcccctcccctaatgtctgtaggctttgttttgattctctttttattaatgatgtgaaaactttggggtcacatacaaatgaggcaaggtcaggctttgtgagccttagaatgcggaaaatgtccctgtatctagcaaatgaaggaattgtctataggggccacatttaccttctaaagtttttaagctcttttgcagattttagctacctgggtgaactttgcagagtggcctcatgctattgctttcttaaggcagaacatgaaagacctgtgatggagaaattgaaatgtgatggaagggagcatcccaagtttgtcataaaagctttttatggttgttctgtggcaaattctggactattaaaggatggtgcaggtagctacaggcatcattttgttctacaggtcaagagtctagtacttttgttgttgttattgttgttcaggctttcagagaacgccttatttaacaccttgttaggataaaattgcttttgactttataaacacaggtgttcagtttgaatcttaatgaactgtgaaatacgtaaatgtctaaaaggaaattctataaattgtgaacatggctctgtcagcacactaaatggattaggaaaattcattgtctgcccggtaactgaacaccaatgtgatgggtgtacatgaattcgtcctgaaaagccaataaaatggaggaagaaagtagagcctaggagatgttttttgtgtgggtccccccaccacaaatgagtactggtgcagaagggcttggaaatcagaatggctattcagaggaaggccaagaaggaatacatatgagcagacaacacagaatttatagagtaaaaccacaaacaccttattttccattgtactaaaataatgatattttacagtactctttttgtatgtaattctgctttcaatttcatattgttactgcaactcaaatctcattataagtgttccaacaaaaatccttttttaatcaaaaactttccaaaccttagcccattgtcaatgtattttgagcaacttatttttccagtggaacaaaagaatttggaccttctttttgagctcattaggatgttatttgacctgtatgaccaaatatgtaattaagataacagaatcactttaatttctacattaaatctgttcataatctgtgtccattgttttggggtgtagaggtatcgagtcagagctctttattttctttgaaagaaaatgaatggatcattagtgcttttgtttgtttatacttctgtttgaaaaagtcattgtctataatatattaagctgcaagtggaagcgacaatatccaattagccaatcgtctgtgagaaaatacatgtcctctgctaagtgttacttactggtaaatggtttgcaggaagaaaaagaatgtatttctgtcatgtctgtgggaagctgactggccactttaaaaaggagatgacagaatttaggaggagggaaatccaacaaaactcttactgacccccgagttcacattctttactctttttaaaatgaattttatggaaaacagaatttattaagtacttccattcccttctttttctttggaggggcaccatttggaaataaccagtttacattgtgattatgctttcctgacactggatccacgtttgtcacacttccctccattcccctggaaaagggctaatatttgctgtagttgggtttctttacgtatatttacacagcaaaccaaaatgtcaagagtgaagttaaatagcagggcttctgcaaggatttttcacccattttcatacgaacttttatctttcttaaattaaatacagatatttattccatgcagacatatactttcctccttttgtcttattaagaaaaagggaggaatacaacttgaggtaataagttgtgtagttaaggatcattttaactttaggagtttggcattattgcaagcatttctaccttgaggtctgtgaaatttattttattgcattttttaaaattttcaaacgtagatgatttcttaaatccttatgactataacagaacaacgtctggctcctacaatactacttggcagttgctaatttgaaacgggacagattctgtgtttggttattaagatctggtcaaatgtgaaggaaaagagaagatccaactcctcatttactgagtgtgactcctttgcccagccccagcaatgccagggccagaagggtcagctctctccacagcgatgactgtctttgacagctcttctaagagtagtaccagaaggagggaaagaaatgatcaggaggggtcacagaactgctggggatgttcagagacctaggtgtcactgagggagtggcatgaggatttgtcaacttttcaacctcattctcatccaaattcaaaaagtacatttgggtaaggacacatatcaattttaaacatttaatttggaaaaacttaaaccacatttgcattttgccctgtgtatgtatgtgtgtgtgtgagaaagacatggagcacttagatgtggaaattaggtgtacgtgtgtattaggtgatcattttgataagctttttattggatctccagtgcgtcagttttaaattgcctacatggtcctaggtgctggagacacagatataaacaagaaataaataccaacattactacccataatatgattattgaaaataagcttaagaattgtttggagtttgttttgtccttgagtttccagtaggattgattcatagaagattcagtctagtgaactgtaaaacaagccctacaaagaccttgagcatataaacagggtaagtgcatggaagtacctaatgaataggagagcttgtgttggtgcttggagcactattcacttacaaatcttttttttaaaatttaaaaatttatttatttatttttatttatttttttgagatggagtcttgctggagtgcaggcgatctcagctcactgcaacctccgcctccggggattttacattttagtttttagacaattttgagttaacttttgtatatggtgagagatagggtctaatttatttcttctatatgtagatatccagttttcccagtaccatttattgaagagactatcctttccccattgtgtatacttcgtatctttgttgaaaatcagttggctacaaatgtgtggatttgtttctggactctctgttttgttccactggactatgtatctgtttttatgccaatactatgctggtttttttttttttttcttttgagacagagttttgctctatcattcaggctggagtgcagtggcatgatcttggctcatagcaacctctgcctcctgggttcaagcaattctcctgcctcagcctcccgagtagctgggattgcaggcatctgccaccgtgcccagctaattatttttagtagggacagggttttgccatattgggcaggctggttttgaactcctgacctcaagtgatctgcctgcctcagcctcccacagtgctgggattacaggtgtgagctactgcggccagcctggtttgtttactatagctttatagtatactttgaagctaagtggtgtgatgcctccagctttgttctttttgcttgattgctttggcttttcgggatctgttgtggttccatacacattttaggattatttttcaatttctgtgaagaatgtcattgatattttaatagggattgcattgagactgtagttagctttgggtagtatggagattttaaaatagtaattcttccaatccgtgaacatgggatatcttttggtttatttgtgtcgtcttcagtttctttcagcaatgttttatatttttcattgtggtaatcttttacctcatttgttattcctgggtattttatatatttttttacagctattgtaaatgggattgttttcttgatttcttttttacatagttctccattagcctatataaatgatactgatttttgtatattgattttgtaaccctgcatccttactgaatttggtgattagttctgagggttttttagtgtagtgtttgggcttctcttccctgccctgcccttccctgcccttcccttcttgccttgccttgccttgccttgcctttcttttcctttcctttcctttcctttcctttcctttcctttcctttccttccctttcctttccttctttcttttctttctttccttccttccttcttttttttcttacaagatctcactctgtcacccaggttggagagcagtactaccatcatagctcattgcagctttgaactcctgggctcaagcaatcctcctgcctcagcctcccaagtagctgggactactacataccaccacacccaactaatttatttttatttctgtagaaatgaggtcttgctgtattgcctggctgatctcaaatttttggcctcaagtgatccttgtgcctcaacctctcacagtgttgggtttataggtgtttagggtttccatatgtaagatcatgtcatcaaactagttggagtccattccttctatgcctaatttgttgagagtttttatcatgaagggatgttaaacttcttcaaatgctttttgtgcatctatttaaatgatcacatggtttatgttcttcattctgttaacatgatgtatcacctctattgatttgcatatagtgaacaagctccccatcatgggaaattctagtaggacaaatgactctgttttaaaatttttgttgccattttaaaaaatgaaacttggcaaatttttctaaagtttgaagatggaatttttaaaaataaggaatccttatctttaaagattatactaaaatatttatagatgaaatgatgtaatatctgggattttatttaaaataatcagggggatggggagggagagtgcagtcagatgaaacaggagtagccctaagtggatacttgttgaagttgagaattgggtacatggagttcattacattattttctcaacttttgtcgatgtttgatatttatataataaaacattaaaaatgaaataaaagtaaattagttgcctgcatgggctctttgaattttattcccattgacatggataagccacaggaagtctcccacctaccttgggacttcatgtcctcatttatacagatgttgttgctgctaaattattccaaacatgatggcaaccataaagatgatttcagaccttttatcgactcagctaaagtatactttcagaaggaaagagtcattttaactttttgcagtttttctaagtctttgtttttatgagagggtaatttggatgtaaaagacctagaagcaagcccagggaaatctgatagggaagtggaatcagttgggctttttatgttgaaactttcggaaatcttttttcaatctagccagtcgctgtaagactttgcagctggcagatgtcagggacctgctgatgactcactccatttagtcagggtcagttcatgataacttccctggaagtgccttgggctgctaggcacagatgatggccacacgatttttgcttgacatcatctcttttacccacattggtatcagtcactggggaacctaatttctattttactctcagttcagatttctaaataaagtttagaaaactttattttgcctgcttggagtcttccgtgaatcttacagtctaggtgtttctgatgagtaaaacataagcctgattcaaggaatcctaaatatttatcctacatattttagaaagagagaagatttatgaaagataatatacagggaataagaccttgttaattttattttcttttattctttctccaggctgaagcagattcaatatggacttgttaaaacgtatgttttgtaaattgagtttatctaaatcccagtctagaagaaggaagctcattttctctagaaagtgaatttcaaagtaaaaccacatgttggatgaaatacaatagagtaagatcattatcaagatatcttaatgtactgtagattagcaaaaaaagataaggatgctcactaatttatgtaagatttcagagaataagacagtgatttgaaaacatttcttttgttcagttatagaatttatatagctgagttcctgatgagctcatttcccacttttttctttgtttttggccatatttctcatctccatttctccacatatttttatgtcctggcagacacctgttggtgctcgtcatctctagatgatgtctcctgaatcattttgtctgctgtgccttagcacagtactcaacattgagtttccagaattgttctctaaattgactctcagtttcttgagaatggagccttcttgtcttatatttcttcctccttctgtggtgtatggttttgctcaattccctcctttcagctactgtaagtgtgggtttagatcaaagaatctttacaaggtttgggaatttttcagaacccaggaagatgttgcattgattgaccactatgaaaaagtgaatagagctttgcatttgtcttcatcttcatggtgcttcgtgccagtcctttagagataaattgttacgtacacccttatcctgggtgttatacttctgtaagctgaaatttgtaattcaagtcaggaatatttcttatgttcttatttttactggcaaactgatgccttatacagatgactgacataattaaagtatttttcccttaggtgcttgtaattggaaaaatcagtagaatgaagtcactaatggcattaatgcaatttaacacattttgccaacaggaagtcttatatatcattaagaataaaataatagcagcatatcacatttattaaacacttacaggtgccaaatccatctgtaatgtcaaataatccttaaatcaatcctaggagtttggtacttcctgattctgataggctttcttattttataaaactttcatatgtgcaaagtggccatagttagaatggactttaacaattatctgtaatacaaattggctgagaaagccctgggtaagttaggcgacatacccttgtccttagggcgtccttatgtatagacccagaaccaaaaataacactagagagtaaattcaataataaaggcagaaacaaagaactacaaaaaccctggtgattaatgtgcctgttggggaggaagtcaagaccggcattacagaggagacacagtacaatggggagccacaggaggtatttaagcaaaggggtggatggtctgatttgcattcttaaaagaccaaccactctgactgctgtgtgaggaatggcctctgtggagccagagtagaggctgcgaggccattgcagacatcctggtgaggagtgacagtggtctgtagccagtgatggttgtagaaatggagacaagagaatgattttgttatatgtttcggaaggatagtgtctacacagtccctttaggctgttataaaaaaattaccataaactggtaatttctggcttagaagcaagaatttttttttttcctcacagttttggaggctgggaagtccaagatcaaggtcctagcaggctccatgtctggggagtgccagttttctggttcacagatggcaccttcttgctgtgtcctcacatgaaagaaaggctagctagctctgtagggtctcttttgcaagagtatgaatcccagtcatgagggctccactctcatgacctaattacctctaaaaggccccacttcctaataccatcaccttggaggttaatatttcaacatatgaattttgggggtgggtggcataagcattcagactatagcagatgtcaggatgtgggaagaaattggatatggaggaggttgggaagagaggaatcgaggacaaattactgggttgtggaataactgaatgggcaacagctgtttcaaggattaaatgagataagagatgtgtattgaatggtagataagttcatcaactatgctttgtgttttcttggggtggttgaacttgcggtatgaagacttaaagcccataaagtagcagagaaattaagagaggtgtgaagagaagggacttagcagaagcgacgagacagcagaatccaggagcaagcaacagtcatgaagtggagagacaggagggtgttgctaaagcagcagaagcagtggcaaaaggagattgcattataagacttacgggcattcgggcatttttcctgagctacccgttgctctggtaaattagaaagggagtcatcattctccccaagacctggccatcctattgcctacagttttctgggtacctgtgatccctcataagccctctttacctggtgaaatctgaatatgtctctactcaccacaacctgaatgggccaaaataagacaaccagacttctttctttatagtggagaacacttctttggaattgcggatggctttgatttatttttaaatcataaagtaatgcaaaactacatttgcattgtcaaaaaaaatttttttaaggtaaaacaaaaaattttaaaccgagaataaatccctcttgcatctttccaaacacactgaagttgcaccccttctccaggggccaccaccattatcattggggagtgtattcttcagattatttaaatgctgtatgtaagtgtggggatttatatgtatattgttgggatcttcccaacataatgaaatcatatgggatacgaaatacaataatttgccttttgcacttgttgtgcctgagaggtccttctacatctgtgcatactgacctgcctccctgtcaatggctactcattactccacataccgtgctttagttcatcattcccctatagataaacaggttgtttccaatgtttctgccattacaaacttatttttaagaaccagactatgttactatgtgacctttcatccattttggcaaagccaaaatagtcttggtgaagtcctttgtcagttgccagttgtgcagtagtgtgtctctgccctggagtggggctgagctgtaggtgggatccatagagttggtgtggattgaagtcaagcacatgtggcagcaatttgctttgttttctgttgctgcagggaggaattgaaactcctgggcacggtaagcctcaaacattgtagtttccttgagaaaaaacttgaagaaaacgcccatgtttatattaacacctagtttaaaatatatatacacatataagctttgctaaaataaccttctaaaggcataggtttaatgagactttctgaattaaatttaagagttttaattaaacatgcaaaagataaacagtatcttcaaagttcagccttaagatgtaaaaactcttgcttaagaagaaaaaatatttaactgcacagaatgcctggacttttaatctttgagagttggagcatttgtatttttgaaaattaatataaaaaacttaaataacttaagtcataaggatactcataatagatatgctttctgtatataggttcaagtaagccatgtatacttttgaaataatacatctttgttttagagaaagacattgtacttgctgaaaatccaggagtgttctaattgtttttattgtattacaattatacattttgctaatactttcaaaagtaaagacaatacgagttaatgcaaatagttaacctttctacacctatttcagaaagatcgatgaaccgagaaagagtgacttgtatgtgctacagacatacaaacatacatacagacatacagatatacatttactaagttttgtcttagtaaatttttatatcaatcttgcaaaatagatagaactatccccattctacaggtgagaaaacagaggcctagaggtaaagtaaatattccaaagccacaggtctaaacagtaatcatgcaggatttcaaattagggctgtcctgacttcactgctcttccagctgcatgattctggggtcatttttgttttccttttcagacttatcagtacttttacctccaggaactgaagcaatcttccttccttatagtatataacatattctgattattaaatttactggccagccaacattaactctaaaatggacctgaagttcagttatcagatggcctggcaaacaaaatggtggacctctctatagaatgtagtttgctgatccctgctcttaatcaaagctcccaggtgtggaaggtctgaatgaaatagttactaagatttttgcacatggtaactcttttcagatatttgaaccctctgcatcacaggatactatatcagatcattctaacaagaatcattctgtggacattccctccatcagcactacatgtgtcaggagctgctttatagagttttgaccttttcttacttcccctgtttatttagacacttaaaaaaattacagctgaggtgaaaacctcccacctcctcaatagtttcattttggcttctaatctcaacactacaatctctctcttccctctctccattcctttcttcttttctttggatatcttttcaaaaggaagctaatcactctctcttgccattctacttagctcatagtcctcttcccttaaaattgcctccactgaatctccataaaatccatgggtttttatatcaatgtgatagggtccaagtgggtttcataaatcagagaaactggctgagcgggaactgtcataactggagagccggcgcccaatcgaaagctgatgcttccccttaggaaccagaggcccagtgttgccagatcttctgactctaagagaagcaggaaatccagacttttgggtagaatctctctctctctcttttttttcaatgctggcaactaatttaagaaattattttgcaatagtgtgcaggccaaacaaaagacatctgttagtcatcacttgaaacatcttagtaaaccaaagaaaacttttgagcattctcattttgaaggcaattactcaactccctccatacttctctacctttttgctaagatggtcttttctttggtacttttatttcccacaattgttatctccagatccctgggaggcagtggggtattctatttaagagcaaggcttggatatcaagacaaacctgggttgaattatagctctgtcatatcatttcattaccttggatgggtcattgcagcgctgtgaactaccagtgaaaggtgactactaatgattcatcttaattgctttatggtacaacaaatatttattgagttccaactatgtctatcaaacactgggttagacattggggatgccacagtgaataaaccagagatggctccagtgttcctggagttttccatctctggaagagaaagatattaatcaagtaatttcagtaaaacaattataatgagaaaaggaagctaagcactatgcaagagtaaaaggtggttctaggctgggcttactgggaaaagatgcttaatctgtgatctgaaagatgagttggagtaaaccagggaagaaggggatggcacagcatttccagccagaggttcagttaatacttttttcctggtggatagaaatcacacagatatgacttagccagattaaataataatctgaacccaagtcaatttcacatgatcccattttaacaaatattctcatagagaaatgcaaaagtgctgttgcttctctgcaacactttaacaagatttcctttgtcaagtgtggtagtaattatgtcagatagtgtggtctgtgttaagctgtggtaacaacctcaaaatctcaatggtttaaagcagaggtcaacaaactatggcctgcaggacatatcctgttgctgcttgcttttgtaaataaagttttattggaacatatccatgcccattcataacatattgtctatagattcttttgcattacaatggcagagttaattcgttgcaaaagagactggatatcctgcaaggtcaaaaatatttactacctggccctttaccaaaaacaatttgccaagccttgcttaagaatattactgtggccgggcacagtggctcgagcctgtaatcccagcactttgggaggccgaggcgggtgggtcacaaggtcaggagatcaagaccatcctggttaacacggtgaaaccccgtctctactaaaaatacaaaaaattagccgggcgtggtggcgggtgcctgtagtcccagctactcgggaggctgaggcaggagaatggcgtgaacccgggaggcggaacttgcagtgagccgagatcacgccactgcactccagcctgggcgacagagcaagactctgtctcaaaaaaaaaaaaaaaaaagaaaaggaatattagtgtgaacttccttagaaaactgggaattatactacgtaggcataaggctgtgtaaaggaacaaattagtacatggaaaagacctagcttggtgcctggcacataatatgttcttgctatttatttttcttcttaatattatcttctttcttgctgtttccttctaggaaattcctgctgtaatagctgagctttgtgcatgttatatcaatattattactgtcactactaacaatcatacctcacatttagtgctcacctatggtgttttaggcactgtgctaggagatttgcgtgtcatctccttgaaccctcacaatgatcctctgaggtagaagtatcccattttatagaccctgctcatattagtaacaaactaccattaactgagcatttactctatgtctagcatgtgctcagcatggtccctataaataaggccatcctgttttacagatgaggaagctgagtaacttgctctaggccccattgtctgaagtggcagaccaggattgtaactccagccagtctaatgccaaagccctgaacatattctctattctggccattgggtcatagaggtagaataattaaaagggctgcttcagctatccctgtggccaggctggcccattccctctccctggggtggcttcttccttgcatttcctctgctcagaatagtcaattcactgtctaaaatctgctcacctctaaacccctgtgtcttagaaaagctggttctcattgccatggtgccttttccttcctccagcctgttgttgagcatttggagagctcattggatgctgaagtgacaatacagtgtagacaaggatgaactccttttacagagcaggtgctcatcgaatgtgatttttcttgtgtatttagtgagctgtagctatgatttctcttcctactccttccttttgaacagcttactgagcactctatatgtgtcaaacttcatgcccacactctacctgccttacatcatgctattttcacaacacccccttgagggagtcctcttatcctgatttacaggtgcaaggtcacttgactaggaaggggtgaaatggatacaatgcatacgagtgttctttggggccaagcgctctactcatgctcctcatgattgttgaggatatcttctaaggatggaaatgtctcttgaacctgttgtctttgtcttagcagctagttacatagaatggaggccaaatggtttcctgtggaggattatgtaaaattcatattgacatggggaaatccaggtaatagcatattaccagataagtgagaaagcacaatgaaggaacaattgcaattcataattttcaaacatgactagaattatttattcagtctagtgaccattaagcatccactctccactgtaagcactgagccaagcacagcgagagcatttgcaaatgactgagacagtcttaccctcctaggcagtatgtagctcaggaaggggcagcaccatctcttcagagcagaggctttgtgtcagaggaatccaggttcaaatccaggatttatcttttgactactgtggtcttggacaatttgcctaaccttccaaaaccttctcaactgtaaaacaggtatgattaagaatattttccttaaagggtgagaataagcattcagtaataggatgcaggtgaaaaatttagcataatgcctgccaaatacagagcactcaataaagtcttcactattaatatacattttttataatagaaataaacatggtcccccaggaagagccagacaaggaacatgaaagaggtgtcagagaggaggggcaagaatcaattccttcaggctggagcatgtaggaaggccccattacagtggcaaaccaggatttgaaggataatagaatcctgatggaaaaaaatggctagaagaaggcatggcattccaggttgagggcacagcatgagcaaagatagagagagtgaagtgtgtgctcagggaatccctcatgatgttgtgtgtctggaaaggggaggacaggtgggaagatgtgaagagcctgactttatgaatattgaataaaatatttctggaacatgtgactgcaagtatgtggtagtgtcccaatgcacatacacctgttccttctgtagatgcctgccatttcctcctgcaggaagatgtaaaggcttgctattctgttctcaagaaaatgccttgactctgcattacctgggggacaagtttgacccttccaggttcaatgccagaggtacatctgcccttataacttacaatttcatggcagccaacaaacccttggtcataaatatttctaaagccaagcttctgggctatacttgtttaggctagggtaaagtagagtaaaatatggatttcttattgtcttaaaaaagattttctttttattcagatatggtgaggtcaacagatcaggagacaactgccactggcaagatagttcattaccacttccaagaggaaggggcacaccctgccacatgggaccatacaggaaagcactagggtcggtcaggaggcagagagagggaggagaaacatggcaagagcctttatagcagtttcccagggaaagaagagatggggcagggtttagaattagctcgtttgaataatctcaatgggctctgcatggggcctaagggctgtccttagttgttgggtacctggccctggagggattacagcagggggagggtggccttcagtgtgtgctcctaatgcaggaggtggtagggtgagggttctggatggttggcttgcatatgaaaggcatgctaaaaggtgagtcccttgtaatctctaggaattggctagctctgggaggggcagtctctcccagtccttagttgtttggagggtcagcaaggctccaaatgtcagagcattagaaacactgaaaaaaaggcatgattcatacactcaggtccttgataatgcaagaaaattgtttctctgggaattaaaagaacctgtgatatatatgtttgtgatataataataaatttatatttggttttcatcctggtccttggtacagagttcttaaaacctttggcatttctgagccctagggtaagggtagcttcctttgttacctgtgataagcccttttcaactacacctgagtttatgttaatgacgtgactcttgaagaatgggggctggttcctagaggaaccaaccctatggttagccctccccaagtctcaccttcgaggaggggataggggctggagaatggccagtgattgaatcaggcatgcctatgtaatggaactgctatcaaaaccctaaacattggggttcagagagcttctgggtttgtaactgcccaatgggtttatcttgcctactgcccatatagagccaattcatcaagacaggggaattgcaatagagagagtttaatgcatgtggagctggccaaaggggagactggaagtcaattccttcttggggcccacaagaccagatgagccaatttactggtcttagtggcaccagctgatccatcagaattcagggtctgaaaaataccttaaacaccaatcttaggtttgacatagtgttgttatccatacaaggaattggggaggttaggaatcttgaggtctctggctgcatgattcctgagccatgatttctaatcttgtggctaatttgttggctttacaaagacaatctggtccccaagcaaggaaggctttgtttcagggaggggctaccatttttgtttcaaaattaaactatcaactcaattcttctcaaagttagtttactctacacccgggaatgaaaaaggcagcttggaggttaaaggcaagatggagttggttaggtccgatctctttcactgttacaattttctcactgttctaatctttgcaagggcagtttcaggctggtgaacatgctgaagtggtgggagggtgtcttgtgttgccctatgcatctcttccatttgtttgttcctgggttgtatcctttataatgggaaagaaaaataaaatcctaatccccctactcactgaatggaaccccctcttggctaaaggaaccccagagaaaccttaaaaactgagttcctggccatgacatgatgggaggtcagacatgcctgttatacccactccctagataactgcctttagactttctttcgtaagggttgaatggaaaccagccctttggaaaaatttgctccaccactgatttacacaataactgactagcattccttttttcttagaagaccactgaccatggacttcctctggctggtttatagaggctactcatacaggatgcctgtgtcctccgtttcaccttttaacatatagagcttaattttaatacatttaaatgttaagtctccactccaaagtgaacatgggatgtatgtaacgtgcatgtttgcttactgtgcatgcaagcctccttcatgaatattcatagctctttttgcaacctgttaaatatgtatacttagccaacccatttggcatgaactcctgttttgccctgtcctcccttgaagtgcttgcttttagtttctgccagaggatacacctcttagccagcaggatggccaggctgcaggctgcaactctctacaagaaataaagctctcctctctaaatatatgaaccttatgattcttcagttgacagtaataagcctatattcacaagtgatatgtttccctgagctatgtgagcgattctagcaaatttccaaaacttaggaggggattacgggaacccctgatttataattaagtcagatggaagtgtaggtaacctggggacccactacatgcaattggcatctgaagtgggagggtggggggcagtcttgtgtgactgagtccttaacctgtgaggtctgtgctaattctgagtagatagtgtcggaattgagtttaattttaggatacccagtttgtatctgcaaagaattggagacttgcttcatgtgaaaaccccatacatttggtgtcagaagtattgtgagtatagaaagagttttcttcttttaatgtaacattctacattcctagagaacacacacacacatatacccactgcaaagtgtgtggaatttccatatgtgggcattaaatcatagagggctgctatatgaaggtattttcctacattcttgctcaacagcaagcgtgaggtatctttatggtcagcagggactgatgctccttagtgttttctgctctgaaactccattaaaaaacttgattcatcttttcagtactattcacatgactaatttcatagaagctttagagagtaatatgttccagctctttctttcatttgttgtcatcttttccttaatgtatcccatctttctatattcagtaaattaataaagaaaaattgtgttcatacatggctctgatatagaatctgatatctcttataaattagcactgctatgctcggccctgtcagatagttaattttcagaatggatattaacaccccacctattagattgagaaagatatatgtataatttctcagtaacttggccagggttttacactgtgagagggagataagctttttctgattttttttatattgcctgttggggatcacttattgaaagaccaaatggctttgatggatcttttctgcctaggtagctaatatgtctgatgatgggcctttatcggctactgcttgaacttatgtaagtcatatttgcaggcatcagaggagtgtggtgttgacctcccggtggaaatgggaaatttagactggctcctcctctcttcggcactaaatcttcaacatatattatctttatctttatttttagtaaaatactttgtaaccatccctcctggttttctcctaatatatgtatgaacttagtgaagtgcatgaactctgctttacagtttacccctgaacttacgaattttaaaatagtgatttttcaaattccaggatcaccttttaataatgacaaccagccagaactaaattgttttaatgtgatactctccttaaagactgaagaggaattgatggtctctctaatgaaaattttgtacctttcataagtgtgtgcctatgtgtgtgtgccaatgtgtgtgtgtgtgtgtgtgtgtgtgtgtgtgtgtctgtctgtcttttctcactcaaggtttgttattctctgttgatgtgctatggcccaggattacttaattaaatatgacttaaaagtttgcattatgctttaaacttgtgacaaaaattgcttgacatgacttcttggttatatgctgcctttggaatggcaagaaagcagagtcaagaaaatgcagtcactctgttaaatctttatttattttctaaggagtgagagagcatttttatccaagtgatgagaacctcctggagttgattgacttaaattagcttgattgctttttatcagtcgcagctgcactgtttagcataaaaatgcaaaacatctaaaaagcatttgccttgcagcatactagaaagatgtttttagttagttttaagatgtttcaaatttttattctgcacagattctctgagaatgtatccagaacatatctagttacagagaattagtacagatattgtaaactttgagaaaatgaattaaagaaaatatgctattttatgaattgcatatttagaatttgggcttttttgcttttaaatgtctcttgtaagttaaacagttcagcaatatttgttgcagtggccgagccaagcaactgctgctaaacattaaaaaacagtcattggaacttttcacataatgagccatttggcttttcttgtggagctgtgacatggttcagtggaaactggctgttgtaaagttaggtaaaaccagctttgtattgaaatcctatgaatgaatttcagaccatcatcttcgttttctccctggcttagatggtttaataatgagtatggctgacttactgagctttgtcttgtgtgggtgctgctgtaagtggtctgctccgtaaagtgccacagttctctttctgaaccagctgctgtttttctgatttacccttatttggcagattttgccctttgatacttttgacattatcaacaccaaaggcaggaggaggtgcactcttggagctggtgagagagagggggggatagaactgagagagagagagggagaggttgagggagagagagggagagattgagggagagagagattgagggagagagattgagagagagagagagaaagagggagagagagaaagagggagagagaaagagggagcgagagattgagtgcattattgagctgattgcttgtcttgtttttgtctaaactacgaattggtcttggctgttagaaagtgaatctcttaaagacactgggactgaagcacaggatttgagttcatagaacacagcctcagggacacaccaggacacattccttcacacataactttctggggtctataatgggaatgtagaggtcatgtgccctcaattggagagagacttagagtccttgagccactgtccctcggtggccctacccccacccccttgaaaacatctgggagacagtgatcaggccaacaatcaaaagaactaggagtattccatatgaacaggtagagaccctaataagagcagatgtgtattctggactccagaggtgaccttggcagacatgagatgcagtcaaagtctttttcttctagctctcattctagattagtctttgattatccatttagatatgtagaatcaaataagccagtattgatgtatcatatcatgctggggaaatttttgaaaaatatttacctgtctcaatcctgcctacaggccattttccaaaaataatttataattccccttgtaatgtattgttaatatgctctaatgatatcaatgcttaaatccatcataattttaacattatgacagaatttaaaaaattctttccatgttcctttgggactttgttatgttgtatgtacattatattaaatatagttgcatttataatatagccaaaattcagggttttgagtttttaaatttaactttttgtcattaaacttgtgcccatgtagttataagcctcttaattttattcttaatcacactgtgtgtcatgatttcccttgccacacttctacttttgttcattgcagctatttctaaaatttttcacttgtatagttagtattgcagtgggaatatctttgaacatttggattactgggtcaaagggtataaccacttttatggcatattctgtgcactttgaaattgctttttaaaaggtgctcgtgtacctattataatacctcagcaaaagactgataccaaatttcctatagccttgctagtactgggtcttttaaagtgaaaatgttcagcataacactatcctgcctttttacaactttaattatattgcagggttgaatatatttccatgctttgtttactgtgtatattttcgccgtgatttgcctatatggtggattcttgtctagtgtaatctcatattagaaatattaactcttccttagttaatgcagacatttacccccattttgttgtttgtcttctaaattttggttttgtgagttgtcatgaggtttttggctgtacatacagttgaatttgtcagtcatttctgtcatcacttttttagttcttccaaggatcagataagtcctgtcttctaatttcagcttgttctctgcgccttgatgtttgttgttgttggtttttaaacatttgtttctttatagtttatttgttctttttggaagtacaatacatgtacaaagtcaaagcaatttcaacactgcagttggaagtgtcccatggccacagttgtgtacctttacattctttacttagcaggacacccaagaattcattctacccaagagatggctgacctcaggcttttcactgctgcatcatattctgttatgtgcatggactataattcgtgtaaccagtttaactttatttggaaaaaaacttccttgatagattagatctgtcaagagtctattttaagactcatgcatgtgaatgttcattgcagcactattcacaatagcaaagacatggaatcaacctaaatgcccatcagtaacagattggataaagaaaatgtggtacatatacagcatggaatactatgcagccataaaaaagaatgagattatgtcttttgtggaacatggatggagctggaggccattatctttagcaaactaaagcaggaacagaaaatcaaataccgcatgttctcacttacaagttaaatgatgagatctcatgaacacaaagaggggaaccgcagatgctggggcctacctgaaggtagaaggtgggagggggaaggagggagagaggagcagaaaaaataactattaggtactaggcttagtacctgggcgatgaaataatttatatgacaaacccctgtgacacaagtttacttatataacaaacctgcacatgtatcctcgaatctaaaatgaaagtttaaaaaaagagtctattttgatgttacaaagcatgaatttaagttaatttctttctgtttaatttatcttaatataatttatttaatggtctttcttcactgtttttgattcattcttcatattatttctcatctatcattggctctgtttggggactgtatgtcagcctgattattaatcttgtatcctacagcaggctctcctactttatgttctggatagataagagattgctcctttcaatccagaattgctttttcagaatggtattggacatgcttacctgatttccccctagttgatttctagaaacattttctttatttttaaaaagaatcatctatagggtacattcaatctataaattaacttagggagaattgattagtttaagtaaatatgatatactgtcaattattttcctgttttcagtgtttttatgatgcttattaagtttattcctaagtgatttatcttttgtaatgtcattttgaaatatgtataagaaatagatatgtgtatatatatttgtattcagatcattattttttcctaagattataaaaaattattggttatttaaattttctttatatgttaaggcaaataatattatctttatccctttgttgtcactatttctactttgaaaatattttttgtgtgttgttctgcgataaacttcaaaacattaaatatttgcttatattttctatgggaatggcctaaggagtttcttgagtaatgacatattggttctttgctgtggaaatactttccctcatgttgagagagcttccatttccctttaaaaatgtttataggaatgaaagttgcattttactaaataatactttaatatcaattaaagtgctcactagcttttcttactttgcttattgatgtggtatttctgttaataaagtgtcttaggctaaaggaccctaggtgaaagcctttttgttatggtgttgtctctaagtattttaaattccatatgctagttttatttaggacttttgtatccatactaataaggaggattttatatatgtacatagctagattgtgtgttgatttacaggatagtaagatttcttgacagcatcaattaacaatttttttctgttgttgagtagtatatcttatatggaaaacatttgttcttgaaagtttgaaaaaattcacctagttgctattacagtaggaatcagttactatttaggctttctactttggatggggtcatgtctcacatttttcccttactttgttagattgagaagattcagtcaatggctttttaaataggtacttagttttccctgttttattatattttatttaggtaaaatgtcttggtgtaatgaaaaaatcagaagggtggctttggtgatggggaatagtttccgagtgctttagctcttgtggttgcctgcacatttttagggtgaaagcagagtatcagaggtggacagggtctttgagagcccatcattttttcagatgaggaaactgaagcagagactgggtgagtggcttgaccagagtaggtcagtaagggtgcagcctgggaaaactgagactgggacccaaagccccttggttgagtcagagactattgtgtttagtttgaggatttatagttcattttaaagaaggaatgggaagcttaatgggcttcagtttacattagtcagcattcttatgctagcaagtaactgcaactcttttaaaattagcaaaaaaaaaaaaaaaagtggatttaatgatttgtgtgattggaaatttcaggatagcattgactttagacatagctggatccagagactcaaacattgccatcattgcatttctttcatttcccccttcaatatcttggccttttgttcctttttgggggctatatattggaagatgccagggccatcagcagacccagtatcatatcctcgttcatatcctcccatctttgcaaccccaatagaataaaacatgtttccgtattgaatgcattacgtggtcctaagaagggctgcgattggctgggcctaacacctgatcacctctgattgattcaccgtggtgattaggtcacagtcaatgaaacacctccagcagccaaagtaattaaaaagtaatctttacttctatatcccaaagaacattatcccaaggaatcacataaatcactaaatcctcttttcttcttaaactaactggaaatatttccagtgacttgctagcacaagaatgctgataaatataagccagtttataaacactagcaacacttgtcccattttcaaagaacaccccagggctgctgttactccctcatggctagtctttgaccaaagtggcttttctctctgccttgctctccattttttcagcattacaaatttaaaaaaataaataagtaaaccagaaaacaaaacatgtacctaacctctgggctatttttatgtttcctctattttctttgtccccagagtccagaaaggccctaaagacaaccccaagttaaaggcccctcccccttcaacactaggacaacaggacagtgaagaataaacacacttattgttgtgtcctcgttaaacattaatacttttggttccttcttcccagttgcagacctccacgaagggagctctaatacataactggatcattctgcttacaggtgaacttctatctattttcctttttccatggggccagtgtaattctattgtatctctggaggtgctgccaggcggagcttggctctcttcactgtggttcttcctgttgaaccttctgcctagcgaacaggcaggcccttctcaaggatccccacccacccccagtgcaaaagggatcctactttattaagaaactagacacctatcaagattatagtgaacattagtatacagtttggatcttcataaaggaattttaaaaacttctcttattcagtgaactcaaatcatgccttacaagtttctttctgtaccagaaacataagtcctgaattgtgcattctttctgaaatcatgtgccaagtttagatcctctacccatttttctgactttcaagttgtgttttaagaataaggacagcttgtgtctgattgaccctgatttcttcatgagactaccagtctagaagttatattaaatgcctatttagctagcacacccctcaaccaacctgtgcagacatctccttggctcttcctggaatgagtctactgttcatcctcctcactgaggggtgtaggcacagtcaattcttatctggattgtggcagatgcctcctaacttctccctgcttctcccactgcctctctacagtgaacctgttaaaacgtaagtctagttctgtctttcctctgctcaggaaccctccagtggggctggacatgatggctcacacctataatcccaacactttggaaagttgacgtgggaggattgcttgaggccaggagttcaagaccagcctgggcaatgtagcaagaccccatctcttaaaaaaatagaaacaaaacaacttaggtgtggtgatgcacacctgtagtcctagctactcaggaggataaggtgggaggatagcttgagcccaggagttggagttggttggagttgcagtgatctgtaatcacaccatgtactctagcttgggcaacagagcaagatcctgtcttaaaaaaagaccaacaataataacaaaaaaccctccagtgaccatatcaaccaaagtcttcacagtgacacccaggtctgtgtaacccttcttcatccctgtccttaccccatttccttgtgaccttgtctcctagccattgtctcctcactcactccattccaaccctgtggcctccaggctgttgctccaacatgcctggcatctgcccatctttgttttttttttctgtgctggctcttccctctacctggaatgctttccccctagctcctcacattgcaaactctcttgcctccttcaagtcctctccctctaatgtcaccttctcagtggagacttacactgatctccctgtttaaaactgcagctccctccaactgcaggattccccaggcttgctctatgacattttctagcgttctatataacctaattatttactacgtttagcgcttgttgtctttcttctgccctgccccattctcccactagactgaaaactattttgttcactgatattcctaacatccagaacagtgcctgggacacagcaggtaccccaggaatatttttaaataaatggatgaaattctttggggatattttaagacatggtacagctgggtactttagctttggttcaaaatcccagacaggccctaaaatgtaacttaaaaaaaaaaaaaatacaggatctagaatgtgtcctagtcctgtcgcattcaaagacacatagcccaataaccgaagtaattaaaaagtaattccattctgttgaatgccccaaaatatcatcagctaaatttataccttattccaatgagggagcatgccacctcaacaaagtcttagcagtgtctaagaagggaaaattagaggtgaaatgtttataggtctttggggtttggcctcaagtggtttaagatgggcctttcaggcagaactaattggaattgttcaaagtctgtgatgtgataatgtagggttgttgtacacagcaaagtgagggtcttgaagagagttgcgatgaataaactgtgattgataagacaatggtttgccaaagtgagcagattattttctccaataagtctatcaatgggaatttcctggagcaaataatgatttttttttttctgggcaaagatttgctggaacaaacaactaagatgttgacatagcagtctgtagtaacatttaagtcatagcgacaaagatggtctcagttctttactttgactcattaaagaagatccagttcattgatgtatctgtttgttcattcattaattcattcacctgacaaatattcactggttgtttacagtgcattgatactgggctagcagtgccgctgaacttcctaccaactattccttctttttatctcaggttccttctttaacactcagctattctgtatcttctcacctcttctaagtcctggcaaactcctcttgacaccaaggtcttgtaggtttttggaatctctccccttctctcctcctgcccctttaaaaaatagtttggatggatagatagatagatagatagatagatagatagatagatagatacacttctagtttttttgttaaattatttcagattttctcaatatgggattattgaaattttgggctggataattctttgttgtggagacttccttggattctacccactagatgccactctcactctcctgcctccctattgtgaccaccaaaaatatctacagagactgccaaatgtccctgggcgtcaagattgtcctggttgagaaccactagcttagtccatagtttgggtcttacacaacaaaggggagcttgggagctggctcagcaagtgggaattcatccctcttagagaggagggaaggttgtgtctctgcacagagtgacacttttggctccattacatccttgctgagtgcttcttctcgcgggcatatttgatcatgccacttcctattgccatcaagataaaacccagaatccataacatggcccagttcatctgtatcatctctccactgtccccacttcaccctgccaattgaattctgcaggcatatcaaactcacttcagattctctaagccatagtgctatttcctgcatctgaatttgagatcatctcatctcaaattatcctttccccttccctgaccattttctctttcgtctcatcttcaatatcccttcctccaggaagctctctctaattcatcctgcatccccttaggactctctccctcccctattttaacaggtaaccaacatttattgggatgtttatttagttgtccttcctgctaacccagtgataaagataggactatctcatttaccattgtttgcttcctcagagttcagcaacagagcgtggaacttggtcaatggtgacaaaaaaaaagttgtcaaatacatttttgcaagtagtattaatgtatcattttagtgaataatgcacatctttttttgacaaggtttctattaaagttcaaaaatataccagctacttatcaacatcagtgggttcaagaagaagaaattggggttgcaggctaagtccttcactttcttcaagaagaaattcaacttaactttttgtttagcttgtagtttagaagagcataatattaatagaaaggacacagaattgcatatttcttctttgtctaattatatattcctaagtaaaccttttcttaggaaaacagaacactgttaacaagctctctaggctgtctttcaaatggaatgatctcaatatattcctcattgctgaactctgctgtgtttagtagagtttttctaggctggaaacctgtggggtgaatccagtccccaggattcagttttctgttctcaccccgtgttctttgtttttggttttgtttttttcttaaagatatcaaaataagttgccaggaatgaaaaaatcatgacatttcatgtaataatgtaggtttctagtttttcttgggtgatgtgaagctctgtccctagcactgcctgggcttcctctggcagtcttgggtgggagctaaggtgtggctggctgcccctggggatgggatgaggtgtggctgccagtccaccccgtcccacccagctggagggagcgcttgtgtcactcgcctgacctccatttgcatttgatttgcgattccagtgtttagtctctgtcataagtgaagcaaagggagggaaaagttagccagtgaacgtatgaataaaatatgagcgtaagaacatccaggtgacaagatctggtaacaattgttattgaaagtaccacatcttgctggatttaaagtctaattctcaaaggtagcccaatcaaaatccatttttatgctcccaacaccaacaccggttgcagaggatgagggaaaagctgcaaagtttctttggctgagttgtgtataggccactttcatctgctcagcaggtctgagcacaaaccccttgacattctcctctgaggctctgagtgacccaatttcctcttgctggaatgtttcccactcagtacatttccgtctttaatggatgacttcctctatattatagggacactaaaaccacaatggctactccggacctggatttagaaatcaggaaacccgagttgttggattccatttgtctgccacttacatttttcaggtccttcagtttctgggctattctgttggctggggaggcccggttgattttcggtggatgtggggccatgggtaagtcctttactttcctgaggctcacttcccttctctaaaaactggaggaatgatgctccctacctccccagcagtaatgcccttagcctggcattcaataaagagcagtaggttgtgttactattacattgttttaaagaggaattagaatgaaactcctcatctgttacaggaacaggtgaagcacgtatgtggatgtttcctctttgaaggaaaacagtctctctttctgtgttataatattgttgttattgtccaacttgtaaatgctcttatcttcctcagtgacagaaacagttcttgtgatgtccgttttcctgaggtgtgatatgagttacggaggtgcaggctggaggcgcaccagcctgcagtccgcagagtgcaggtcctgcccactcatctctgattatgtcagaatatggctgcttttcagagaagacatcactctatccaatgaaatggatctttattttcacaatctttacagagattagaaagagcagatttcattcatctttgcctggaaaataactttccattcagaactgtagtatgaagagaaaaacagaggatgattttttttcctccttaatttgattatcccctgaatttctgtgttgaggacaactgttagaggtaagagagggagtttttaggcccctttccttgtaattccgtcttctgaataactcttatagcatgtgtagtcatgaaataaccaagagcttatttttacagcttttactgtactgtgtgtaatatattgcaacttaataatgttaatgcaactaactagtggtgacagggaatatacagaaaggaatggcatgggagcatgccctatccctgatcttctgaggaaagatgtttcagaaaattcattttttcatgttcgtagggatgcttatgaatatgatgaaatttgccatatgaggaaggcaaattttgtaagatattttgcccatttgtgcaaacaatacttagaattgttaacaatcaaaatgaaatatcttttcccagcagggttattctaacatacttttaattttgtggttttgttgagtgtagaattaactcacgctgtataaagtgaagtcacgtaagctatcaagggcaaggatgccacctgggaaatgtcatgttcccagggtctaccactgtgccttggactggggtgcttggttcttgcttgcttagtggtcatcagagggcattggtaaagggatatgctttttgataaaggtgttgggtttttggcaggagagggaaaaatgttccaacagtgagttaagccagcagtatatattggagggcctaccaaatatagaatataatctattaaacttacatttgaaaaataacgttattcaaatgcagcattttctatagtatgttccccaggatattaataagatgttacaaaaaagacaatgttagagtgaaataggtttgggaaatgctgattaaccaaagttaaactggacttctcagagcattttgcaaattcctgaaagagcatttcccaaatttatgttactttggaatgtcttctgcctcccctcagtcctttttttttctccccaataagagtgctcgtagagctggttctctggaaagacttttgggaaggctgggattccatgtagcaaagagttttggaggaaggaaacttcaggcaaatgtgtctggcaagggggaaaggcaagatgcaaggtcaggagtagaaagtctgtgttttcatgaaagggagtttagacctctgagttcttgagcaggactgaggtaggaaaagaaaccttcacatatcctttacttcaccaggaacagcactttctacagattccctgtttttcccacaggaaaagatgccatccaagctcaccaactatggtggacacagttttaggatctggcaactcgcacatggcccctcggtgtcctgtctgcccactgtggagatcccgtgtacttcccctccggctctattgatggagactcttggaccacagtcatgttacatcctctgaggatgctttcaacattatttcaggagagttctgtgcttcactcccatagttgttggtttacgtatcactccctgtagaacaagagcctctgaaatgcagggacggtgtttcattggtctttgaatccccataaaaaataataaacattagctggtagtggtaagtggatggatgaaaggggatactgtataagttttctaggacagccataacaaattaccacaaacttggtggcttaaaacaacagaagtttattgtctgacagttctggaaaccagaaatcagaaatcaaggtgttgcaaaatctgcacaccccacagaggctctaagggagaatcctcctggtctctttcagcttcaggaggctccttcacttgggctgcatagctctagtctcttctcttgtcctcacgtggccttctactcttctctgctgtgtgtgtcttttataaggacactcatctttggatttagggcttacccagataatccaggatgatctaattttgagattcttaatcacattttgaaagacactttatccaaacaagatcacattcacaggttctggaacatggacacatctatttggggaccaccattcaactcattacaggtactaaatcaatttttcaagattggaggatacataagcctagtccaagaacgaagagccagccatgcatgtacctgtgaagattcagggttgggtgttctagatcaagggggccaatataggcatgccatggctccccaaacttgtgtgtctagaagtcctcactgcttcatcctgcccatcttttcaccaagtctggatgtggccttaggatccttcctaacattaggctctatgaagctgcttccaacagactggagtggacctgtgatacaaacaagcagattccctaagatgataaacagagcactttatgagaggtatgaacagtcagtctcattgaaacatttccaatgaccagtctcaatgatgtcataagaggccaaggaattcaagcttaatgtaaatggacacgaacatattttatgcagcaaaacctgtgcctcatagggaatgcctagggatgaagtggaggtggttgttcatgtttctggtcatttatgtccttcctggcaggatctaaagtgcctggcaagaagaatctcggagggaagaagtgtctttcctcacgctccacttctaaaactacagtagaaattgagaccactttggttgatggtgactgcttcttaaaagactcaaattctgctattcgtatggtttataaaggagtcgggcaatatatttggcctgaaaacatccttacttgtctttgcgcaaacttgcttgcatttgaaatgctgtagagtggcaagctctgcttgatgcatttggtttatccatcatcagaaggttgtagtttctagacatattcatccccctttggctcagacagtatttccttttagatgagtgctctcatttctgggtatttcttgtgtttcagctagataggatgctatcagcacattttccccctccctataaaattggtaattgttaaagctaggggcatgattttttgtttgcaatccaagatattctgtttggaaggctaaatgtgatgcaaaatactctctgtatctccctcttagaatgcactgcaaatgtttactgtttaaatgggtaaatgcctagtgaccaggtttgctgataggatatcaggctgctcagaaacaatagccccttagtttgtgggtgttttattgggtcccagtattgcataatatgaactaacaaaatggcatcataaaaatcacagaatgtcagagttgcaaatggatcagtgagttccacctcttcatcttacagatgtgaaaacggtgggaacttcccattaccaattgttactctttgagcagttaagttatgatttctctcataaaattgtaggactatgaacaaagaaaccactgcctcaagagtaatacaatagaatattgttgactcaatgcttacacagtaaattgatttatacacacccacacacaaacccacacagaaatagaaaattcgcaggatgaaacagattttccataccaaaatgttcactgctataagtgctgtgatatttttcaggagccatgatgtatactagcaaagggatgattgttgctctgcctttaagaaaaaaaaaagtgagcaataagtatatgtaggttgactctaatttttttaacatcatggcaattcttgcttccagcttagtttttatagtgattgtcttctttactcatggagctcagttctttttccagctccgtgttccttagtatgaaaatgcttccaagttggaagaggctgtaacaagtcccaacagagaaacaatcacttgctctggccaaggtaaatttgcacagagtttggtgttaccgcccatttcagaatcatttatgctcttcctaaaactcaatgatgtgaagtcccaacttggcttaaatgtgaaagtatgttcctaaattcaacacacaccttagtgggaggtgttacaatggaacctcagtagtgaacctttctttccttcagcatttgtgggcataaaagatgtttctgaatgtctgaggataggatacatgttttcattcttttgaagagcaaatttgttaaaactatttcagtattaaatatttggctgaagttgaaacattacaacataagaatacatagagggaaggtgttatttacacttggcattttgaaggattttccatttgatgacattttgtttggagcactttagactggatgcagaatagcacacaacacacacacatgtaagtgtaataatatataaatgtacataataaacgccttacatgtataagtgacacttctatcattataactaggagacgtctcagagattcgaagtttttacttctaaataatacctaccttgtatataaatatctatctatatatgtcagaaaggataagatacatgtcataattttagtacattcaccctttttttgcttcataccacattctctccactgctttggttgctatttatgctgttcagatatttcctgctttcctccttctgagcgtgatgtcttggctttgctgcttaaaagccatgtggctctgggccttctaaaatggagaacaagaactcaccctgtctcaaaaatgctgaggggcctcatgaaaatgcctcctaggcattagctaatgttatcattattgtcagtgagattagcttttaatgataactgctagaatattaacataaatactctaatgactaaatttactaatcatatgtagatgatagaatatataatgtatcatggtaatcataaattatgtcacttttcactattaaacagcagctgctgttcagtgattgtctctactttatctcttagtgccttataataaaacatcttaaaagtcatatttcaattaatcctcatagtatctgtactattattaccctcattttatggatgaggagactggagttttgagagattgtatctttctttccctaagccatggtgagtaagtggaaggttaagatttgaccttgaggagtcaagagctccgacttgcagccattactcttttcctgccttcctacaatgtattaatatgctagataaagagtcataacagctataatatgtaccaccatggataattcttcctgggcagagtgtgtcctggccatttcctccacctgcagcatttctgtcctcaagaaagggctaaactagaaatgcaggcaatcaattaattttctgggagctctgggcctaactagatttctcttacactgagttagttcctcataggaatctttgggtgggattccttggttagtttacaagtgaaattgacaaatgtgttcatttaatccttgtttttatcactcatttaactgagcatgaaggaggcatttaataaactcttttcatttgcttatgcatctttccagaaatagcctgtgtgcacacaagcaaatgttctttcttttttcccaattggaaacatgttagacatactggaatacacgctgcattttacattttgcctttacaaaaattttctgcaatttgccgtttgtctttttccatgaagatagtttcaatttaaatttaatcttatttatctgtcttttactttatggtgtctaggctttttctcttgcttagaaagggctcctataccctatgaataaaaagaagggcccccatattttctttttaaaattttttcatatatctatattaatactttttgtttttgagcccatgtcctactctgttgcataggctggagagcagtggtgcaatcatagctcactgcagcctcctgcctcagcctcccaagtagttgggactatagggctgcaccaccatgcccaaacaattttttattttatttagtataaatgaggtcttgctacgttgctcaggcttgcctcaaacttctggcctcaagcagtcttcccaccttggcctcccaaagtgctgggattataggcgttagccactgcccccaaccccatctgttttagcacttttatgatttaattttttacatctaactctttattaggaatttatttttgtcataaagagttaggtaaagtttcactgttattatttttctaaatgaaagtaagttttcagtcattatcaatggaataatccatgtttcccctactgaatctaactaccacctttatcatatactaactttatatgtgtatgtcagtctattttggactccctcattattgttcatggactgatctgtctttttcttcctgcatcactaccaaactgttttaattaccaaagctttaaatatgtttcaatacagtacagctggatcattcacctcctgacatgaaatttaggttaggtaaagtccttagaagtcattgagcaaaattttatctcaattttatttttttatcaaaagataactgagtccctcagaaataagcagcttcccccaaggtcccatccccaggtcctagcagagccagaaatgaacctagggtatgggctgctggggtatgttttggaccagaagatggggctttaagccatagctctactacactaggtctctgagccctgaaagctccactgttttcacctttaagcagtacttacatcacaggttgccctggggaatgcaggagcctcctgcaccacctaatgcagtgttagccacagagggcatctcaaaagtatcagcagactgtcagccaaggccttctgagtccctttcagcagtgtgttcccattttgccacactcaaacctttcttacccatgccacaccttacaaatttgatggcttaaagatactttagaacagcctttcctaaaaatattctgaaggatattattatgtgttcttagaaaagaacgggttcggtgggaaaaaatagatgtggggaaaggtaagttaaatcaatttaaagaagatctttgctgtgggacttttcagaacctttagtatgctactgtctaccataaaccactagagcccacaatgtttcccaagtctgctccatcatggcacacaccctgcttccacacccctacttaacttttgcacaacactcagaaaagtttcaaagaacaaatactgtttattttagagtagtatttttcacagttgagaaaacatttcttcttctttttttcaaataaacaaccttgtagacacctagtattgttttatgtaataattactactttacttaattagtgacaaacataagattaagcatgtttatagctcttatagaactatgcagccaaatcaagattatgtactaaatgaaaatacaatgtcaaagttaataaaatctaaattaatgatattaatttaatatggagaaggatagtgttttccacgcatgaatttacactgatatgaatgtggtacaaactggtatggctgaggtgctagttcaggaggcctgaactagtggtatgttgtgtgaagatccagtttcctcgctgattgctgtttttatttatagtgctgatgaacccctggttttcatggttagcatgatgtcctgtggttgagacttggagggaatgtatcatagaaacaagaagttctgtgcttttttccatttcactccaaagcaatcttaagtgcaaacacaaaggctatattgaaatctattagcaaggagagatttacctgatccagatttataagagttatttacatgatccaggataaattcattttaacttttgagataatcatagaaaagaaaagatgacatagaaaagaacagacaacataagaacgctcttatagcaaacttctggatccttaaacacaagtccccatcctccaggagtatttgagagacacgactctaaaacatgggtttaaccctaacaaatacagtgcctaatttgttagtcatttacaaatactttaggcatatctcattggaggttatttgtttggatttgttaaaaagcactgacctaaagatcacaaaattattacttagtactaaattatctgtgatttaagttctggagcttcagtgatagtttagaaaattcatggcatatctaagcgggatcaatattttaaaattttatgttaaaacacaatttcgtgcttacatttaatgtgcttacctgaagggaaagcacaatatgaatgacacatggtattttcttaaacttgtttttttccgtaatagcaaatgttttgaagatgggctttataaatgttaggaggtactaagattgatagctttgcaaattggttttaagtattttgaatttataactatcatcatgttgcaaaataacattgactttggaatggcttacttccttttgtagtaattcaaaaatattatgacagctatagttttatagtgagcataaaaatcagtgaggtaagttcaatgaggtaaggttagtgttggaagttttattaacgaaaactttaagtattaacacatgagttacaattcccatgtgttttcagaaatttgctggaactgaactgagcattaaattttgaactttggactagtcacttaaaaccacctaattttagtgtaagaagtagccaaaaacttaagtatgaaaacaggtttataaagttggctgaattattaactcacatgtgatatgaattctcccatgtaggtgatacaaagcactctcaacccagcattgttttcttcaagtaggtggcatgtgggacttgggtataattttttgacaggtaggcatgacaaacacatttttacaacctgaaaatctcgactgtgttattaacaagttggtgattgtaacttaacttttataagcacagcttaaatgatatatgtggttatatgatactaaatatccctgaattctattttttgaattcaaattgtatgagaacagacaacctaagagaaacatgtactgtaaattatgaagcactttattatacaatcattattgtttttctttgtgctatctaaatgtttttaaatataatataggttttttttctcttgtcaagtgtgtaaatttttgactgctaaatgaagtcagcacacagaagtgggattatatagtcctttatctctgattcagtattactctactgactgtagacatcaacaggaggataaatacatcattgacattaactagacgccttgaaaggccaaaggctcaattgagatgaccaaatctcttgttatccatgactatgagaggaagagaccttatagcaaaagacctaaaagcaggggcccttttaggaaggggatttctctcagttttcaacaatgtcgatgtcctctccttacacatttttgttaatttggtctcagagagctgcatcgaaacaggagtgaatctgtaaatgtgcagaaggtgtcctacctggtcattaggggaaatgttgatgtaattacaggactgcccatccacatgtagatcagactccagtccagcttctgttgtgttgggagcttccaaatcatatagccatttgcttttcatatgtttcctagccatctcaaactatatatgcctaatcctaaactcttgatttcctttcctcaagtccagttctccccagtcttccacatcacaggcaataattccactatctactgagtttttccagctagcaacccaggagtcttctttgatatcttccttcctttcatccctacacatacaaatcctcagttctgccagctgtcttctgtatctcaaaatgcatcacaaacacagccacgtgccccctctccaccacctccatcctagttgtgacagccactttctcccttctggctcattgcagcagctcctcacctgtccccggcctccattcctgtcccctagtgcctgttttccatagaacacccagagcgaattttaaagaaaaagtgcatcaaattgtcccatccttgaccaatagcaagactctattggtctttaataacttccttgctttctggttcaacaaggcattctgaactcacctgcacatcctgccttagacctaaaatcaatcatttctacaatgaaagtagatttgttttagtgaaaaatggtttagagatcacaatttgggcacctggggtgggttctcatcgctacttaggtggtcagttttttttctaggtctacagtggacaaagctagaaataaaaaaaagaggaagggtagggggagccagggagcattgaaaaatcacctatcgggcacaatgttcactatttgggtgatgcgtactctagaagacccaaacctcaccattacgtaacaaacccagatctaaaaaaaaaaaaaagaaaatatgaaaatatatcatgtattcataatatttccaatttgaatttagtattacaaggcttttatttaagtatttaagttcttagagtttatatctgttttactccactcttatgctaaaacttgtatttattaaatgatattgacataatacttatttgttctacctccactacctccaaccttacaaccgtatgtttcaataaatcacaaacctgactgtcttgttaaaaggctatatccctaacactagaatgttgcctggcacaaaattgattcttcatatttattgaatgaatgaagaagtgattctggttactgcttataaaaaggttaactacagacaggagagaaatctgaaattaaaatagctgcagaagttaaagagcaggaggatgtaaccaagcatagggtaagagatgggcacaccctcatccgtagagccagtttttgatgatgcagctgctgaaggacatttttttctgaaaggcaacttttgctataattagagattgacgtgaaagagtttttgaaagcagtgattattctgagttcttatttcatcaagaatccagaaagattcatgctagctgaattaccagccatcaaggtcattgatgattattcgtcaaaaattttcttttgtagaggtcagtagcccctgatggttagagaagggaagaaggcagtactcctgccccaccacctggcctctatgtagtacatcacagctgtacaacttccctgagcactccttgaagtttcagctctctgtttttctggaagcttcatgtccatgaaagcttctctctaagtcagtgtgatgctatgtcttgtgacagggctcagccaaccgtctgtttgctgttgggccagaatcctccctgaatcatcaatatgcaagggagattgaaattctaagcctaggtaggattccattccaagggttgaagcttttgggcttacaggagtcatagaccttcactgtccaatatggtagccatgagccacatatggctattgagcacctgaaatatggctaatcctcattgagatgtgctaaaagtattaaaaaaaagctagattttgaagacaatacaaaaaatgtagagtatctcaatatttttcatattgattacaggttgagtaataatattttagatataatagattaaatattttattaaaattaatttcaatgtttctttttactttttaaatggggctattaaaaaatgtaaaagtacaaatgtggcttgcatctaattattttggacacacagtcttaaaccttgctcttggaagactggacatgcctgtgcaacatttctagccactgcacagatctcaaataccattcacttcaccagggagaaatcactcctcacataaattatgttaattgacaattttcagttgtccatcaaatataaagaatactgaggtatttttggtagctgactctggaatgttagcttttaattaaagtctttcatagctaattaactaactctggaggacttattcccagttgggtaatacacccatctgtccacccacccacacaaccctccacactgcacacataccatagagtgtatgctgaaatatttttaagtaaatgtcaaacaatataacgcctcagtacatgttagagcacaaaaccttatttgctggttctccactcttcctgagggctgctgttgatcagcaacctttattgcattcctgcggtatataaatcactgaattagaggctgtgaaaagtagaataataaagtataataacaatagcaaaaatttattgagggtttctaagtgccaggtaccatgctaagtgctttacatgtgttatttaatttaatactcaaaataactcaatgaaggacgtactgttattatctccattttccttgtaataccttagaaatgttcatgacatttgaaaggccattgttatgagttagttgaacatatatatttgcattgcagaggatgttgcaaaacatacccacctgagccgcttgtctatccaaactgaaactcaagttgatgagcttaaggggatctttcctcttcagtctgtctttctctctttttcccaaggctttgatctttaacccccgtgtctactcccccaaggttctactgcttcttcctcttagctctgtctttggccctctgtcattttttcccccttctttggatttgggatgaaaggagaagggaagttgaaggtcctatatatagaaagagtgaaaggaagtaccatagccctaattctttagattcatgacaatctctaagacaaaaaaaacagttttagttttaaggtgcctattttgcagcaaaatcatacgagtttattgtaataatttctaagctatttaacccatcatactgtaagtccaacccgttttaaggattgaggacttgggggagaacctgtttctcacagtcacttgaggatccagacttaggaaggttctgccatcttgtatctccaccatctggaaagtgtagcctctacgatctctgaggaagaaaaggagtgtggtatggaacagacaggaagtgatgtacctcacttctgcttacatttcctgaagaaaacacagcgtttcatcttcccaaaaggcgcctgagaagtgtgatctttcctgttttcaggaggaaaggagagttggatgtgagtgagaactagtcgttactaccaagcaagttttagattttaggttatttttagtgtttgtgtctttggagactgtgtacattatgcgtacttccaactttgaaactgtctcctgtttgaatgattgcaggttgaatcaaattcaaatatacccttaactcaagtctacgattaggaaaaacaaacaaatgaagctttgaatgtgaaataaaactatattgggagcttttgtgagtgttccagtttcattttcttttaaagtttttctttgtgatagcctgtttattcaattcttgaagcgttgtcaagcaagtagtatttaatctgtgaaaattttcaagtggcccctttttctccctcaggtgtttttttctctcaagtgttgcagtagtcattttaagattgaaatgaactgtttgatttttagaaattatttatggcacatcaagtagcacttagtgttttgtcacaacattgaaaccgtttctgaaggcgcacataaaatacggcagaaaggtcgagtgtcttatgtatagaacttctggaaacatacctcaccattggaactggttataattcctgggtgctgacatgaagattaataatgcttaactctgattttggcaacgttttgccaatttcattgccatggttcttttctttcaagttattacctggaactgaagtgaaaacaaatgttttatgttttatactgccagataaaaggttaaattttcatatgtcacatgctcttacacacacacacacacacacacacacacacacacacacaaatggatcaaaaggaaatgagcaattctcctaaaatggaaagattgtcctagttttaacattagatgactagttcccatgtggttaagtcatatgtaaaaattggaaattcaaccttctgggtctttgtgcatggactatatcatacagttctaattttcttttgtttttctgggaaatgatggtgctctttgctttgccaagttttattattgagtcaactgccaaagtttaagagagagagtcaagggcccttaaaattatttggtgttgagtgaagaggcagagaaaggtattccatatacctaaacattttaactttatgtctctacctgatgttggagtataatctagacttcaggcttttctgattctgttttaagtgatgtactctgttgagtggagtcagaatattagtgaggggaactttaatttcagtcattgatacctaatttggaactagatattctaatttttaatagaatgcattttttcttgccttatcttccctgtatttaaactttggtgcatccaaaggcttgtgtgcctgcttgtggttttgcaccatgtggaagttcatatttggttttagagatgatgtcatacttgcttactgcacactgggctaatgttgcttgtgaattgcctgtggttcatgtcaaagtttcatcttaaaaaaaaaaaaaaagaagaccctgaagcccatttctagtgcaaaactttaaagacagagtgaaggtgattgaaaggcacgacccaaattcctttgaagttaagtacacactttccagtgcatggaaaataaaccccccaaacagaagacctcagctggcacaggctccctcctgccatgttgaatttgggtgtttgagtaacgtgctgatcacaaccatcctcgctctccattttgtttctggagaaatattctcatggctagggttgttttttatctcttctgggcttgggaagatgcgacagggcactgatagatcacacatggcgagaaggtgctataaatgttaagccttaaagtctagattacattccaacatcaggtagagacataaaagttaaaatgtttgggtatatggaatatttttctctgcctcttcactcaacaccaaataattttaagagcccttgactctctctctcatgattacagagtgtctttttctaaactctctccagcaccactcactacctcccatattgtaatttatttatatcacagtttggatattaggcatttcctttagtccagatatagaccatccagctttgataggtaggatgcagggcaaatgggacctcagtcatgtgtttcttctcagaatcacactgagtcctagtaagcccatgtgcaaatatctacaattgattgtaacccctttataaccactgctataatccagagtgttcagcatgttctgccaatattccagtaatccaccaaatacctatatttgtgcataaactcaaaaatcatattttttcaccagatataatgaaaacctacagagaagagtggttttatgccaggctggtagatgaaggtaactttaaacaaaaatgggccacatgagaatctgtggcccatctgtagggcatcatctttagtgcacctgtcatgaattttcatttaggaagaggaagatccccaggacgtgagtatccctccacctttccaggccctgtatctttctggctattatgtgagaaggggcacagctatcagctatttgaagaatctgccgttctcctccccagtcacagaatgtccactctctcttgtaatgcagtcagggccattagggcttgggggctccacacatctgtgaccaacccttcccctacggggacctcccagcttcatccttctcactggagcagaaactggaaaaactctctactcccccaacttccctgtcacctttgacctttagaaacacaacttaggtacccctttcttggcaaggagcaagaaaaggatattctactccaataatttttctttatcgctaatatcatcatccttccctgacgcattctaccaaaaacggattcctgcctttaaaaatcctaagatgtcagatatgatctgttcacacctcttggttttatagatggagaaactgaggctgaaaggctggggaggggaaatgagagttatctgtcctgatcctctcaggcagttaaaagcagaaccagtcctaaaaacctaagtgtcctctttctattgttcctattgactttttttttcttttaaatgccaccctctgctgccctgaacttttctttttttttttttttaatttttaaatttcagtatctttaggggtataggtagtttttggttacatgagtaaatcgtatagtggtgaagtctgggatttcagtgtacgcatcacctgagtagtgtaccttgcacccagtaggtagttttttattcctcatcctcctcacacccttcctgcttctaagtctccaatgtccattatacgacttcacatgcatctgtgtatccagaacttagttcccacttagaagtgagaacatgcagtatttggttttccattcctgagttacttcacttagaatgatggcctaagtgaagttccatccaggttgctgcagaagacattatttcattcttatcatatatatatcttatttgttatcatactttatctactcttatctacttattctttgacaggcacataggttgattccatatatttgcaaatgtgaattgtgctgtgataaacatacacatacaggtatctttttgatgcaatgacttctttccttttgggtagatacccagtagtgggatggaatagtagattgacttttagttatttgagaaatctccatgttgttttccgtagaggttttactaatttacattcccaccagcagtgtataagcatttcctttccaccacatccaagccaacatctattgttttttgactttttaagaatagctattctggttgggataaggtggtattctcactgtagttttgatttgcatttccctgatgattagtgatgttgagcatttttcatatgttttttgggtatttgtatatcttctattggtttcttatggcattcttgtatcatttttgtttttgatttctttattctttttttttctttccattcaaattttacttgcctataggataaggaagcaaaatgtttgaaaatttttgttatgagatgcagcaatcctttacttcccctgttccattttttttttccctaagacaaacccttttaactcttcttgttcggttattttgatatctctaaataacctacttgcttctctacttcctgattgctggtatagctactatctgttgacttcctgctatggagggtgaagattaagtccttccatcaccccaatacctcatcacctcaatacctcatcacccatgggaaccttatccaacccccacttcattctcccagttgtgttataaggtaatttagttcccaggttggtgttttgttttgttttgacctctctctttcatgaaagacattgttgtaagatatttgttaattcttagttatgtattcatatatttttcaaatttattgaaatataaattataattatatcaaagtataaattattaaaatgtacagttcaatgagttttgacaattttgtacaccaggtaactgttctccactctccctaatcaatttagagaacagaaaaacaccctcctgtccctttataatcagcccttcccagcttccaccccaggcaactgttgctctcatttctgtaacctcatagattattttcacctcttttagaatttcacagaaatggaaacacagtcatgccataaatcctctagattctttcactcggggtgcttttgagattcacctatgttattatgtatatctgcaggtcactcctttttatggatagataatattccatataaaaacaccaccattttatttatccattcatttactgatagacatttgtgttgtttcctgtgtgatccattatgaacaatgttgctgtgggcatctctatgaaaatcattttgtggacatgtcttttacactttctatatcagcagtccccaacctttttggcaccagcgaccagttttgtggaagacagtttttccacagacgaagaggtgtggggtgtgggggatggtttaggaatgaaattgttccacctcagatcatcaggcattagactgtcataggagagtgaaccccattgtgaactgcacatgtgagggatctaggttcattagattctatgaaaatctagtgtcactgctgatctggcaggaggtggagctcaagtggtaatgcttgaccgacactcacctcctgctgggtggcctggttcctaacaggccctggaccggaactggtccaagggttggggacccctgttccatatgatcttatttaattttgatttgttgtagtaaacataacatattcctttcccacatcaaggggactgacaaagagttacttcatacatcctttgccaaagggatcaggactgatccttgaagagttagttcctggattgttctaaccctggctttgacatacaatcaagtgttaaggtgtctttaatgatccagaaaaaataaatcatggtggttgtcttagttcattcaggctgctagaacaaagcaccgagactgggtggcttataaacaacagaaatttatgtcttacagttacagaggctggaaagtccaagatcaaggcatcagcagatttcttgtctgatgagagatcaatcaatgcttcatatatggtgccatcgtgctgtgttctcacatggtggaaggggtgaatgaattcctttgggcttcttttatgtagcaattagtcccattcatgaggcactttgccctcatgacctaatcacctcctaaaggccccaccttttaatattattgtattggggatttgatttcaatttatgaattttgagcaacacattcagaccataacagtagtatctgctgaagtggcagcaagataattgtggcaaagggtcctaatctttttaatatatatatccaataaaaaaagtaaatgctttgggagtaacttattgaatgtcattgtttagctgagaacaagactcttggaaatctcatagtctgtcattgtcgataattaaggacaataatccttcaaataaagtgtttgtcacagttgcattttaagactggattagtgtacatttataaacatggttgcaaatatggtgttgtatatcaaaaaagtacaatttaaaaatgctacagaaaattaactcaaaatggtattctgatggtcttcatattctttttgttgtctcatttcttttttaccaccccagtgatatttttctatgatctaatctgagtagtctagaaatagacctttctttgcacatgggcttcagaatgttaaattaaaaaaaaaacttatattttcttttttattaacaacatttgaaagcaggaattatattttttttaaattttagagctgagttacaaggaggaatttttttttgtatgctttgtctttttctttttttttctttaaaagtatttggaaagcagtctcatgaggctggagcatgggtgtttcatttctatcttattttcttcctccagcagcatgagtgtcctcttggcaacatgtatttttctaatttaggagtgtttctctacatgtcaatcttgttcctctggatgtccatggcatggctcattgtgttctccgtatttcaggacgatgctgcaaagcttgagcagtattttatcctccctggactctcagagagacatgggagtattgatgtgctttgtttccaagcttagacaaacatgttgtagtagggaaacaaacatggaaacctactactatttcataatgtcttatttcaaagaagtcttattttttttttaaagtatcactattgagatgtgcacacaatagggctttaagaaggatgtaggctgttaaaatgcagggcagtgaggtgccatgagcagtggttccattgtgccttgctcagtaaacatgctgctgccctgcctcctcaaagggcacaattgatggttattgatgacctttctgtaaaaccacaaccttctgtctttttcctgatttcaggtagatgcgctgagattacgactggaagaaaaagaatctttcctcaataaaaaaacaaaacagctacaggacctcacagaagagaaggggacactggccggtgaaattcgtgacatgaaagatatgttagaagtgaaggaaagaaaaatcaatgttcttcagaaaaaggtgagtagctgacataagaccttcaagtggggtatcatccatgttttgtcattttagaaaaattttgagcacatggaaaataagtgatcttttacgaatctttaggaagaataggctgattttcatactggtgtttcacttactggtagttgcatcatgtcaatattagcgttgcttgatgaattttctatttgattacctagaaactaaatagtgatgataattttttattcagcagcttaaacatagagagaattgtacaaatttagatacaaatctaaaataaccaaaggtcccaaaagttaattttttcttcctgagagttagcaatgtatttgtgggtcctgaatgtattttagatacatttgatagtcacataaactgtagtagatcctattctgtgaagcccatatagatttttgggaggcaggggtaatgttttatacccattacttaattgaaatcaatggaaagaatgtataataattcccagccacagtgatgcaacacagaagatgcttgaccttgttagggctcttccttccttcctttagcagctcgatttctcccttataggggaccctgattttgtgatagcattcccgattttcttttggagaatttctgtttgctactgtatatagttttagtggggccattgagtatcctgccttctcttagtaaaagggtgggtgtgaagagaaaccaatggctgctcttttacaaaaaaaataaaatgtgttgggaagatacaaggctcacagatgaacagggggccagagaggaaattaggtggaaatcaatggtgggccgcaggagcctctgacctggatgctgccatccacaggcatgttgtcaggtgctctgctgcagcaaatggaactaactgtcccctgttcttggtgtcacctgctatcatcatttctcacctggcgttgatctacagcattccagatgtttttcttgtcatgtttcctacagcctattcttaacacagaaactggattaatcctcataatgcataaaacggttcatgtcactctctgataaaaactctccagtcacaaccaattacataattttgggggtccattgcataatgtaaacatgacacccctgtcccaaaattgagaatttcaggatggtaaccgtagagccttaaaccaagcatagggacctgtgcagctgcacaggtcagaggtccatggagctgtccccacctccattggcttccattgtcactcagagtaacagtggaaggcccaggacaccctgcaggattgggctccctctggccagtctggcctcctgtctcactgccttcccctttgctcagactacatcagtcactgtggcctttgtgttcttctgcagacacatgaggcatgctgtcttggtacctgacatttactgtagcttttatggggacattctcattctgaacccgtgctgcccattgtggtagtcacgagccacttgtagcgattaaggccttgactgaggtgtgctttaagtgtgaagtgcacatcagatctggaagacttattatgaaaaaaatggaagcgctttcgtgaatcaatttttagtttgattatatggtgaaatgaaaatattttggacatatcaggtaaatgaaaatgaatttcacttgtttctttttactttttttaatgtaattactagaaagcttaaaattacctgtgtgactcacattatgttcctattgacagaactgctcgaaatagccacatggctcatgcctttgcttctttcaggtctctgttcaaatagtgctttgttacaggccttttttgtccatcctgcataaaattgcatgaccacccacattcctgccctctgtcttctctcatccagttttatttttttaattagaacttttaaccatttgacaaatgtgtttttgtgtgtatatgtatttttaaaatttatataatataaataaatatatatttaaatatatatattgttcattcatattactagaatgtaaattccaaaaaggcagacttttcccccgtatgtttagtacccaaaagatactaaatgcttaataaatatttgttgaatgaatggataaatgaacttgctccagagttaaagtcttgggtaggagcatttgattggccaaggttatgttacatgctcaccccctactgccaggagcacttgttcttgtgaatttgattcaaggaccgagctatgcaaagatgacaacagtagctggcattcatttgtttcggtgcagaggctgtgattagattatcaatgcattctaatatctattaggatattccccatgattttgtcttttcataagtgagttctgtaatctttcttaaactctgagagccagtgagtctcttcctgttctgttatggtcagccagagcctaaatggtacattcatgtacagaatagagtctgtcacattttaaaaacaaagttagattcaaaccaaattatagaggctttaccaaagagttaaaagtagagacactgcattcgttagaaactctcaggatattggtgatttgatgaatcatattattaattcatttctgtagagctcttcatggacaaggtcctggtcattggatcctcttcctcttgtagcactagctaattgacacagaaatttagaagagagctcaggagagattactaaggacccttgaatcaaaggggctgtctaggatacgtgggaataacagagagatggttatagtagcctgtcttggagcatgttctaaggattcagaagaagatttttcatttaaaatctccggctgcaaataataacaaaagcttacatttattgaacttgcttatatggaacactgtatgctgactactctgtttactcatgtaaatagtgcttgttacatgcactgtttacttacttttgaccactacctagtgagatgggcacaattattaatctaaggaattgtggaatattgaggcttatggtaagcttgcccaagatcacatagcctagataaaagtgttttttgtctttaggaatatataataaaataattaatgtaaattaagagaataagcctttttttaatttcactttttaggatgatgacaccaggtgtgagagtgaattagggaaaaatatcacacttgttcattttgtcagaagttgagactaagtgcgctcattcttgaggaataaatgacaacagttttctcagtgaatattttgggatggcacttccaatgcataagtgacaaatgaccacttttgccaatgcaaatgttttgcagaattttaaacttccctccacagccagactcaaaagtttgggaaccagtttggaagttctagaacaaaaccagttgtatattatggctcctttcggcaacatgattatgatatcacttgttgaagtcatgtagataatgggtttggaaatgtttcatgtttatttggagaggttgctcagcttcaggtttttaaaccaagtttaccaatacatttgggaaggaaataaaaccactggcaatgtagcaaagccacaggagctctattatacctgcaatgtgaaagggaaataatccctagagaagtgatgcatatgatttagaagctgactcaaaatgtagaaataatacaaaaacgaatgggccaatgaaacattgtctttaagtctggagactccttggagcttagactgcattcagcataattggctgttttagggcaggcttggattggaatagcataagctttggattagggtgtgttggcatggaagaataataagctcatgtcaatgtcagacatgcagtattacttaatatttctttctcatagactctttcgcaaccctgttttgatgccagtagaactaggtatgctcctttcctggccacgtttaccctggcaaagctaggcttgcatttcatatctgtcagctttgccttcagagctctgagtctcagaagtcttgtgtgctccataagccatgtagacaggcatggacatgatgctctaagcatttcatcacttgaagaaggaagtgaggctgaataaacagaaaaccccaggtggaggagcatctctgatgaagcttttgtgggaagacagagatcatctagagtggatttttggccctactaacatacttttggctgtactctgtaattccaagacatggagttctcttagcaggggacaaaaatgcacatgtatgaaaagtgtttagtgaaatgttcccgtggggctgtgacattgaaatcagaagagcggtatggtttccatgctgcagccatagttttctgttcccatacctgaatttaaactgtaactgatgaagtgctacctgactattgagtttttgtaggaaatgtcataaaacctgatgacattgtacatttggaaagtgtataatgcccaggattttaggacatggtagcattatttgaacccgatcaaattcagactgttatgtaacacatagattcttacagcataaacttgctacccacgaatttttttaaacccattaaaattggacaaaaattctatctccattttctttctaggccttagtcccataaacaatgtgaatttatagagcagaggtactttatttattaaaggtagaaaaacagatggcgatctctctggaagccaagtccactggctgcctactgaactttgtggattgccctgtgggttggaaaaggtagagaggggtgaatggagttggctcctgggagtggtgtatatggacctttccacttcagcaggttgattttacctatttggaagtatggtggtgaaaattctgaatgatgataacctcaggggtaaggacactgtgggattactgagtttcttctggaaaaaaaaatttttttatagtaatacctgagaagatagatacagaacatagagatttccctgttagtgtaaaattgaagtaaagtgtggaggactttttgactcacttgagctctttctcagtgtttaaacatctagttgagcttttatacttattattggcaaacctcctaattttttgaacatgtgcaacatcatattcatttcacatttactgagtgtttcctatgtgtcagtcagtcaccactgtaggtcctggaggttcagggagaaatgagacaatctccagtcctcaagaaactgacagtctagttgtggagacagacatgcataatcctaaatataagtgcagtggagaacaacatatggcacgttaccagaaggaaatcacttgatggatgcaaacagcagaagccacttctggctaccttaagcaaaagggaattttttgtaagaatatctggggtcccaatatctggtctgtagaaccagattggggatgatcaagaaccagggcagccctaagagaccaagagaaggcaaacaccactttgatttcataaccaggagtgtctggtcagctgtcttttctgttgacggctgctctccctcaccctctttcctctgccctcacattgcactgtcagtcaagagtcaaagtcctgggacagagctccaaacttcacacaactgactctcattggcaggatctaatcagaccctgcctttataagagtctgggatatgtgactccaagctttacacttgagctttctgctctgtttttatgtcactcagggaagtctttgctgacactgcagtctgggggaggttttacactcttagagaactatttcttggttcagtttggaattatgcatccctttggtgaatgttggctttcctctcagggcttgagtgccccaaccataatcatcaagatacctccagcttctcgcaaaattcttggcatgtgatgctccttgatcaatgtgcattgagtgaataaatgagctcagcaaattctcaatgaatgagaacttgggagaggagaaattgctttgagatctacttctcacccaagaatattgttagctctgaggagagtcatttgccccagcaaaatgtcaagcccactcttgttcccagcacggtatgttctgtgtaggctgcaagatggaaccataccacgaataataaaacacagaagaggaaatggctgttgctgtacccacacctaacatctccagccttggttctattaccctaggaaggtaaaaagggatgaaggtttgagtaagggtgtttcgccactcttccttcattttcctttttaataaaaagaaatgtggtatttacagagaatatcatcttattctgcaaagagaatgcttccttctctagttctcacttctaatttattggattgttaggaaggtgatattttatgagagtgatacaatgaaatttctggttatatgtggtcatttccaattatttgcatttccatgcaaataattatttttataataaaatgattatattatatactatttcttgaacccttactgtataccagacactgcactaaatgatttgcatccttaggttatgcgttcttgtaacagacctaatggcttataggcactatcataatcttggtttttaaaatgagagactatggtttagagaagaactcgttcagagtgacgtggcaggaaagggatggagctattcttaaccaccacactattctggtgtttttcctagtttatgatcctgcttccctcatgagacaagtgggatcattaacttttacagattagctaaactacaatttgagcaacatacctgaggttgatatataagaacccctctttttaggacaaaaccagcagagatgcagccactaaataatgtaattttaaaaaagtagggaacgaattacatgaataaaatataacaccaggtctgtatttaaaaatatgataagttatatgtagaaaaaagaaagattgtggtggctttcaatatctgtttaatttttcttcccccagaagctctttatgtaccattctaagattgttttactgcttcatttttaaaggattgacgtgtttgctctgttggtagtttccctttcctttggttgttggcttaaaggactgagacctcaaaagatgatttgagacatgtaagcagctttcctggactagacgaaggtgaactcttgagttgggagatccctcattccttgccaagtccagagtggaaacggtctgggaagctgctccactttgcagtgagctgttcacataggtctgacctccttggtgtaggcaaactcactttgcatctgaagccaggaactagcctggtgtcccagggattgggatcacaactagggtggccatgggtctaaggcagaggttcttaaccagggcctgtaacagaggcttagaacctccctactcccctgggaacatttgctaatgtctggagatatttttggttgctatagctgggaggatgctctaagcatctcatgggtagggtctattccaggggtgctgctaaatgtcctaatatgcagaggacacctctgccccccaataaataatcatccagagaagccctggtctacaggagtcctttccttcttgtgtaaggatcactactgatcttggttctctaggccccctgccttgaggtagcatttcttaaaagtttttacttagtataacagacctttctcccacctttcagtattatctcagttgaaatgcataacatttttacctgcactttttctgtggcattattttaggcagcttacagagttgaatttctcgtgtatgtttgtgtgtgtgcacatgagtgtgtatggtgtttggactgttactctttctgtctaacaattttcacatatagtaatctatacttatatatgtgagtgtgtatgacactcttgaaccctgaaaattattgcaattattaaaactgatctgactattcttatcatgatatcgactaatttgttaggggggtgctagtcaggtgtagtacagggaacatgtaataggaataaagcatctgattgagacagaacagagatagcccacccagcagataacactcagtttaaatttctttggcttaataccagcattgcagtcatttgaaaaatagtgacctttaatatgactttttttcctgactgaaaataaaaacactttattttatcaaccttttgggttgaaaatcttatttctatattcacattaaatatatcttttcatacatttgatctagtcatttgggatagggtaaaattttctgttcaatgtagattgaatgtagatttaactaatacagtgcctaaaaatttgcaattaaaaagtataatccaggttagtgtttgtgatttgccaaattcttttgaacagtgtctttcctggtttggaaaatataacaaaaatctaacttaatatattacacagaaagttatttatatgtattttgtgttggtagggtagcagtatgtcaccggacctaagaataggcatctttgctcttgcatcctttaatacagtgtgtcttgacagcttgcttgggggttctaacaggggagcacagctactcgtatgcccttgactgaagatcggtcctcctctattggggatgtcgtcctctttgaccaagcatgtagctttgggagggacacacatggagtggtgagggaggaaggggacacccgcctaccagccagatcagccgaatcaaccctggccatcaatggggtgacagatgttgcagccagattgccctcacatccaatacagtgtgtcttcatcatggtgcgaaggtgatgccaagggttctagtgctaattaaattccacagggcaagtaatcaccaacagtgtatggctgctgcacttggctggaattatttgccccaatgttggtgagatggtttaggaaaaaacatcttggtgactttaaccaattgatcgatactgttggtcagaagtccattttgctccaatgaatgatattcaaaagtcactttgtgtgtgcttcatgtctcttggatagagattgtggcttccatggtaaaactaagctcctttgtgaagcaacaaattcagtagcctcctcctttgtatacattgcttttcttctaagggatttgaaattgtccttctcctagagatgacattgatgaaatggtattttattatcaaaggaaccaaagctaggaaagttaccctctaatggaacaattaaagagagtcagggaagcctgcccattcattcatccattcattcagcatctacaggcactgtcttcacatagctccatttttcttcctttgggctctagtgtacacaacccaatattatttgattttaaaagacatgtaactttggttatgctgatgaagcctggacagtcttgaagacaggaagacatgagacaacagtaaacctggaagagacttgatggagcctcctagtccaacctcttcatttctccactcaagatatagagtacctgagggatgatgtgacttatgtagggtcatggagctaattagtgacagagcctgggctgtactcaagtgtctgaatctgattacacttttcctttccttctttccatgtccctatggcatatgaggccttgggcaccattgccctactctggcctgtttgtttgcctgccctcctgctgtccagccatccaatagtccacattcagcatcggtaatgagctggctgcctcaaaggtactggggatacatatattattgaagaagttgtaatttctgcccactgggaactcagactcatggagaaaattactaaataggcaagttacaggactgtagatgatgtgtgctctatcagccaggtatactacacataggaggggcacctcacctagccaggggagtgggatgaataaggaggacttcctggaaaagataatggctaaattgagagatgaggggctaggagtagtggtccagtcaaagcgagaatagcatttgcaaaggtttggcaggaagaggcagcacggtgcatttggtggaattagaagtaatttaatatagctggaccacactttcttggcccacttaggaaacagatttcacatttcggagcttttctattctttacgtcttctagcaatcaaatatattttataattaaagttggagagtcattttgacttctatattataaatgttctagtcctttgtgacttgcaagtggcaataacaattatcagtgttatttaaaaatgcagttcagggccagatcatgctgagaattgattctcgttcaatgaaaaagctgatcccacccaggggaggcaaattctcttttaaataaatatttgcttctgggttaagaccttatattctatactcaatttcactatgatggatttttttttttttaaaaaaggtttgtttataattacttgcaaaattccttgaagatttaaaataaaaatgcccagagtgccctgaccacggctgctaccctaacgggtacaggcatcttgacacatctgtcaatccaagctgccagctattgcttatagtttttgaaatgggattagaggtggttgagcctttacatatttcagtctgcagatgattctgtttttctccctacatactcccaggccatttgatttaaatcaaccttatttatgtgggaaggaaaatgttctgtctttttttacttatcttttgtttgccaatggactctgctttgctgtgaagaattttacacatatctatattggcatttatcatgttatattgtaagggaagtccatgattcaaaatgtctataatacctgttttagtttcccataagtataaatgtaaagtaagggtaatgtgttcttgtggggcatattgcttcacagttactgtgggtaatagcatttttctactgttctgatactgcagtctttgtactttgtactttcctttgtactcacctgattatactacaacttctgcagactaaaatatgtaactgctttaaacagactgttttcatggaagttgtattctaaattaatggcacaaactatatggcaatttggagcctttgtcataacatttttatcatacctcctttttagattgctgattttgagaaccagcagtagcacccacatataatcagtccttagataatacaattatggtttataaaagtcatttataactctaacaaaagtactgtggtagatagaattctaagatggacccctgagctttcccacttccctgttgtatgtgctttgaataatgcctgggactatgaatatgatggatttggaagtgaatttttccctagagcctccagagagatgctcttctggctgacgtcttgatttcacccttgtaataccccaggcagagaccccagccacaggcagagaccccagccacaccttgacagacttctgacttacacaactgtgaactaataaatggatgttgttttaagtcatttggtggcattttgtcatacagcaatagaaaactgatgtaagtacatgttaaaataacttttcagagttcccaaacctctcatggaaattcagaggcaagtaaacagtagtagagttcacaggatactgacaaagaatgctgctggtccactaaagtggcaccgctaggaactaaagcagttttcaataccttgactgctcagcatagaaataatggcagtcttcccacacaataatagtgggagaccttaacacccaactgtcaatattagataggatcattgagacagaaaattaacaaggatatgcagggcttgagctcagctctagatcaagtggacctgatagacatctacagaactctccaccccaaaacaacagaatatatattcttctcagtgccacatggcacttactctaaaatcgatcacaaaattggaagtaaaacactcctcagcaaatgcaaaagaactgaaatcataacagtctctcagaccacagtgcaaccaaattagaactaaagattaagaaactcactcaaaaccacacaactacatggaaattgaacaacctgctcctgaatgattcctgggtaaataatgaaattaaggcagaaaccaagttctttgaaaccaatgagagcaaagagataatgtaccagaatctcaggaacacagctaaagcagtgttaagagggaaatttatagcactaaatgcccacatcagaaagctagaaagatctcaaattgacactgtaacatcaaaactaaaagatctagagaagcaagagcaaaccaatccaaaaattaactgaagacaggaaataactaagatcagagcagaactgatggagatagagacacaaaagatccttcaaaaaaatcatgaatccaggggctggttttttggaaaaaaataaataaataaataaaatggaccactagctagactaataaagaaggaaaaagagaagaatcaaatagacataataaaaaatgataaaggagatatcaccactgaccccacagaaatacaaactaccatcagagaagagtacaaacacctctatgcaaataaactagaaaatctaggtgaaatggagaaattcctggacacgtacaccttcccaagactaaaccaggaagaagtcaaatccttgaatagaccaataacaagttctgaaattgaggcagtaataaatagcccgccaaccaaaaaaagcccaggagcagatggattcacagccaaattctaccagaggtacaaagaggagctggtagattccctctgaaatatttccaaacaattgaaaaggaaggacttctccctaactcattttatgaggccagcatcatcctgataccaaaatctggcagagacacaacaacaacaaaaaattcaggccaatacccctgatgaaaatcgatgcgaaaatccataataatatactggcaaactgaatccagcagcacatcaaaaagcttagctgccatgatcaagttggcttcatccctgggatgcaagtctggttcaacatacgcaaatcaataaacataattcatcacataaacagaaccaatgacaaaaaccacgtgattatctcaatagatgcagaaaaggcctttgataaaattcaacatcccttcatgttaaaaagtctcaataaactacgtattggtggaacatatctcaaaataataagagctatttatgataaacccacagccaatatcatgaatcggcaaaagctggaagcattccctttgaaaactggcacaacacaaggataccctctttcaccactcctattcaacatagtattggaagttctgaccagggcaatcaggtaagagagagaaattattcaaataggaaatgaggaagtaaaattgtctctatttgcagatgacatgatcctatatctagaaaaccccatcgtctcagctcaaaagctccttaaggtgataagcaacttcagcaaagtctcaggatacaaaatcaatgtgcaaaatcacaagcattcctatacaccaacaatagacaagcagagagccatgaatgaacttccattcgcaattgctacaaagagaataaaatacctaggaaacagctaacaagggatgtgaaggacctcttcaaggagaactacaatccactgctcaaggaaataagagaagacacaaacaaatggaaaaatatttcatcctcgttaataggaagaattaatattgtgaaaatggccatgctgcccaaagtaatttagagattcagtgctattcccatcaaactaccattgacattcttcacagaattagaaaaaaatactttaaaattcatctggaaccataaaagagcccatgcctatgtagccaagacaatcctaagcaaaaagaacaaagctggaggcattatgccgcttgacttcaaactctactacaaggctatggtaaccaatacagcatggtacaagtaccaaaacagacacatagaccaatggaacagaatagagatctcagaaataataccacacatctacaaccatctgattttcaacaaacctgacaaaaacaagcaatggggaaaagattccttatttaataaatggtgctgggaaaataggccatatgcagaaaactgaaacaggaccactttcttatactttaacaaaaattaacttaaggtggattaaagacttaaatgtaaaaccccaaaccataaaaaccctagaagaaaatctaggcggtaccattcaggaaataggcatggacaaagattttatgatgacatcatcaaaaacaattgcaacaaagcaaaaattgacaaatgggatctaattaaactgaagagcttctgcacagaaaaagaaactatcatcagagtgaacagacaacctacagaatgggagaaaacttttgcaatccaccccttttacaaaggtctaatatccagaatctacaaggaacttaaacaaatttacaagaagaaaaacaaccccatcaaaaagtgggcaaaggacatgaacagacacttctcaaaagaagacatttatgtggccaacaaacacatgaagaaaagctaagcaaagctcaacatcactgatcattagagaaatgcaaatcaaaaccacaatgaactaccatctcatgccggttagaatggcgattattaaaaagtcaagaaacaacagatgctggtgaggctgtggataaataggaatgcttttacagtgttgatgggaatgtaaattagttcaaccactgtgggagacagtggtgattcctcaaagatctagaaccagaaatactgtttgacccagtaatcccattactgggtatatacccaaaggaatataaatcgttctgctataaagatacatgcacatgtatgctcattgcagtactattcataatagcaaagacatggaatcaacccaaatgcctgtcaataatagactggataaagaaaatgtggtatatatacaccatggaatactatgcagccataaaaaggaatgaaatcatgtcctttgcagggacatggatgaagctggaagccatcatcctcagcaaactaacacaggaacagaaaaccaaacaccacatatactcactcataagtgggagctaacaatgggaatacatggacacagggagaggaacaacacacaccagggccagtcagtaggggcaggggggtcacaggggaagggagagcatcaggaaaaatagctaatgcacactgggcttaatacctaggtgttggattgataggtgcagcgaaccaccgtggcacacattaacctatgcaacaaacctgcacgttctgcacatgtatcctggaacctaaaataaaatgcttttttttttttaaaaaagaaagtagtccatgtcagaatatcatgaggctgggcacggtggctgaggtggaaggattgctggagcccaggaatttgagagcagcccggggaacagagtgagacctgtctctacacaaaattaaaaaattagctgggcatggtagtgcgtgcctgtagttccacctgttcgggaggctgaggtgggaggattgcttgagtccgggaggttgaggctgcagtgagccatgatcatgacactcgctgaagcctgggcaacagagcgagaccctgtctcataaaataaagaaaaaaaataaataatgggagtcttgatgatgttttacaattttagggggacccggattatttaaaaatgtatgcataggaaatgagcctttattacagctttcagattgtagtattttagataaaatacctaagatttcctaaaatgctatgttgtatctttatgtctctctcctcattaaaccctgagttcagcaaaggaagtgactgagtcttagtcattcttttatccttagtacttagcacagtgctggcatgttataggtgcttaataaatgttagctggaaaactgaaatgtaatagattgagtaaataaataagtccaaagttctttttggattcagaatgagtaaataaataggaatggctgtgttccaataaaactttatttacaaaaacaggcagtgggccagtttggcccatgggctgcagtttgctcaactctggtgtagatcacaagttcttacagcctctaggcaactctatcatatagcaaccttcatggcaagtttgagattttaaaagtgtactctaaatatttaatagagttaaacaaagttcacttcttttccagactatatttactgtttgcctcagacatcctttctggtgcaaagggaagtaagtcgttcgttcccaagggtgaggtcttccttagtttctgttgcgttctgtagcttttttgtgaataaagtctgaatgaagcaaagctaagcaaacaggatgtgcttgaatgaatagcactcattgacatggagtggagatatttctttctttagttattaaaataagaagttaaattcttaaggtcacatatgatagactgatttataaaagtttatgaagggcggcatacacacaccaaggctgtctccaaatggaatgtctgtgaacttgtgaacagctgagggcatggacaagggtggccaggtgggaaggtaggaatagaggcaaaggtcctttgctgcagttccatgttaccgacacgtttcttagggcttgcccggtagtgttctttgggacaggtagatggcaggtatgaaatgtcaggtagtcaggggaaaacaaacatggggcatttgaccagagctatttaacctattgattctttacctaggaattcattctaggaaaagattgaggatgtaggtattgatttagctacaggcttgttcacggcatagttctttaaaaaaattttttttccagatcagtgaaagcattcccaagtggaggagtaactaaataaatgatggtatattcatacatggaaattctgccagtagacatgatgttatagatgagtatatttatgagtatatttaatgatatagaaagatattcactctattttgttaatggaaataaactttacaatatgtatgtacagagaagtatcagaaaatgcctattttcccacaccctcaacaccactttatagtataacctgatttttattttaaaaactttatacacagacataacttatgcatacatacatgcatgcttcagtataattagtttattaagggcatgaactgtgacaggcctggctttgaatctcagtgttgttacttaaggtctttttaatctttggcaagttacttacatatcctctgcctcagtttccctgtcattaaaatgaggataagctcacctcttactttcagtctgaatttttctcagcatagtaggtgttcaagaggtatttgttgaatgaacaaactgaccatcactgttggtgctcaataaattattattttatacaaaaaatccgaacttaaatgctaaactcctcaattttttaagagcttggaaagaaaatgaaattatttcacaaagataatttttaattgctttttaactttactaatagtgaaattcactttttgtggtgtacagttctatgtgttttaacaaaaacaaagtaatgtaagccccttcacaatcatgacacggggcacttctgtaatcctcccttgtgctgccctttgtggtcaatctctctccccagcctccaatccctggcaatcaccagtttgttccccatgccttgtagttttgccttttctagaatgtcataaaaatggaatcatcctgtatatggatagactttcgtgtctggcttctttgacttagcataatgcattgaaactcatccatgttgtagcttttatcaatagttcattctaaagaggatactcttaaagataactctgagagtaaccttgttgtttatgaaacaatctctgtcataaccatatgtgtctttcatccctgaagttattccgaagccagagttggggcagggtaggatgttggcactgaaaaggactggagaaacaacctagtctccgtctgttgagaaggtaagattttctagtctgagagccagaaatcaaatgcattaccccaggtgagctcaagtcagagttgagaccagaatccagagcctttgatggtaaacttgcaaagttacatgggaagttaggtagggtcaacaattctggtggtatactaatgataaactccctaaagggcagggaaaggcatgcatatgtgtgtttgggtgtgtgttcatgtgtgtgcaatgggttgtgctgaaacgatagcatttaactatttttaaaaataaaagaaatgagcgcttcttgttttagaatgagaaaaaagggccttgtatcattattattattttttgtaatcagcatgagtttgtgcaaatccatcttcattttctagcattcatagtaagcagtgaatggtttggagagtgaccagaggtatcatagatgctgctttcacccctagagcagatagatacatggtaattggccaagccttttaaatgtgtaagtttggcctgataagcttcagatccccacagaaaattcacaccagatcttgtacagaggtgtacagttttgccctgaagcctgaactgaaaagagttctcttaccgtttattatttatcctgtttatttttcatttctaaagcaatagtacttctttattttaaaataattagcttacatgtaagtaccatgttatacttcttttaaaaaagaaacagtatagcctttttattcttaaaaatcaaattaggcttttaaaaatgggatctcttgaatctatataaaatagttatctatttttattgcataagccaatgaacaaaataaacatttaacattaacaaggaaaattaagatttatggtttataatatgaaatgcagaaaaaattctacacatagcatgaaatgtttatttgctaatttaagttggtcacggtaatgtgcttatacccacgtgtatatcagctaattttcctttgcattattttaatcctccattttaaaatactttttatagcagtttactgaattacagatacagaacttagttaagcacccaaggtaatttatgtatttcttctgtttacagtaactttaacttagatttctggtaaacatggcaattgtcataaggaaatatatgttatttgctatgttcaaatttaaactctcagaaactgttcttgaagaatctttggtttagtatttcatttccattcatagtccaaacatttgttgtatgtttctgtgtggtttatatattttttctcgtcattgccacaagacctttatttagaattttaagctaaatatttttttctttgaataattcatcttttaaagtcccttcctttcttttgtagagtctctatgatcaaggacatgggaactaaacaaacactgtgctaagtgttatggtagctgacaaactagtttggttagataagtctcccaattgcagtgtcagcatgcagactagtctagtccagagagaaaagcaggaggtagaaaatcacattcgaaatgcttacaaggtcaatagagaaagagcctgagacaccatccctgtgttgaattgaaggaaaaatcaagaatgtcaattttagcgattgaaattgtcttatagagcacaggaggcactaatttgctcagacatctttgggcaaacttgcatgtagaatctgctagatcctgttattatttatgtgcagtcgtgcctgcagccagagaactatctttctggacttgcttctttctaactgagaataaaggcttgaggaatataggagatgtcagtagcaacaagcaacttgaattcctcaagataaagaccatggctgggaagaattgagcaggcaagtggaggttactgactctgcattaataaaaaatttacgagagtgcagaacaaatcatgccaggccatctttatcgttttctaggtggatgtgcaagattaaagaaaggaattcaatagctgtaatatctggaattgagtaaatcatctaattcagtgtctccacaaatctttgggggcagtaggggcaggggcagaagagggggagaccctcaatgagaattggccctgagcactgtcatgtggattcaatttggctgttgtaataaattacaatggaacagggtccattgggacgatgttgggatcaatagaaggtcaggctgtaacatctccagcagtggtctggaagaatggataacatactttattaagcttggcaggccaggaggttttggaactgttgtggtcactgccaccgtcattagcctttatgaagcacctgttgggtatggggcaccctgtgggttgttagatgaaagacagaatgtgtatgattgcccaaatggtcaacctgtctaaaaatgatgataagtacaattcattaaatacttacaaggctgccatgcatagtactaaaactttctcatggattgtttcttttaatcctaatgacaacctttaaagggtgggggtttcttcccattttacagatgggaaaaggaaagtacagataattgctgtggataatgcagctgattagtagcagcagtaggtaactgaactgaagtagtctggattttactcttaaccattatctgtggatatagaaatcttcatgtgcccatgggagaaagactatgtttgtttgtcagttccttcatttgtgtgttcattgagcaaacatattaaatgtacataagacgttcccagtgtagtagagatagaactcattctaagataatttttttaaaatggtaaaattatgactttgatacagttataaaatgaacacatattaaagattttacttaactcattagtcagctgaggaaccaggcagatgttagaactggatagagaattcagagaacagacacatttgtagatcaggaatattgaaatgaatgtgcaaatgcagacaaagctggctttttcccaagtgcagagggaaagtcaatataacctctactggacagctcagaatctgcatgtttgtagacaggaattattttcattgccatcggttatttacagtttaccaagttgtacaatagctaaaagacaataaaagactagaaccagataacttgaaagggtatgatctgaacatttattttctattgaagcacagttttttgttttttgttttttcctacaacactaaaggaagaattgtgatgtggcacaatgggatatgatttaagataaaagacttaaatacagagaatacatccaactctcctaaattgtttagagaggacttctgggcaaagatggaaattaaaataagaatctttgagcccaaagacacctcagttttcagatggggaaactgaatcctagagatctgaagtaagttgtccaaagtcacttacttcctgtagctgattagtagcagcaataggttatgaactgaagtagtctggattttaaccattatctgtgcatataaatatctctatgtggccgggcacggtggctcatgcctgtaatcttagcactttgggaggccgaggtgggcagatcacgaggtcaagagatcgagaccaccgtggccaacaggtgaaacccccgtctctactaaaaatacaaaaattagccgggcatgttggcgggcgccaatagtcctagctactcaggaggctgagacaggagaattgcttgaacctggggggcggaggttgcagtgagccgagatggcgccactgcaccctagcctggtgacagagcgagactccatttccaaaaaaaaaaataaaaaaaataaaaaaaagatatctttatgtgctcatggagaaagacattacaagagcacatgaagccttataattttctggctttctatgatcccctcattgacccttagccagggagagtgggtaagggccctggaccaaagtttctgtggtagagaaggaaagaccaaatgcattagacagggttctccagagagacagaaccaataggatgtgtgtaaataaagaaagaaagaaagaaaaagatttgttttaagaaattggctcatgtgattatggggactttgtgaatccagaatctaatgggagaggctggcaggctggagacccaggaaagagttgcagtttgagtccaaggctgtctgctagtgaaccgggaagagctgatgttgcagatgaagcctgaaggcagtctgctgaggaattccatcttgcctatgggaggtcagccatttgttttgattggatgaggctctcccacattatggagggtaatctgcttacttaaagtccactgacttcatgtgtcatccaaaaacactctcatagaaacatccacaataatgcttgaccaaatatcttggtgtcgtggtccagccaaattgacacataaaattaacagtcacatgtcaccagaggactgagagacttcgtcttttcagaagtgattggggtggtggcagagttggtggggatgacactaataccaggcacctggagtgtggtgtggtgagcaatcagaaggttgtgaacctgaaggtaaggcttttccaacctctcaactttcccaagagccagccgttggattaagtccaagggtcgtaacagttacagagaccacttgcaggtctgtacatctaccttgtcagggtatgtctccctaaaagttaaggggaggcatgggttcaggaggggttttctggtagtcacaacttgtgagtatgtttggatatcaggaattataaccagagcacagctgtttatcaagtgcaggtatcttgctacagaaatttgtaatatgaattgaagatttgttttacaagtgcttctctgaaaatcacattgattatatcactgtaaggatacctgacaaataataatcaattaattggagaagaatttaatgtggaacattatgtaatgttatttaaaattctcatatttgaatatttataccaaactaaagaggtagatcattatatttcttacctttgtctacttgttctttttttttaaccatagtatttcaccttttaatacaatctatcatttactcattaattatatttatttttcatctgcctccctctgttggaatctaagttttataaggacagaatcattgtctgttttgtgtactgacgtatcccaagtgcctagatcggcatccaccatgtaacaggagcttaatcaatacatgtgaaatacaatgaatgattatcttaatcttcacaacacccacatgtcagtgaggtaggtactgtttggattccagtttaacagatgaaaacaaggttctgggaagttgctttggtactgcattttaggtacatcttaggcgaaagaaccatgcagctatgccagaacacaacccagtcagctggggtcttgatggaggctttctaattaagaagaatacaactgttctgaagattttataggcccaaagcaaaaccaagaaatgagtaagcaatgtggggcctgatgctgacacattacaagaaagaaagaaaaattaaacaagaaatgttaagataaggagttattatttaataggtacaaaattttagttttgtaagatgaaaatcattctgtggatggatggcagtgatgactgcacagcaaacaatatgaatgtacttaatgcccctgaagtggacacttaaaaatggttgagatggtaaatcttgcttgtatattttactgtaattagaaataaaatataaaaaataagtgttaagatttagagccattgtttaatggtgtgtttgtgggggaaggaggagaaggtaagaaataaaaggatcttattggggaaatgggaggaagaaaagacctgaggttaaattttggcttatctcttttttaactatgtaggttagacaagttccttacccttctcaaccttagttgcccccatatctgtaatgaacatgatcatggtacctacctcgtagagaagccatgaggattcatggagaatgagtgaaaagagctcagtacaataactggcgcctaatgaatccttttttaaaaaagagtatgcctattgaccagggaaggtgtcttcattcattccagtctcttaatatattgattggcttttcaataaagcagttaagtgcaggattgagagctctaagagaccaaaaccggtcagagagcacttgtcacatcatctcgtctattctcaactcagagggtattaagtaacgtccagctattaccagcacagatctctcaggtcttaaagattgacacctatgtccaagtagtgctaggaggccccaactctctcacaaggcccatacataataatgtatgatacataatacatacatatttgggaaacagattttgtccagatcagcttcaaggacatgacctggtcagtgttgttcatttgtgtctttcttttctgaggtggttggtggagaggccactgagttgtaacttttcctttcttatctggggcactgagaagtaggtttctcctgtttctcaagagaaacaaagtcatagcaagcatgcaacaccctcatgacattgaggaaactataaagaccaaatgacatttcatgtcttctttccctctctttatggggactttcataaattatctcttagcaattgagcagaccaaaccttatgtcctctagggacaggtgttcaaaagcatttgtctccagatgaaggaagaattgtcacatggcaaaggttaagctcttggtctggtgagacaggatggactgagggttatgtggacatcactcagtaaacattattacataccagagatgaatttgctggaaagctaatggtgcttaagttcatgccccctcctttgcacaagtctcttccaaaactctggcagtgtattctcatgtttatgtttttgtaaattttgcaaaagtaagatttttctttaaagaaaccccccttccacactcctatcaaattcaggccccatgaaacctggagccacccaggctgttatttgttgttgaaatgtgggcagacagaaccaaccacaatgtggcaattctcagcatgagggcatgcaagtgcagatagagagaggggagactgagagtgggattggccaagaagttgggatggaatgaattcactgaaaataagaagagtctctctgcagctgtgttgtactaatgatggggctgataggcccccggagagtggcagatttggaagccagcctccattacctctgcagtttgtctgtctcgcctgttatacgggacattctagtaggaaaagctctgcttgagctcttcagggcagacttaatgactaacgtcttttaagtaaaatttcctctgaacaataggagctaaggttgtatatcagaaccagacataaatatatttggccatggattacaataaaatttactggtgctaaagataatcaaaccatttcactttccatgtattttattgtctgaaaaaaaagtgatatcactccttggaagggaggaaaatgacttgcttcatttgctattctgctgggagtgaaaatctctgaaactcaaaggcaactatgactgtcttttctcccctaagtctgccctccccatcagggaatactgccatcccagctagaaggcaccagctcaggttgttctttcagcctacccaggttttacagcacaaaagctgtatggcattctctttgctagctggtggaaagaggcaaactgttgagcagatgttgattaacggggcccaggtcgccgtgtttggcatttcagtttaagtttagtggggctttgatagtgtatacacagagggcctgtgtctcgcctgaggtaatgaatgctgcaacctaacacgcgcattgtctttccgagcctcagtgttgcaatattgaattacatcgcactgccatgagggctgtgagcctctgaagaccgacatttggcccatgtcagatcttaatcgctttttgatataagactacatatacagagcatgagggcaatttttgaatgacttaataaaaatggaagcatcttgaaaacaggcttttgattgttactgcaacagttttctccaacttgcttgcttgagtgttggcaaagcaacttgattgtaaatgcctttctaaaagagatgacccatattttatccacagacagtatattgaactagggacttactagttgtatggactgagtcaagttgttgtatcccttgaagccgcagtttgctcatcgataaaataagaacacagtatcttttccataggattattaggagaatgaaatgatacaatggatgttaaaagtatccagcaggggggacaaggtacccaacagagatgataggacgtaatagacatttgatacgttatatagccaatcatatttaaatatgctatcatatatatgaaaggcatttattcagtaatatagctgtattcccatcatgttccacatctagacttcattcatatgttatctcaaaattgggtgcagtggtttgaaatggagctatctctggaatttttactttgaaacccttgaactaaatctcccccgttcaacgatgtttgtttttccttattccaattcaaagcagattcatcactctggcccatgtgtgggcacagtcctgctatttctctttaagcactgcctgacatttcctaaaaagcaatgggtcgggaggcaggtactgtacacaattttagtaaaagaccaactttatatcattctctgtttttccagagagtataactttaagcctaagaacaaaatgggtgtaataattgccatataattgccagctgttagcaaagtttaacttactgggaacttgaaggaagtgtttacagatgattcaaaggtgtgcttttgaataaatgatctcagcctattcggggtgggggtggaccatgagctgcagctggtctgtctgcgtctttgtatctcctgtaactttgaggaggttacagttttattgcctggaattaagaggggagaaatgtaaactgcttcaagagctttgaagttttggttttaagggttaggctggttaaggttttacttaaaaaaaaaaagtcaacttcttcttaatgatgccaccttacattgcgaaggggacttataattttcatagtacacatgtttttccatttgatcccttccgtaaatccagtggagtcatcggggcagctattatgcccatttttgtagataaggaagctgaggttctaaagtggctaaacggcttgattgagatcctgagatagaaaagcaatgggaatcaagttttctggcttccagtaaataatgattccaacaataattgtaatggcaaggacatgtaaaagatcaggaaaatgttttatatgtcagttgttgagctaagttcttgatgtgtgtaactcgggtgccacctgaggtcatcctgtcctttgagatgtaaatacagcttacatgttctaccccacatccagaaagaagcccattcctccccacttctccccatccctcacagtctcctctttccagaatgccctccaggtgtgaatttccatccccgttatactgctcacttacacctcttttccctgtgggtctggttgttcagtttacccactcgtggcacacagcctcttccctttaacttctcctcttaccactcacacaaggcatgtgggctgagcagtctttcctgaaaccttaggttgggagagcagggcttataatcataacaaggaggacttgagaaagtggagcatcaggcttccttgattctgcacaaagctggtgctgcctcgccatgtggagtttttcatcagtcactttgcctgcttgtttcagcagcttgccatgtgttcagcttcttcccttacctacttttttccttggcccacctgactacctttcttcacactgtcagtcctaccccacctgaagagtgtgggaaagatgagaggctggaggtgtggtctgtcaggaggcagaggagcatgaagacacttcaactccactattttcagatagggtagggctgacagtcctatgattatgtgggaaagattagtactactaatagtggttcatacttccctaagcaacagcaacacttctctcaaaatgcaactcgggtcccagctcttaaaattccatttcccccttgctttctacatttgcattaactcttgtagctgcgataactaccttctgggataggtgttactattatcccattttactgtggataaaatgaggctcaaagacattagctaacctgcccaacacacacagaatttaaatatctcctcatattcactggtctgagggtcatcagatgttttcttaaagggccagatggcctccattgcaaatattcagttctgccatttgtagtactacagcaagtatagatattggctgggtttcaataaattctgtttacaaaaacaggtggtgggccggaaactggcctgtgggcgggagtttgctgaccctgcgcattagcatactgctgccttttcccgtaatactggctctctatttaatgtctctaaaacctaaagtggattgagaacagaatccaggacagaatccatgtggccacatcattttgagttctttttctttttctggctgaaagcatcttgtagcttttcacagagcaaacaggtctgcaatgactgttaagctacccatagggcatccttgatggcgcttcctctgaacttggttggagacatgctgggattttacagtctgggccaacagcacattactagaattgtgtgactgttttttgtagtttcttttaaagcgaagtggacagtgcatgcactgcctatatttctcaaagtctggttttctctctggggccacaaggacctaagagaacatagtttatactcaatttattgtgtctaaacaacagcaggagttgctattttctacatcttaggacactaactctgacaaataaatgtgaccaggttaaatttgtgtgtgtgtgtgtgtgtgtgtgtgtgtgtgtgtgtgtgtgtgtgtgtgtgtttgagatggagtctcactctgtcgccaggctggagtgcagtggcgcgatctcggctcactgcaacctctgcctcctgggtgcaagcaattctgctgcctcagtctcttgagtagctgggactacaggcacacaccaccatacccggctaatttttgtattttaagtagagatggggtagctgcccagtgtatggtgttgatggaagtcagtgtcctgttttgcttaagtctggtctcatctctgagctctggttctcaagattgatgttgaaaacaaagatatcttctctctgcaaggatgatttaaagaaacactgaaaacgacttttcacttcttcttttttggcatttcagtatcttacaagtgaccaaaggttgtctccctctctctctgcactcccaccccctttttttctaaaaaatatgtgtgaaggcagtccatcattatttgccaagtttcagtttagaattaagttttacagctggcttatcatgtaatcccctgcaaataggggtttgaaatgaaaaatgttaaaaccatcttaatctgctggtaaatgttttcattctagcacttatctgagttccaagtgggccttggaaaattattcttgggtctcttattgaatgtatgaatcatgaattgcattccttcccaacaagcagagcaaagttctggtaaagcctacagcccagggaagtgcttcattctgaactgtaaataggtcccacctgcctgtgtcttctgttgggtagaaagtacttttcaggacctctggctgcaggcatcagggaatgggtggggaatgggctttcctctgtgaaatccttatatgagtttctcatgtgctttccctaataactactactttagaagaatcaaggagctgttccagagctgcttctgcctacctaatatttctaatgagcaacttattgaaattcatttcacatgtatgtattgagggcctactatgtatgtgctaggtattgggaatacagtctggaatgagagagatggagtccttgcccccatggagctttggcttaatggaaaattagtcagtaaacaaaagtcaagctaagattccagagttaataacctgactgcagttgcagggagtatgatgaagcagtacaggtgttgagagaatatgggaggactcttcccttgtcaaggacaggatgtagcatttcagagaaaggagaaaagaagacaaggtgtttgctgagccagagagggtggagttgtggagcttagcagttcaaggacttcagtgtgactggagtaaacaggcagggtggaaaggaggctggcgaattaggcagggctaagggaaggttttgtaggagacgcacgcatttcacacttgaccccaacacttttccattgccttttgcttatgaaactgagacaaaacagcctcaacaatccaccagcttgtttctactctggtcccttgcagatcccagatccaactggagggcgtcccagactgagacagttgtatagaaatagctgcatggccatgggctctgtccttcccttgagtcttagtggtacaatctttaaacctattaatataagcatgttttactagtcacttaaaaagcttgagatattacttacatacagttaaattcctcctttttggtgtacaatctatgcatttaaaaaatccatacagtcccatgaccatcactgcaatcaacatatatgacagtttcatcatcctctagaattccctcatgcccctttgcagtcagcctcagtgccctggcaaccactgatctgctccttcgtcccaatagttttgccttttgtacagtgtcatataaatggacccatagatatgtagccttctgggtctagcttcttttgcttggcataatgtacttgaggttcatctgtatagttgtggaaatctgtgttagggttctctagaaggacagaaccaataggatacacacacacacacacacacacacacacacacacacacacacatatatgatgggagtttattaagtagcattaacttatactatctcaaggtcccacaatagtccatctgcaagctgaggagcaaggaagccagtgtgagtcccaaagctgaagaacttggagtctgatgtttgacagcaggaagcatccagcatgggagaaagatgtaggctgaaaggctaagcaaatctagccttttcatgtttttctgcctgctttatatcctggccgtactggcagctgattagtggtatccaccaagattaaggttgagtctgcctttcccagcccactgactcaactgttaatcttctttggcaacaccctcacagaaacacctaggatcaatactttgcatccttcagtccaatcaagttgacactcagtattaaccttcacagtatcagtagaccattcttttttattgtggagtaataatccattgcatgggtgaactgcagttgtttgttccttcacctgttaaagtggtccagtcatgatcacatggggcacctcttcacagaaatctcgcctgcttggctgtgggggcttcctatcagccgtttctgctttcactgtgtccttagcatgcgctcacccccagcagccagcctcatctttgtcaacacaagtcgagtcatgctatctctatgctcaaaatgctaaagccacctactgctttcagaataaaggtccttagcattctccaacatcctctatcatctgggctatgcctgccttactggcctcctctgtactgcctgcccccctttggccatttggaactcctttttgccttagggcccttgcattgtagttctccccagcaggttcttggtatcatctaccactctccttagatatcacctcctccaagaggtcttcgtgaatacccatctcacgtaactcagctgcaaacccccatcacttactgttccctgaactggtttatttttgtacctagcactttgtacttatcactgtctgaagttactacattttgtgtgcatttgttgacttgtttattgactgtgtcccccgttgtacacaagctctacagaggcagggaccgagtctggcttcttcaccaggtctgcagaggttacttggcatacaggaggaattaaacaaatattagctcaatactgaatgaatcaaaaaacatataaccaggcatattgagaaggaagatgctttgattttcttgttaatgaaacatttttcctatgctgtcttgaaactatttgattctcactgagactggacctgcggtgctaatagtatgtagtcagaccagtttgaagtaaatgcttacagaagagctgttcttgagcatgctattggccaattcacattagatattaaaaaaaaattaaagtagtgggcagatgactatggtttttaacaaagcaagcactgtgtttagaatgtgagagacttgggttcaagtcttactttgctgtcttgtagcaatgtgacccttgtctgtaaaatagggatcattgtcaccaaatcatagacttgttacgcagattcaatcagcaaacagtgcctggcactgggagatcttgctcttggcttatagcttcttcctgccccctctgttcctgagtttaaagaaggctgagttagagttagacaaaacactgaagtaatttacggtttaatatttagaccaacataagtattgagagcagatttgacttgcttatctgaatatcatctgaatatctttaaatctttttaaaaaattgttcttattaatttgttttaaagaaaatcaccaggcagcccatttggggtactacatagggattcaccaccccatgaattgcagggttattgtgttgctttcttggaattccactgcatctagggccctataatatagaagctgcttctttttttgtgggtacaattctacatctgcaactgactgaatgtgaacatgggcttgtacagaaataattagccacttgccccttattttgagggtgcaagtggcccctcttgccagcaattactgaaccatggaaaggaggaaatctacgggagagcctgtggaaatgtaagcataaaggcaaattgcttttctttttcaaagttacagctatctttttcttttaaaaaagtacttgaaagtatgaaagctaccttggaacaaaactactagtcattccttgcacctctccctgggtgtatcacttcaaatattccccattttcctccttcattttgttctcagggcttgtttaaataccctgtgtgctttaagcactgcatttggtttcacagttggttcattgtacattttaactaattattagtaaagtatctggcttatgaactctggcctttttcctctagaaggactccttgatgccttatagcagccccttgcattttaatatgcttttgcagggaattttgcagtgacctgcagtatggcacctatggatacatctggatttgcatcacttaccccaaacatatgctctgattaaggacaggatccagtggtattaaaggaccagaggaatttgttaacaaagcatagaagttgttgatggccatcccgaaacattgatctgtgagattccaaaattacatgtggagaagctgccttggacaataaaagaacaaaacacattctggatcttaataggaaacaaaaatgcatagacaaaagcagattgcttctttaaatatccgatttcagaacaagactagcctcctaggaaagtttaagggaccctgaatttaattgggaaaagaagcccgggtttatgttttcttcagcgtcaggctagcagatgagactgaatttttgacactttgcagaagacagactcctttccactagcggaatgaatctggggcctgcatcattattttactttgtaaattctgcatgtgctgtaatcagacctcttaaatgcagatggttactgctggaaggaatgaacaacattaaactttgaaaggaagaaaatgaaagggtttcttaactatttcagcttatctgtccagccccagggtttagatcacaggcctacagggtgactgctcatgatctttttgtgcctcttctctctaagtgggagattccatgaagttcttttgccaggaacttgagaggcaaagaatatacagaatttgtttcatttatgctgacactctgtccattagaatttatcaggtctcattattttatgggtatttgttatatcttcagcctctttgttttatggttggcctccaatgggttctaagtgaagataggctatggatatgattgtcataagtaactggtgacttcccattgaagaagcctttcacagagatggaatctttgcatgccctttgctttctcatgaaagatgcccttatcagtgtaaataccaccgatgtctatgctgttcttaaggaaggtgcaagggaggaggagcttactcgccaacccttctcacccccagcttcttcctggacccatgtcctgtgggtatctcctaaatggcagtgaataatgctttctgaattctcagacctttgaaaaataagttcagtaccggaaacttagggagaacattgtcaatttttcttgaaaagggtgatggttgagggagaaattgggagtaactattattttccagactcagtttgatgtaaaaatgtttcagtgcaagtgtttccagagctctggttcatgggactgggagatcaaaaatcacctgtagcacttgtttaacatgtgaattaccatacctctccctggatctactgtgtcagcacttctagtcgggggctcaggaatctgcattatcaggtattcagatgattctcgtgtgcagtcaaatttggaagccacgctatttttgtgtaatttttatattttaataattgagtatattttttgcaggtgtgtgattcatcacaccacggtgagtgataggaatatgatgatcccctgactgtatagaattgtgtaaatcatttgggtgctggtgtgtctcagaagttgctgaattatattcttatgggctttctgtccacccatcactttgttccaatgaataacatatgtcattgtgtcacaaaaaattcttgagaggaatttttgaccttaacctcatggaaactcttaatttccagaaatcctttcatgtttagtttccaaaatatttgatataaattttaaaggtgctcaaagttaccgtatagcatttgtgaattttagatgcaacaccgtggctttcgtcagaatgctaggtaagattatacttccctatagaaacgcatctgaagtgaaggggatttgtggcacaggtaggatccatctttgaggtgcttatcagggctattcaaaactgggctctggaaagataaggctgtggtatgtcttgccatgtaggtagaacacactgttaaagactcaaatgcacaggtcaaagaaaaaacatgctaaattagtaaattatcttcccacaggtcatgcttgtgaatctaattgaagaagtgttacggttctgtttacatttcttgatgtttctaaaatgaaaataaaaagtaaatttgcaaatttgcctttaattcttgcatgttaaccgccctcttttagagatagtctgatgagggtaaaatgcactttaatctctatttctaaaactttatgccaactaaaaaagaattctaacatactcttaggttattttatagattatattgatagtgagcttcagttttaaagtatatttttctaatctaccataaaatacgttctatatccactagaactattgctttggtggtttctatttctagcacatgttactatgtttttgaaatggaacatttgctgtaggggacagaacatttagcatgaaggatactaagcaataacaaaataaattgtctgcaaataacgatgtagggtgctttgacataatgtttctatttttcagtctggtagttcatctccctgtccttcctctgggtttgtatttgatttggggagcgagagttaggatttgtttatttaggaagtagatgcaagagtccaaaaatgaaccgcgtcctaatcctgcccccggtgactcttataacaacattgtggagggattttttgaaatgctatctcttcttaagaggaaattttctgcaatatgagtattttatcctattatttcttaaattaaattaaagagcatagatagagtactttaagttggaaaatagtttcttgagtactgaagtgctacaattttccccccaaatgaatacatacttttaatctcaaatttagtttattctattatttcatttttgaactcaaaggaaataaatctcttcattttattccctccataggtttcaaatgttcagctcataaagttacataatctcttaaaaaagtaaaagatcataaccaaatttagaattcaaaacaaggactatacataaataattcttgaaaaaaaaatcctaaaaccccaagaacacagtcaaaattgtgaaaaggcatcaacttgaagtaatttaaatagcacagttttatagctgtcttagaatgaccttgaaaaaatgtttcccaaaacgaattctcccttaaataattctttcagacagagtcttgaagaacaaactctcttgaagtgaattgttttctttgatgctgttctttttcctgcaaatcccagaggacagaatatttggttttaacttaagataatgaaagtaattttactttgagaactaggttttcagccgaattgtaaagcctgtctgcaggtgagatttaatttaatcctttgagtacttaagaagcattcctgagacagtggccaagaaagtgacaagattagcactttgtttattgacagtgtgtggacaagaaaagacttttatcctgaagagtttaatgattttttttaagtgatcttactgacaaatcttaattactaaaatatacattatttaaatagtcaaagattagatgatgtgtttgaattttaaagttagttgcaattgaattgtagatgaggaattaaacagtaacaaagcaaccatgaaaggcaggtactatcttgtcaactaacttataagtttagaatagagttagagggtagaaaatgaacgtatgagtattaaaagaaaatgtattaacgaaaatctgtggaagatctgtgatatatttctcagaatcagtcatttgcatgtggttttcatgagagtttaaagattttaaaagatttttttttacttgtcctattgcttcctttttaattcctctttttttttctgagtgtcttgtgtttccgataagcagtccaatttttctgatgtcagacactatttgaataaataaagaagtccattacaaatgaaaggtatatgcatggttgaaacttgatcccaacgctatataacatatatagctatgactttccaataaaattagtgccataaaaaattcttaatcattttctgttcaatgtgtgcaaatgtacttttgccacacacaatgatccccttgtgtacactctgctttttattttatttggggagtacaaaatgttgaaaaactagaatattttacatactaaatttgataggtcttcaggtttttatatggaaaacaaacaaaaataaatcttctttctgactatcacgatatccagcagaaatgactttacactatattaggagtttttttcattttgcgggctccagacctcttggccgctctgccatcctctcaatacgtttagccacggttagcaaaccatgaagatcttgcctacagtaatcacttattaatattttgaaatcataaaatatttctagaagctcctttggattttgcctgccattccatcattggactttttcaggatgttccgttttaggacaatttggggatgttttaaatttgctgcctgttcattttatgtctaaaggaaaaattacacaaaattccttaccatttggaaacatgttgtcttggttaggggtttcgaccacattttaaaattagttttaagagaaaatgaattgtataaatgatctgaaattcagttaagcaccgagaattgggaagccgctacttttattttagagtaccttattcattgaagtcagactgctgacgataaaagagcattctagacctttaaacattgattatgcactttggggagcggtcttattttctgctttcacccgtccatttgaatttgggctttggtagagcttgtatagtgcagtatctcaaatattccacagggtgtcatgatgtggttggttgttctcagggacactgtttggtaggaggtatatgagccaagccttatccagtgttttaaacggctggttcactttgttttcagttgaggaatatttactgagaacctcctatgtgccagccccacgataggaatgcagatcttagtggtattaggaagctcctcttcttcgctttgtgtttggcatttcagccaacagaatatttaccaacacagtgagttggcttgaatgtgtttgaatttatttcccatgtagctttatgtcatttgggaatgaatctgaaatggaagatcaggttttgcaaacaactaaattccccagttagaaactagttcttttccctccttcatctcgtgggaatgtataactatatgtgcaggtgcaggaagggggctgagagttccttctctaaaagactcctggggtagttgtgtggagcctgaagcaggagctggggcttcttgagtctgtctgagtgtgaacctcactttgccgctaatttgctgggtcaccttaatcaagttactttgcttcttttcactttaaatcattgatggtattttcaaagagtaagtgaaaaataatctgtttttaaaaagtatttagtggcttccatttctgcaacagggtgtcataaagtcactaatacttgttccttccctccaaatacaattgagtacctgaaaatagtacgacaggcaatcataaaaggactttgacaggtagtaaagaagaaagtggattggctagggacctgaggacttgaagaacggcatcatggtgagtttcctgacttttcttcccatctcccatatatatcttactgggcactggagagccctgcagccctgaattgccagcaagaattggtggagggaaggaatgaaagagggaaaggaagaaggagaaagtgagagaggaaaggtggaaggaaggaagaaaggggaagggaatgcctgctttctctggccaaaggagtggaacaggagaagcccaactgggatttagtaatggcccagtctgcccagaaatgttgccagccaagccctcagtaagccaacccattttcctgtcttacatctgccagaagtggtgagcgcaggatgcctacagcagcttcatcagcagagccagggtagctcaatctatcaccagccccaaactgctggtagagcctctctgcccctagcagtgatatcagtgacccggggaggagactcttccactcctttggtcagactgaactactatgctaaaccaaaacagatgacttcctattaggtaaaagatatacatagaatgtaaataggaaaaaaaccccacctcttaaacatatatctaaaatgtccaagatacaatagaaaatcacctgtcataccaagaaaataacccattataccaagaaacctgtcatacaagaaaaatcacaattttgatgagaaaaagacagctgacatgaatcagataatagaattatctgacaaaagctgtaaagcaattatcataaaattgattgaatgagtgattacaagttcatttaagaagtggaaaacctcactggaaggactcaacggtagagtggaaatgacagaagatagaatcactgaacttgaagacagatcaataggacttaatctgaacaacacagagaaaataatacccttagaaaattctctaaggggagatatatagatacatatatatctatatgtatctctctatatatatctatatatatctctatatatagagatctatgtatctatatctctctctatatatatagagatatatctatatgtatctctctctatatatctctctctatatagagatatatgtatctatctatatatgtatatatacatatacatctatatatgtatatatacatatacatctatatattatatatacatatatagatatatatgtatatgtatacatatatacatctctatatacatatatagatatatatgtatctatatatctccccttagagaatagctataagggagatgagtgctgtagcttatgcttgtaatcccagctactcagaggaggctgaggtgcgtcattacactgagctatctatgctcatgctactgcactccggcctaggtgacagagggagaccctgtctaaaagaatggcaaaggaagctctccaagcagaaaggaaataaagtgtaatggaaaaaaaatcaaagtaattaataataaactgcatataaactaaataaaacaagctatctttctccttgtggtccttaaatcacgtatgtgatggttgaagaaaaattgtaacatctgttttggtgttcaacgtctatgtttcctttgctgtgcaaaagctttttagtttgatgcaatcccatttgcctatttttcctttgctacccgttttggggttttatttaaaaaaaaatcattggccagatcaatgtcaaaaagctttttccttatgttttctttgggcagttttgcagttccagctcttgtatttaagtctttaatctattttagttggtttttacatgtagtgtgagataagggtccaattttacttttttgcatatggatatccagtttttccaacattatttattaaagatattctctttcccctattgcatgttcccggcaattttgcaaagaaaaattgactacaagtgcatggatttatatttggaatttctattcagttccattgatctgtatgtttgtttttatgccagcaccttactgttttgattactatagctttgtagtatattttgaaatcaagtagcatgatgcttccagattcattttttgctgaagattgctttagctattcagggtcttttttggtttcatatgagttttaggatttttttttctatttctgtgaaaaatgacatcggaattttcatagagattgatttgcatctgtagaatgctttgggtagtatggagatttaagcaatattaatttttcaaattcgtgaacatgggatatctttccatttatttgtgtcttcagttgcttttagcaatgttttatagttttcagtgtacaagccttttgccttcttgattaaatttattcctgttatatttattgtcttgaagctattgtaaatgggattgttttcctaatttctttttcagatagtttgttgttagtatatagagatgctactgattttttgcaagttaactttctatcctgcaacattactggatttgtttattagtttgaacacttttttactggagtctttagggttttcctttttttctgtttaatttttattttaagtttcagggtacatgtgcaggatgtacaggtttgtttcataggtaaacatgtgccatggtagtttgctacacctatcaatctatcacctaagtagtttatttgcaattaggctggtgagtggtatgagggtgaggatggtagagaagtacataatagatgctgtctgcccgatggcaataaaagggtatttgactggctgccctatcaatccatcacctaggtattaaagcccagcacacattagctatttttcctgatgttctcccaacccccaccacctaccacaggccccagtgggtgtttttcccttccctgtgtccatatgttctcattgttcagcaccaacttataagtgagaacatgcagtgtttggttttctgttcctgcattagtttgctgaggataatggcttccagctccatccatgtccctgcaaaggacatgatcttattcctttttatggctgcataatattccatggtgtatatgtatcacattttctttatccaatctatcactgatgggcatttgggttgattccatgtctttgctattgcgaatagtgctgcaatgaacatacacatgcgtatatatttataatagaatgatttatattcctttgggtatataaccagtggaaggatagctgggtcaaatggtatttctggttctaggtctttgaggaatcaccacactgtcctccacaatggttgaactaatttacattcccaccaacaatgtaaaagcattcctctttctttacagcctcaccagcatctgttgtttcttgatttttttaataattgggatttgactggcgtgagatagtatctcattgtggttttgatttgcatttctctaatgataagtgatgttgagctttttttcatatgtttgttggccacatgtgtgtcttcttttgagaagtgtctgttcatgtcttctgcccactttttaatggggttgtttgttttattcttataaatttgtttaagttccttgtggattgtggatattagacctttgccatatggatagattgcaaaaattttctcccattctttaggttgtctgtttgctctgatgatagtttcttttgctgtgtagaagctctttagtttaattagatcctatttgtcaatttttgcttttgttgcaattgcttttgaagttttgtcatgcctatatcctgaatggtattgcttagattttcttctagggtttttatggttgtgggttttacatttaagtctttaatccatcttgagctgatttttgtataaggtgtgaggaaggggtcctgtttcaatttcctgaatattggcccccaatctcttctggcttgtaaagtttccactgagaggtccactgtcagtctgctgggcttccctttttaagtgacttgacctttctctctggctgcccttaacatttttccttcattttgaccttggagaatctgatgattctgtgtcttggggttgatcttctcatggagtattttactggggttctctgggtttcctgaatttaaatgttggcctgtctttctagactggggaagttctcctggatgatatcctgaagtatgttttccaacttggttccattctcaccatctctttcaggtaccccaatcagtcataagtttggtctttgtatataatcccatagttctcagagcttttgttccttccttttcattcctttttctctaatctcgtctgactgtcttatttcagcaagacagtctttaagctctgagattctttcttctgcgtggtctcttcagctattgatacttgtgattgcattgtgaagttctcatgttgtgtttttcagctctatcaagtcatttatgttcctctctaaaccggttattctcattcacagctcctgtgatgttttatcagggttcttagcttctttgcattgggttagaacatactcctttagcgcagtgaagttcattattcttcaacttctgaagcctacttctgtcagttcatccatctcagcctcagttcagttctgtgttcttgctggagatgtattgcaatcacttagaggagaataggcactctgggtttttgagtttttagcatttttgtgttgattatttctcatctttgtaagcttatctacctttgcttgatctttgaggctgctgacctttggatggggtttttgtaggggcttttttattgacgtcgttgtcgttgttgctttttgtttgtttgtttctcttttaacagtcaggcccgtcttctatagggctgctatggtttgctgtggcagctgcccctccccttgggaacttggtcatcttaggcagtctccagcctgctgccactggcttcaaccggagtggctgctgagtgtctgcacagctctttgcttgggccccacggctctggtggcatgggctcatgagggaatctcctgatttgcaggttgtacaggttcatagaaaaagcgtggtttcccgagcagggtagcacaattactcactgcctcccttgtctgggggtgagagctccacttgttctgtgcagctcccagtgggccgtcactccaccctgctttttctcactctccatgggttgcaccaaccgcctagtcagcccagatgagagaacctggatacctcagctggaggtgcaggattcacttgccgttttcgttcttcctggtgccgctgacggcagctgcttccagtcagccatcttggtccctcccctcagagttttctctatttaagatcatgtcatctgcaaacagatgcaattttactccttccagattcggatgattttattgttttttttcttgcctaattgtagcaaggtactaaagtgaaaagaaggcgccaggtactatatagaaaagaagtggcaaaagtgggcatccttgtcgtgtccctgatcttagaggaaaagttttcagcttctctccattgagtattaagttagctgtgggcttatcatgtataaccttgattatgttgaggcacattcatcttatgcccaatttgtcgagagtctttatcatgaaaggataaattttgataagtgctttttctgcatctattgggatgatcctgtgatttttatcttttattttattaatgtggcatagcccattattgatttgcatatgttgaacaattcttcatcccaataataaattccactagatcatgaagtatgactcttttgatatgttgttgagttctgtttgctagtcttttgttgaggatttttgcgtctatattcatcagggatattggactgtaatttttttttctcgtagtattcttgttggctttggtatcagggtaatgctggccttgtaaatgagattggaagtattctgttttcgtttgttcatgctgctataacaacatacctgagaatgggtagtttgtaaagaacagaaatttatttcttacatttctggaggctgagaagtccaattcaaagtgcctgcctctgctgagggcagctctctgctccattatggcaccttgaatgctgtatcttccagagaggaggaaggctgtatcctcacaaagccaaaggcacaaaggcataaagggccaaactccctctgtcaagcccttttataatggcgttaatccattcataagggcagaaccttcatgacttaaacatctctcaaaatgtcccacctcacagtactcttgcattgtggattaagtctccaacacgtgaatattgagggatgcattcagaccatagcatgttccctcctcttcaattttttggaagagtttgagaaggattggcattaattctttaaacgtttggtagaattcacctttgaagcaagcagattctgggcttttctttgtggggaagttttgattactgatttaatttccttactcagtggtctgtttagattttctatttctttatattttagtcttggtaggttacgtgtttctaaaaatttatccatttcttttaggttatccaattttttggcttgtaaaatggctcatagtaataatcttttataatcctttgtatttctgtggtgtcagttgtcatgtcacatctttcatttataattttatttatttgaggcttctctcattttttattagtctagctaaaggtttgtcaattttgtttatcttttcaaaaagcaaactcttagtttttttgttctttcggttgtttttctaaacttaattttatttgtctctgctttgctttctattatttccttccttctgctaacttttgggtttgttcgttcttatttttttagttacttgaggtatgaggttaagttgtttatttgatatctttctttttccttaatataggtgtttcttattataaacttcccttttaaaactgcttttgccatgtcccctacatttttgtatgctatgtttccatttttatttgtttcaatatatttttaaatttcccttttgatttctttcttgatcaattggttgttcaggagtaatttccacatatttgtgaattttccagttttcctccattattgatttctaatttcatactattgtggttggaaaagatacttgatatgatttcaatcttcttaaattttcaagactgtttggtggcccaagatataatctgtcctagagaatgtttcatatgcacttgtaaagtgtgtgtattctacttcttttgaatggaatgttttgtatatgtctgttaggcccacttggtctatattgttattcagatctactgtttcttgattgtttttctgtctagatgacctagtcattatttaaaatgagtactgaagtcccctactattattgtattgctgtctgtttctaccttcagttttggttatatttccttaatatatttaaatgttctgatgttgggtgcatatatatatatatttatagttgttttaccttcttgatgaaatgacccttttattattatgcaatgaccttctttgtctcttatgacagtttttgacttaaagtgtcttttgtctgatataagtatagtcacccctattcttttttgcttacaatttgcatagaatatctttttctcttcattgactttcagcctatatgtgtcctttaagctaaagtgagtcttctatagtcgcatatagttgaatcttgtttttaaaaatcaatttagacattctatgtcttttgattccgtaatttatttacatttaaagtaaatggattaaattatcctgattatcctgattatttataggtaaggacttactgctgctagtctgtaggtggaggctgaggtgggaaggacacttgagccttggaggtcaaggctacagtgagccatgatcatgccactgccttccaacctgggtggcagagcaagaccctgcctttgaaaagaaaaaagaaaaaaaaagaaatcttgtaggctgagagggatgattacatgattcaaatcttgtaatgagagaaattctcttacatgagagaaatcttgtggggatgattacatgattcaaatttctgaaagaagaaaaaaacctgccaaccaagaatactatacttggcaaagctgtccttcagaaattaaggagtgataaaagtttcctagacaaacaaaatccatggaagttcatcaccaccagacatgccttacaagaaatgctagtggtagttctttaagttgaaatgaaagaagctcgtcaccactatacatgccttacaagaaatgctactgggaattcttcaagttgaaatgaaaggatgctaaccaaaacatgaaaatataaaaaagtttaaaactcactgtaaaggtaagactttgatcacatttttggtactctaaaactgtaatagtggaacataaatgactttttactctacaaaatattaaaaataactatagctacaatagtttgttaattgggaccacaggcatgcaccaccacacccagctaatttttcttttttccttttttgtagagatggggtctcactctgttgtccaggctggtcttgaacccttgggctgacataatgctcttgtcttggcctcccaaagtgctgggattacaggcatgagccactctgcccagcctttgtttttactttactttacttttctttctttctttctttctttctttctttctttctttctttctttctttctttctgtttcttttttctttctttctttctttctttctttctttctttctttctttctctttctttctttctttctgtttctttctttctttctttctttctttctttctttctttctttctttctttctttctgtctctctctctctctttctttctttctttctttctttctttcctttctttcttttgttcttccaacagacagggtctcactatgtttctcaggttggagttgaattcctgggctcaagtgatcctacagcctcacttcacaagtagctagctggtagtacaggaatgtgccacaccacagtgcctggttggggttccaaggttcctgttgtaaaatctgatagtcttaaggaaattcctttttatgtgatgaatcacttttctcttgatgcttttaaaattatctttgtttttgacttttgagaatttgatcatatctcagtgaagatctttttatatttatttgggattcttttggcttcacggatctgaatactcatttccctctccagatttaggtagttttctgtcattatttctttaaacaatcttctgcccctttctctttctctacttcttctatgactcacataatgcatatattgctttgcttaatggcggcccataagtcccatagacttattaaaatttttcttcttttgagttggtactttccaaggatctgtctttgagtttgtggattctttcttttgcctgattaaatctcctgttgaagtttgtcctagttcatttgtgttgctatcaaggaatacctgaggctcaggaatttataaaggaaagaacatttatttggcttatggttttgtaggctgtacaagaagcatgatgctggtgtcagcatggtgagggcttcaggctgcttccactttttgtggaaagcaaataggagctggtgtgtagagagatcacatggcaaaaaaggagatgagagagaagagggaggtggcagactcttaaacaaccagttctcattggaattaacagagtgagaactcactcattactgcaaggatgtcaccaagccattcaagaggaatccactcccatgactgaaacacctcccattaggctccacctccaagattgaggatcaaatttcaacatgagatttggaggggtcacacaaatcagactataccaaaaatcccagtggaatttttcaagtttagttgtgttctttagctgcagaatgttttattgttttttcttgtttttgtgtatttctttattgtttgtgtgttattttccttattttctttagttgtctgtgttttcttgtagcttactgaggtttttaaagatgattgttatgaattgtttgccagtcagtttacagatagtcatttctttacagttggttactcatgcttaattttgttcattgggtggtatcaagtttccctgattattcttgatctttgtggccttgaatttttgtctgcacatttgaagaagtagactccttttctagtctttacagactggcttcagcagggaaaggccttcacctgttagcctgtccagagattttggaggggccatgagatggagtctgggcaggtttgctgctagagtccttgggctggctggcctggtacctggttgcatggggccagccatgggtatgtgggggtgggcctggagccagcatgtacatgggaaggtccagtactgagtccatggtagagacctggaatctgggttatttagggtgggactggatcttatgtccatggggatcagcttgggttggggtccacagggatgagcctgttgtctgggtgcagaccaaaagcttgtatccatgggggacaggctggaggctgtggtcattagggctgacctgggctggggcaggcctggtgcctgggtctatggctatgtgcctggtcttgagtatttggaggccagcctagtgctgatcctcactggaaagtgttaaagctctgcccacaggggctagcctggtgattgagtgggcctggaatctgactgctcaggggccagcctggagccagggttcatcggagtaggcctgatgctaggatctttggcaaagtcaggtgctcatttcactctcttttccccatgtatctctctccccatgctgcactgcctgggattcaggaagggctgactggatactgtgaaactgttcttactctcttcactgagtcttttcttatatttgtgctccattcggagggtataattacttactcctagattaattcgcatccatgaagattattcatgcatagacagttgttcaaattgatgtttctgtcagaggattagcactggaaactcctattctgccatcttactgacatcactctttgttctaacattaatttttaaaatgcaagaatggctatattaatatcagataaagtagacttcagagcagaaaaaattactatggaccatcagtaacattatatcataataaaacagagtaattcaccaagaagatatagcaatcctaaatgtatatgcaacagagcttcaaaatacatgaaagaaaaactattagagttgaaaggtaaaataaacgaattcacaattatagtttgggacttcaacataccactatcagcaattgaactaaataaagaaattaaatataggaaactaaatgtagaaaattagaaaaatatggaaagaactgatcaattctatcaactgattgctatttatagaatattcccaacagctgctgaaatgcattatttgcaagtacatatataatattcaccaagataaactatatcctgcattgcagaacacacctcaccaaatttgaacaaactggatttatataaggtatgttctatgatcttaatgtaataaaactggaaattgataacagacagacaaggggatctataaacacttgaaaattatatatcacactgctaagtaacccatagtcgaaagatgaagtttcaaaggaaaaacatacatgaaactgaatgaaaagaaaaacacaaaatatcaaaatgtgtgggatgcagctagagcagtgctgagaagaaaatgtaagcattggatgcttatatgaaaaaagaagaaagatcttgaatgaatactccaagttcctacctcaataacccagaagaacaaaataaaccgaaactaagtagagggaaggaaataataaaaatggagcaaaatttaataaaatcgaaaatatagaaacaacagagaaaatcaataacattaaaagctccttctttgaaaacataaataaaattgataaatctccagaaaccctgagaaaaataaagaagatgtatattgccaatgtcagaaatgaaacagaagctatcattacagttcctgtagctattagcaacctaatagaagaatactgtagacaactttatgctcataaatatgacagtttagtagaaatggaccaatttctaaaaaaccacaaagtatccaaaagtaaccaacatgaaatagatgactgaatagtcttaaaaccatgaaatacattgaaggtgtagttaaaaggctcctgaaaaagaaatttccaagccctgatggcttcactggagaattttaccaaaatgttaaagaattaatcctaattttactcaatttctcccagataggagatgagagggaacactttcctactaatttatgatggcagtaactctttgattcccaaacctgaaaaagacagtatcaaattaaaaaacaaaaagaataaagccaaaaacccgcagaacaaccctatagatgactgtctctcatgaatttagatataaaactctccaacaaaatattacataaatcaaattaaaaaatgtttaaaaagaataatatggcatgaccaagtgaaatttattcccggtgtgcaaggctgatttagcacaccaaaactaattattataatccacagtataaacaggatacagatgaaaaaaatgtgttaattaacacagagaaagcactttacacaattcaatacccattcataataaaaactcttagtaagttaggagcagaggagagctatctcagcttgataaagcacatttacaaaaaacctatagcgaacatctgtttttcaccattaagactgagtatattccctgtaaattcaggataaaaacaaagatgcctattctcactattggtatacagcatagtactccaaagccctagccactgcaataaggaaagaaaaaagtgtcatccttttttgaagatgacattgttgtccacatagaaaatcccaaggaatctttaaaaagggacaaaaaatgaaacaaaacaacccacctcactcccagaactagtaagtgacttcagtaaggtctcaggatgcatgatcaacatacaaaatttaactacatatctatatactaacaacagaatatgtggaagctattgataaaattaaaaatataagacggtttacagttatccaaagaaaataaaatatgtagatgtaaacttaggaaaacctgcaggatctgtatgctgaaacttataaaatgttaatgagcacaactaaagaagacctaaacaaacttagataagtattgtattaatgaattggaagactcaacatagtaaaggtgtcaattctgctcaaatagtgctatatagatttaatgagattcctatcacaatcccaccaaagggttttgatgacatagacaaactttttataaatttcttatgaaaaggcataaccccccgaataactaaaacaatcttggggaaaaaagaataaggttaaaagattcactctactaatattaagccttactatatagttactgtaatcaagacagtgtgatattattgaaggatagagatatagattaatgggacagactaggacccagaaatacagccacacaaataagcctaagtgattttttacaaaagtgcaaaagcattccagtggaggaaggatagccttttaaacaaatgatgctggatcaattagataattagatatctacaggcaacacaatgaacattgacctaaacttcacaccttatgcaaaaaataacaaaaagtagatcatgtacttaaatgtaaaacatgaaagtataaatttgttagaaaaactataggagaaaatcttcatgatttaggactaggcaacaaaccctgaaagtgacatcaaaagtatgatccatgaaaggaaagactgataaattggaccttttgttctgtgaaagacctgttaagaaaatgaaaagacaagccatagacttggaggaaataattgcaaaccatgtatctgacaaaggactaatacctagaaaatataaaggagtcacaacggtgaatagtaaaacaaaaaacttagaaaatgggcaaaagacttgaagagacattttaccgaaggagacttacagacagtaaataagcacatgaaaagatgttaaaaatcattagccattagggaaatgcaaaataaaactacattgatatatcactacacacctataagaattaccaaaataaaaaatactgataacaccaaaagtttgtggggatgtacagaggccagatcattcacacactgttgatgagaattaaaatggtaaagccactctgggaaacagtgcagtagtatcttatataatagaaattacaacttccattcaacccagcagttgcactctggtagcatttgtcccagaaaagtgaaaacttacgtcaccgaaaaaataaaacccgtagttgaatgttcatagtcgtttatttgtaacagcccaaactaaaaacaactgaaatgtccttcagcaggtaaatgcttaagcaagcctggatatccatgccatggaatacctacttagcaataaaaaggaagaagttgttgataactataacaactttgatggatcttcagagaattatgcagagtgaaaaaagccaatcccacaggttacatactgtgtgactttatttatataacatttgtgaaatgaccaaattatagaaatgtagaagagattaatggttgccatgggttaaggatgggacagaggcaggagggatttgtgtgcagctataaaagggcattgcaagagatttttgtggtgtgggacttgttctgtatcttgactttggtggtggtcacgtaaatctacacatgtggtacaattgcatagaactaaatacagatgcacacaaatacacaaatgcacatgagtgcatataaaaactcatgatatatgaataaggccgttgggttgtatcaatgtcaattccctggttatagtattttactataattattctagatgttaccattagcagaaactaggtaaagaataaaggactctctttgtattatttcttataactgtatgtaaatttcaattatctcaaaataaaatgtcaaaaagaaagcttttagtacagtgcctggcttgtaggaatcacttaatagataatggccatcatcttcatcattctcatcctcctcctcctcctcatcatgacactgttatattagctgaaagttgtgaggctgctttttgactggagacagctatatgttgccttctaaatagtcatctcattaaagcagctttcctgaatagaccctaatgctgggaacctatgttgcttaagaatggagatcggttcaagaaatggaggaaggtggctggttgcggcagcccatgcctctaatcccagcactttgggaggccgaggcaggcagatcacttggagtcaggagtttgagaccagcctggccaacatggtgaaaccccatctctactaaaaatacaaaaattagctgggcgtggtagtgcacacctgtagtcccagctacttgggaggctgaggcaggagaatggcttgaacccgggaggccgagatcatgccattgcactccagcctgggcaacagagtgagactccatctcgaaaaaaaaaaaaaaaaaaaaaaaaagaaagaaacggaggaagggggtttgctgcatacaatacttacttttttataagctgaaaatttgttttcaaatttttattccattttttggccatattaaaatgttacacatcctgttagagtggagaattcctccattttgaatgaattccactcacagaattctctgtataagagatctaaaggaccaacatgtttttatttcaaagaaaaaatatgggtataataagcagaattctagaatggttcccatattatgtgcctgttggtgttatgtctatgcttaggttacattttatgcaaaagggaattttcagatgtaattaaggtcactagtctattgaccttaagttgatcaaaagggagattatctgtgttggccctacctaatcacatgagcgcagtaaatctggggctagaggtcagagacagggaagtcagagatattccaagcaggagggtgattttctatgtgagaaatgcttggttgctggttttaaagagggagggaagtactgtgtggcaagggcctttgtatatagcctctggaagctgacagcaaccttggccagcagccagcaaggagctgaataataccaacaacctgaatgagcttgaaagaggaccccagattcaagatgggaacttagccaaactgatccctttatattagctttgtgagaccctcagcagaaaaaccaatcaggccatgcccagacttctgatctgatgctgttaagctgctaaatttgtggcaatttgttatgcaactgtagaaaattaatacaatgggttgacttaaatctttgtgtttaaatccatggtttggtaggccctgtactagcaaccagccttgccttttccactcaaggagcatccttggcattctgcaaaaggtacctctgagggacacggagagattggcagacctgtgcattcatgctccccaagcaagctttttcttttttaaataattttcaatctgtcatggaacaatatgtggtcttactgtgcacttgatcagtgtgcagttccagccacgtgcgacacaggttcaacaacacctgaacttgtccatacattgctcatgatgacaggtccatggatcatgttcttgcatattaggatgctgtatacacacttatgatttctgtagttatcttgtcaaagactggtaacaaagagttgccgggaccatatttggagaagtgtctgagtcaaaccttaaccttgtcagcctgtaggaacttgagagaaagaaagtccagagcaattgttttaggatggtggagtttgctggctcaagagctaacactggagctctccctaggtgctgtggatatgggtcataatttttggccatccagactccaagctttgttctgattttatgaagaacatctcactatggaagatgaaactgctaacacttggtttctaagcctcccttgcagttgggctgtatgccttaccttggctttcctcattagatgtacctgccccagtgtcattggaatgttgggattttgaaggaccctctctctgctgcagggactgcaaagtcaagatcatggggcaacatgactgcagggctagtggtgttgtccgggggtcagttgaagccactcttgttagggttccttcctttctcacttctttcgtttattcagtaagttaatatgtagtattgccaacacagttgggtgctgcggccaaagagaacgagtgggacagagctcactgtactgtaagcctcgatgtctagttttcagcagttggggcaacagtgtttgcactagaccacttgcatcaaaactctgggcataattctatactattttccctgaccctgattttctagcctttctggcagttttgtgagtttccccatttttctgcttaaatcagactgagctgtttctgttgctttagctaataacattaactgatactctaggtgtgggtaatacaaaatccagagacaaatcttagagagaagataaattttattagtgaatgaattttggaattttataatgaaaactaccagaaagatacatttgggtatatttgaaactgtaacgatgcctaagtatgttttaggtcctctgttttaagctatgtatagactttctccatcactttttattacttctttacttctttgtagaatctcggagctgaagggactcagccgtcacctactctggcctcttccttttacacaagccactttctttagaattccttccttccttccttccttccttccttccttccttcattccttttttcattcattcagtaagctaatatgtggggtgttgccaacaattgggtgctgcagctggagatacaacagtgagtagaacagagctcttgtcttcattgtgctcatggccaagttgtggaaatagataagtaaggaagcaattttaatagtgtatgaaaaatgcagattaggggacttaacctggtttagggggttggagaaggagtcctgaaggaggcaaggagtgtgctgatatctaaaggtttgagtagagcttgaataggtgaacagttggagtgcaaagagggctccaagaaaaggaaatagataggcaaagatagggaagatataaggagatcctcgtgctagggaatagcactagtgattcggcagggccagggcttggctgagggattgtagaagatcacacggaccatccctcggagggcctcatgtatgatatcagggagtttgggctttatgtggggggcaatgggagccattgaagggttctaaggaaggaagtcatgcagttagagttgcattttgggaaggttacctttgactgcagcatggagaccaaatggaaggaggagcaaatgtggagtcaaggaggctgtggctgttagtcaatggtcccttttgtgctgaggactacacttgtgtgaaattcacaacaaagctcccctgctgaacattggcccatctcaggctttgcaagcccagagttaaggaccccattaattcttgggcagagcttcagaagtcagctaaagccattaggattagggttgtcaagtgacctccagggtctgagctctcctcctctcttaccccctttccaggtttctgccccagaaggcatagctattgcttcagcagtactggctccttctgaatcttcccagccatgaccagaaggcagctcaagtcaaaggcaagggcagggtttctctctagctcccttgtactcaggcctatctcatactttgttgtctgtgttgctaaggtggtgtccaattctgcaatatgaaatttctcaaaaaaacccttccctttccacccccaaggcttcccatcctaacccttgttttcaatttgcttattttccaattcctgctatttgagccttgcacaacctcaccctttgaagaaaaaggttcccaacatttttcatataaatgtcataacaatttgtgaacatgagaaaactgtgcagtacttttttttaaaagatacagaattttatattctctccagtcttttaagtttaaattttaagaattcagtcatctttggagtatgaaaggattattttctcctgcagagtccttttaaaaagcaaaaacttattgttcaaaagtcacttaaataaccattctgatattttgtagttggttttaaaatatctttttattctgtttacactcaatgaaaacacactggcagatgcagaaaagcatgaagaggagaagtaaaatcatcagtcgtcccattgccaaataaaacattttagtagattccttatatttttgttctatgcaataattttttctttttacaaaattaatgccatactattttacattctgctttttaaagatctactattttcatttagttagcaatgctatgcaaacaggattttaaatacttgcataataggccatggtttaaatatgccaatatcccattactgggtatatacccagtggaatataaagcattctaccataaagacacatgtatgtgaatgttcgttgcagcactgttcacaatagcaaaaccatggaatcaacctaaatgcccattaatgacagactggataaagaaaatgtggtacatatacaccatggaatattatgtagccataaaaaagaatgagataatgtcttgtgcgggaacatggatggagctggaggctattatccttatcaaactaacgcagaaacggaaaaccaaataccacatgttcttactcataagtgggagctaaatgataagaacttatgaacacaaagaaggaacaacagacgctggggtccacttgagtggggaaggtgggaggagggagaggagcagaaaagatgactactgggtactgggcttaatgcctgggcaatgtaatgttatgtacaacaaacccccttgacacgtgtttatttatgtaacaaaccttcacatgtacccccaaacctaaaattaaaaaatttagctcccattaaaaaaataaataaatatgccaacaatctgtaactgctggcaacttggacaatttagtattaagtaggcatttgttttatttattaaattattatttactcatgtgtatagtatttattatttttatgtataaatataaaccaaaaatggcccataattttaccagctggataaccctgattgacattttaaaataataaaacccacatggttagaaaattcaagcagaaatctacacaaatgtacaaagatgaaaaccagaaactccttcttccttctgcctcctagaccttaccctacaaaagttaaaatttcttgtgatttgtttccagatatatttatctgtttatagatgtttcaaattttatgcaagagattatatgctacacactgttctgtaccttatttttttctcttaagagtcattcttggtgatctttttgcagcatttcttaaagtggtgcatccctagctcaataaatacatctttaattccagctctgttagtcagtcacacctgcagtatcattggctcttctgctgggttcttagatgtgagataaacagatcgcatgtctccagtctccaccatccctatttcttcagctcttgacccctacctgcatgccagtaggaccctgaccctcagtctccctagtctttccagttatatgaggaggccccagggattatgacataagtgcacagccacttttcctttggtctctatttctcgtgcccaaagtcctttgaaattgctgcctactactgccccaaggctgatgtcctcctcttatgcccagggcactgtctgccagggtgggccagtgggtctaatcagtgtattcagaaccacggtggatttgcgtacatgtgtgtacacaaatgtatccatgggtgtattcaaagtaataacatacactgtttccaagagtcagtcctctcagctgctggcttcttccatataaccagtatcattctgacatataaccatccatattcttacttatgtgtatttttgtgtgaacatttgtctggaagggaggaagcctttgttttgactggagatgattatgccttctgaattgctgtgttttccaaggagtggcaattaattttcacagtggcagctggatgggaacacattacattttgatgaaggaaaagaataattatttgacctataacctgagtttctaagctgtctatctcaaggcagaagaaaaaaaaatgaatgaaggaaaggtggaacgaaggatggaaggaggctggaagaaaggaaggaaagaaaaaaaatttcatctttgttaggccacaaagtttacgggtttccattgtggccattgaaaaaattagccaagaccatgtcctccagattgaaggtcagcagagccattgtctttgcatccagagctgtttttgacgctgctactgctgccacctccattgtcattgtaatcatctcctcctcctcattactactgggattactattattattatttggattaccattccagatacatgctaagggaatcaagtaatcaaaaaatttgtttgagtgtacattgtgaaacatacttttggaatgattccctgagaaagctgggtgcagaatgcaaatattttgaatggacttatcttagagttgtactgctttttttccttgtcattttaaaacccttaatacgaataaattgtttgtatagtggggcttttttaaatccttagataagaaatacatggtttgaaagcagagaataaaaacatgaatgataatgtcctcaatgcccaggagaaagtccttgctgctgctcctggacaggcattgtaatcggctatttggcgtgtttatttcaggctgcagatagtggataaaagtggctggttggttgccagcacatgacttagttgccaaatggagtgtttagtacttgttacatttgacttatatcacaagttcttcccattaacagtctgctggtgataacctacttggcttttcatgtggttactttgaaacagccacttgacaacatttggcatatcacaaactttaatactgaaataaaggagtaagtgaatggctacatgggatctgccatatactgatatggtacttggtgcagaatgggctctccagtaaatgtctgtttaatcaatgaattaatcttgcataatatttccctggttcagtgtaccaagttcaagcctatcgacttgagacctaaaaggctggtaaaagggatagaaatacaaagaaataatagtgattacgtacgtgtcagaagggcttaccgttgtatggagggagatactctgctcctctgtatcaccatttaaagacagacttgaactaaatggagaaatgaagatttcatcaaaatggccttttgtctaagtcaaagctactgacaatttctatcatttcaggtctttttctttctttttttattaatagatccacttcaggaattttggcctaggatatgtaatcaaatatgcattaaaatattgatttttatttttagattgaaaacttgcaagaacaacttagggataaagacaagcaactgaccaacctgaaagacagagtgaagtccttgcagacggattccagtaatacagatactgcactggcgacgctagaggaagctctgtcagagaaggtgagcatgcactcaaaaactggggaatcaggatatggggaaacagagttggggaaagttgatcccaatgcatttaaatgtgcctgcttttcttcttttgctaacactacctttagtcccagctggtccttgttcttcccacacaagccctcttcagtggacttggcatactacagtcaggggcattttctgaaatgcaaatctgattacatcactcttggctttccttaaaaaccttcactagcttgccattgctcttacgatgatataatttgaaatcctctacctggcccccagggtcccttctcccatctgatctggcaagcccccactctgtgtgcctgctccctccctcattctttctttcatttccagcctcatcccccatttctctttttccaggttctctgttccctagttatgtggggcttctagattttcaactgtaccatactccttcctgcctcagatgctattccccagctgaggatattcctcactctctgctaatttaattcctcctcttctgagaggtcagcttcatgagaagttgtattgtgcagtagtcaagaatgtggactttggagctagactgcctgggatcaaatcctaggtctgatactttctactttggacaaattacttaacctctcagtttcttcatttgtaaaagagggtaataatagtagccacctcagtggattatattgaggagaaaatgcatgaaaatatggaatgtgtttagaatagtagatgtaatgttatcactattattattattttatcatttccttggggacacctcctaggtatccccgttatgtctcaggaacaccacaaactccccagagctcatgtcacattcttaattgttcatttatctgtttttaatttctcttctctgctagactccaaacccaagaaacatatgctatgtgtgtgttatctttccattccctgtgcccagcataacctgcattggggatgctcactcagtactggatactggtggagtgagcccccaccatgtgacaggtcctcttttgagccttgggatgcagcagagaagaaaatgggtgaaaatcctggctctaatggagtttagactctagtggaggtgatggggagacagacaataaatacgtgacattcctaggatttcagagggtaatattttctacaaaagaagagaaggcagggaggggtacagggagtgctggagtagaatggccaggtaggagcttgctgagaaggtgacacttaaggaaacacttgaagaaagtgagtggtgagccaggagcccttgtggagggagaaagccctggcagaggggagagcaagtacaagggtgtgggtgagaggaagggcagcagatttcacaggcccttgtgagacaagatttttaaaaattggcttttactttgaaggggatgggatgccatcctgagggtttccttctgacttacatttaaggggattaatttgaataaaagaatgaatgaatgaataaaatcctttaggcaaacagctcattctgatgtttacttacttttaaaatgatttccagtccatttcattctggctaaatgagttcattcattctctgggcacctattgtaggtatcagaccctggagttgagtttgcatatgctctctcctctcctccaacacttcctgaatgtcaaagagccagtgcaggtaaagttctctaggaattctcaggagggacggcttgtttgttggttggacatggaagtgctggcgcagtttttaggcccatgttattggcattattttcaaatttagcttgaaaccaagaaaagaaatgttaacttttgaagtgtgggagtagattttattatgttctttttcttcatctttcccatcatttttgatcctgcagcactttgcaggatttgtccacacatgcatgggatgttgtgagggttttcctctgggatgccctactagagtaatagcattatctcctatattccctgttacagtagcctataaactctggggtaatgaagtaattggaaggagacctaggggccagtcccacctaagccactaattaactggggagccattaattaactgggtgagcctggcaagtaattgcctctctcagggcctcaaatttcccatttgatgaatgggggaattagattaaatgcccatgggtttcctaggccagtgtatcctaaaggaggcttctcttctgttacttcagaattaccaggaagctcctgttgaaagtctctattgttaggccccatctatacctaccaaatcagaacctcatagggcctgggaatctgcactttagcaagttccccaagtcatcgtgatgtaaactctagtctgagaaccaaggctctatgataaaaacctaggagctctaaaaagatgggtaagcatatttttggagttaaattaaaaagttattaaaaaaaaaaaaagaaaaaaaaaggaagctacaaaaagacccatgactctagggctagtcttcatggtcctattaaaaattgtgagatttaaacgtaaaacccagaactgtaaaaactctagaagaaaatctaggcaatacccttcaggacacaggcacaggcaaagatttcatgatgaaaatgtctaaagcaattgcaacaaaagcaaaaattgacagataggatctaattagactaaagagcttttgcacagcaaaagaaactatcatcagagcaaacagacaacctacagaatgggagaaaatttttgcaatctatccatctgacaaaggtctaatatccagaatatgcaaggaacttaaacaagtttacaagaaacaaacaaacaaccccactaacaagtggtcaaaagacatgaacagacacttctcaaaagaagacatttatgcagccaacacacatgaaaaagagctcaacatcactgatcattagagaaatgcaaatcaaaaccacagtgagataccatctcatgccagtcagaatggcaggtattaaaatgtcaagaaacaacagatgctggtgaggctgggcagaaaaaggaatgcttttacattgttggtgggaatctaaattagttcaaccattgtggaagacagtgtggcaattcctcaaagacctagaacaacaaataccatttgacccagcaatcccattactgggtatatacccaaaggaatataaatcattctattataaaggtgcatgcatatgttcattgcagtactatccacaatagcaaagacatggaaccaacccaaatgtccatcaatgatagactgaataaagaaaatgtggtacatatataccatggaatactatgcagccatgaaaaggaatgagatcatgttatttgcagggacatggatggaactggaagccattaacctcagcaaactaatgcaggaacagaaaacgaaacactgcctattctcacttataagtgggagctgagcaatgtgaacacatggacacagggaagggaacaacacacactggggcctgttggaaggggtcgggggagggagagcattaggaaaaatagctaatgcatgctgagcttaatacctaggtgatgggttgataggtgcagcaaaccaccattacacacgtttacctatgtaacaaacctacacatcgtgcacatgtatcccagaatgtaaataaaataaaatatagcaaacaattaaaatgaggcttttgtaagataaagaatgtacattttgacattgagttaccttatttgacatcatatttagtatgtatttccaaattaattttgctaaaaaaaccatggaggagaaacagttgctggttaataaagttataaatcctgtaacaatttaaacattgaaagattataacttcaggattaaattataagaatgataaggttttacttgaaagcttataagaatatttaataagatgactttttggggagagatattctcttttcatcttttaataatttatttccagagctctctgcagtagttttatttgtaacattggaatgaggggatgtttgttcaaaaactattactgcttatgtgttcatttagcatatttgggttgtatgatatcaccctatttctacctcttgatttctttcttaaaattcacagaagtaaacatataccatataatttttcatgtcatgaattcttggcaggattttatttttttttctggaccctattaagatttgatttattctagcttaaatcccaaagtaattcccaaatctgaaactactccctttatttaagtacttcctttgaggctgagggggtgtctgggaaggaatctgaggtctgtgggagtctggccccttggactgtctttactgcttgacagttgcatcacctgggcaagcctcttctctcagcgtctcagtacctcatcttcaaaatacacatttttattagctgacctctaagtttcatgctgtcctggaactcccttgacaatgaattattcagtttgctgatctgcaatctcaggctcatggcatctgaattggacaacagatgaggagttgagaacttagacgactagaagggccagggagggaacaaaaatgagggatgtggctttgctgaagtgtagtagggactactggtagctatggtaagctgcagatccctggtctatttcaaaacattcaagttcagatttttaaaaattatgatgctcaagtcaaacaaaagagctctatgtaccagctttgtgagctatttatttccaaactctgtttgcatctgtttttttttaacttttcatagcgatgaagaataaaagcagatatagagcaatggatgtggagggaattttttaaaggtgccaaaatcagaatgcctaatgtatttggaaagcacagataaaaccgttggataggaactggcaaggttctctatcttaggacaaataatagaagatttattctaagtattccagtatgcatcaaacctttgtatatatccaaataatcttatcatctaggaggtttcttaaaatacagtttcctgggtcctatttcctagagattctgattcagctgctctgctgtggagcccaggaacctctgatttttaaatataccgaagggttctgatccaagtggtcagaaggctacactttgagaaacactaaatctatgctcttccattttaagatgggaaatgggctcaatgaggtgaaatgatttgcccagaaataaaaatatcgacatgtacagcatcatcccccatttctgggcctagagagacatcattaattaatcatggcacatgctaacttctcaacccaccgctcctggaagctgtttccaccctgtctaagctggtccttcgttgagactttgctgcctcctctggactatcccaaggccagtagctcacaggtgatagaataagactaaaactcaaagatctttgtgcttttggcaacatcacaatcttctttaaatggagttttgctcacaagtcccatttttatccacatttaattgcacaaatccccctgtaacaaggcatgctgtgaaacaaaatgattaataaaaactcatgaatttttaagtacatttaattatttgctgtctcttggctgatgaaaagaatccatcaggcagtattcaccatttcccctggattatggcatcctagggagtatgttattccttttactttccaggaacttattcaactattaacagagtgcaaagaataatgcctctccgtgagttaagattgaatatgacttggttctaggattgacacacagaagctcaagagatggaacccactgtatttataaagctggtctcgcaaagccttgctgtagccacatagcagataagcagttgagaaagccagatagtggagctggaggccactgtaatttagttcccaccctgtgataaagcacaaatagattagacctgtgcagagccagatgagtgcacaaggaatgcttgccaatgcaaataagactaaaacaagaacacattgttggaatttctgcaagttagtttttaatcaagtacatcatggtatattagggccttttaacacatgtttttgacatctggccctgcgcggctgacagttaaattggttttgtgattgacggagaaatatgttgtagtattgaatcatcaataacacttaaaaacattatagtgcttgttgattttttttgtcatcaatgcccagtcaatagtacgagtgcttagagcaaatcgacctactttccaaacgattctgacaccttctggctgttaacatgtctgcttaattttattaccttttctttgaagccaagatgatccctaattgagttctccttccttccttcagctcttttaattgcttgttgtatgccagatgatttgcccagctgtgggtcaagaagactcataggattttagtgctgccctcttgaaagtggggctgggaggatgatcatgcagtgaaaccacgtgaaggctgccgagtgggaataagtgccacgtgatccagccagagggattcctgggaaggtttccaaatagtgagacgacaggtccttttggagctttagaaatgtcgctccaacagccatgtagtggaagggatgggacggagaggtggctgggtaattggttgtagtgtgggcaaaaggcagcaaggtcttggttgctgaaatcattaaaaacccttgagagattgaccatgtactgtggccatttccttctcttgtggatcacatagtcatccactcaccattgtcacaggtaggtaaactaggtctgggatcaagaagaaacaaatataggcaattaatagtttcatttgttatatttctgcctcctctcttataataatatatttcatttaaagtgtttttaaataattggaaaatagtaatggtacctcctccgctgaaagcattagatatataaattattgtcagtggggtagaacagttgcttcctcgggggatcttaaatcacaggctaactgttcaaactaacttccctctgcattaaatactattttacagttgtcttatttatcaggcattgtcttgcactatgcaattataagaatataaaagatagtatcaggatccttggccacagttgttgcaccagtattttttaacatggccatccgagaggaagtttagatatgtgttggataatttcaaactaatttcagaaatctaactcaagctttacgcagatggaattttcgtgtgcatgtgtgtgtgtgtgtgtgtgtgtgtgtgtgtttaagtttcttactttgatatcaggcagattccctatttttggaaaacaagtctacaaagcagtgttttcatttcagtgtgaaagtcaaaggcagacctccttgaatggctccaggtgtatgtttgtggcagtgtggtctcatgggtgtggctgacagtcagagagcctgggatgtgggaggcgttctgtttatgacctgggccaccttgcatctcggagctctgggtttcctcacctctacaccgtcaccaagagcactggatctgcccttgcgcttgtgatgagggctgatgaggagagcacatcacagtgcctagcatgtagtaagccctcaataaaataaagctgctgctgaacttcgttcaaactcagccagtgttttggattctctgctgactatcaagaaaccactgaaaaaacacagaagtaaacatcctcagacacactggaaaatcacatacacaatggactgattctttgtctcaagttctcacaatgagtcccagctctaagtcctggagggtttgggtcctgccccacttcattcccatctagccagagaacagtcttcagaaaccaatgaaggctctttgatgacaaatggagaggctaagcaaagagggcggagccaagaggcatgttctacttcttcccctttcctgtgcaaggctgtggtaggtctggagtcttggtgtctgaagctccctcttctagagctgctctagaaatttgctggatactaccatgaaccaagagcaaccacagaacttgaacattacgttcctttgcaaccctgtgatattaacttttattaacaagtcaaaagctgttattggttgtccttcccaagtgctgttatgcacagcctccccacgaatccaattttgattttcttgtgtgtgttgattcctgtacagcatttcttagatgtactgcctcttattttcttttacagtatgctttggcatatacactgatgggttctcacctcttcttttttgttaattgccttacaggagagaataattgagcgcttgaaagaacagcgagaaagagatgatcgggaaagactagaagagatagaatccttccgaaaagagaacaaagacctgaaagagaaggtcaatgctttacaggctgaactgactgagaaagaggtgagtctggaaaaacaaatgaaccacattgatagtcctcataaacccatattcaatgaagctgcaagagactagagacttagtaggaggcactgtatgaaggcttggggaatgtagtaacctttcttttgtaaagctgcctgaatttaaaggaatttttttttttgtaacttccttcatctgtgatgccctatgcctatcttctctgctctgctaaccatatacaatgtagctccttgaaacttttctttatgtcttaccacatttgcacagcttaaaggattctgtatttttcacaggcccatgatcccttgcttgagataacaacagcagcgatgatgatagtaacaatagctctactttattgggtgtctgctatgtactattccttgtgtcaagtgctttgcattcatctgtacttttcaaagggaccacccaatactctcagattaggagatgtggtaccatgctggaccccaaggtagagcttaagtgtggctgctcttctggcatattatttttacattatagtaaataatttagagctgtatttttataccatagcaaacatgaatacagaatataaatgccacctgtgtttttaaagtaaaatcttatactttgaagaaattcttgcttgggggttatgaagaggatgctttgggctattcccccattcttcaagggatccctgtaaccctctcagttttcttggggatagttcggtggagaagtatgagcagcagtaattacacattattttatttaatcctcacagctctgagatgcgtggagattgcctgcaattggccccttcacacttacttttgtctgctgtaactgtccatcttctttagagctgttatagacctttcaccctgctggacggtaccacagcacagttatctatctcctagctccgcagtatttcctcactcgtgtggtactgataattccacacaaactaaagtcctgaataaattaggaatctagatgaagaaggaaaagaatggatgagtaagaggagtttcgaggaaaatcagaaagaaaatccgtatttcctaaaatttaaacctacttgctttttagaaaggagcttatttctttgttatgaatataaagaatggagttctcttcctagcttccactgctgattctgagttggaggatctgtgatgactgttgtttgtatgcgacagaagatatggaagctttgactttgtttatagcattcttcaccggttgcaagtgttatttgtcggtttgcaccttaaaatcaatgtatatacttctaatgaaaagagatcttgatgaagtggtggagcataagctgtaagtgaaaatagttttgtaaataatgccaacattgtatgactttcagatagacattttggtaaacacttgttgtttctgcatgatgtgcttggcactgggctgggtgtgtcagtcagggttctgcaagaaaaacagaaccacgttaaacattttctacagattaagaactttatcataaggaattggcttacacagttacagaggctaggcattttcaaaattcgcagaacaggccatcagcaaaagccgactggaaggtcttagacagaagctgatgttgcaatcaataggtggaatttgttcttcctcagggaaacctgaattctgctcataggcctttcacttgatgggatcaggcccatgcagaatactgagaataatctcctttacttaaagtcaactgatggtagattttagtcatgtctacaaaatgccttctattagcaactcctagattaataactgaggactagagcctagccaagttgactaaaactggctattgcatctggcaatttaaaatttataaaggaaaacaatatgcagttgccgtcagcagggagcttataatttaattggagtgaagatatgtcttcaccatgacaaagtgactggattataatatcctttgttatttctgtgggaatgatatgacaaaagtcattgaaattggaattgtagacctgggtttgagacctgtatctgcctttactagctaagtgatctttgacaagatgctcagctcttgtgagcctcagtttcctgatgtgaagaatgagaatggctcacctgttccccagagggctttagaagcaccttgctggatgatggtgatttttatcatcaaggttattccagtgtccatgaagcaacccagtgtaaattattagccaacgttgtttacagagagaccattgtgtctttagtatcttcctaggtgatgcaaatgatcaagaaggaaatacatggagtctgttttggggtaaaacctgtacatctgagtcacatagttagatgttgctatttcatatttgatgacaaacattgctcttttaggttgcaaagttatgttcagtgatatatgcaagttatttatttctgtagtttttggaattcaaactatatgtggagcctgttggtttctggacatgattagtgactggaacaatttaggtaaccctatgtctgagttggaaagattcatcatatctgtcaaatctagattgcaaaggacgcaaacataaaatttactctaaattttaaaataattttatgttaattttccagaagatgtttgtaaaaccattgatcatttatctgttaaagaaatgggatttgataaaaatgtagtaggaggcttcttttatatttgacttgctcttgggagcggatgcattaaagtcagtattttctttcgtatttgtctcaatgtctgcatagtctgacagcaataaatgtaaacggaaggttcagggtgtctgttttgctatgacatgtaaagaccaccttgggacttacatcattagcatgactttgagacgtgaaacatgcatttactgaccacaccatttggtcacatttgattctacggcaattagatcctactcgttctgtaagctggccaactttaatttcctgaccagagctgactattgttaccttagtaagattatatttaccctttctgtctactgcacactttattgctatgtatagaatcaatgtgttcaaattgaaggcattgctagtagaaatttcagtgttttactcactcacattctttctctttcagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggtaagtgaagtctaagaaaaagaatcatgcttatttaaaaatgaatttataaaatggaacaggaagagacgtttttaaaaagaaacaaaccccttatctgttgctgtctgctgataaaagaattaattaaatactcttaactttattgctaagaagtctatcaaatctgtctgtaaacctgaaaaattatctcagatttcctgtttaagaaaaacttgaaaaatagatcaaaatagtagcagaagttaaaaatattataaaaaccagccattactctctgggcaaatctcaactatcagcaaagaaaaatagaaatgttttcaacaaatcacagaatccggaagccacattagatattaataaacttttgctactttcagatgtaggtcatttttttgtaccagaactttgcaaaaagcttttctgacattgttaactttctagaagttcaccaaaattgtcaagtcccatctctgtagaatgactatttatatttgatcaaaatggccttactgtctaagaaagcttgttgtagatagaaggctttggaaaagaaataggatatttacatggcggcattaacatgttttctctgacccagacatttttgtggagtgcatttccagtcatgcattgttactttgactttttccctgtgttgtttggtatgtctgcactcattgttcacataaaactcataacattatgagtttaagcattttgtttccctttgacaactcataaacttattcaaaagagatgataagaatctaaacaatcaatcaaagcatataatacaatttgactatgtataattcatagcacacaccgggatggggatttattggctaaagttatgaaaaatatgacatggatggtcaaggatgtgaaggaatcacatatctgtgaaggaattactctagatatcttaaaatttaatatactattttgtatgatgcaatatataactgaaatgttactatatggtattcactttacagagatgtttaggaaattgtcatgagaaatttcacactaagaaagtctacttgctaatacagaaaaagataaatacaccgatcaaatcctttaataacaaaacagcaagaaaatctctatattgcaaaatatatttcccaatccactcatcatctcacttatttcaagcaatatttagttaagcagaaatcttgaacaataaataaaagaatttaaattgcccatttgagggtgtttaaatggagattgacttggctatgatgtattgggtatatgacatacattcctgacctatataaatgtgctcttcaaaatattatctatgatatgcatattaagggatgaacttatgaagaatattttttatttaataaaagttttgtgatcataaggcaggctttaagctagctttgtgaaagagagaaattcattggctccttatgaccattccctgcattattttaccttagtcacagtgtgctgagtcgagaagaaagacggcctcaaatagacctgggcatgaaagatgtcctccacctactctgatgagtcattgttatggagatcgggggctccatttattatttctataggtacatgcttgacaccttcctttttagtgtaaatcatctatgggaatttgaaatccactagtaattaaaaggaagagattcacatattgttgcttatacttttcgtgtaatgacttgactagtttaataaatcaacatttatgcaattcagtatagtttctttcaacatagctgtggtttgcccctgagatcactcagagtgtgtggtttcctttgactcgcaggtagacaccacacactgaaattcacagaccaaatcctgtaaacattgtagcattattcctgacagcattttaacattctaccacgtcactagaattaaagtaacaaatatggttgtcttgctgtaaaggacctatttcatttatgaaaagataacttatttctaagtatatacataatctttgcttatactatctcctaaatgcatagtgcagtgagtttaaatagggtaattataatttaaatatatttatgtctaacctgcaaatgctattttgttatttttggctgtctagcattaactaaattcaaaagtttaaaatattttttcagtagtctttaatttctgctaataaatagttccgtaaaaacctcaaatacccatcaccttaaaaaaattgagatctacatgaaatatttgaaaatataagccaacagtatgtgaatatacatataaacacatcatttactcatggaaaaataagcagctataaaagcttaagtgtgtctgggcctctttttaaataaaagggtacgtgacttgtgaattaaatataaaagtttactaaatgaaagctgaaaacataatagttttattatgtcataaatacaccaaaaattcccaatggaattttgctcaaggtttgtgagtgtccaggtatttttcctataaaatctacacaacattgtagatgtgtgtcgttgaacagaaaccttgtctgccagtggcaatgaaatccaaacggtgatttaaacttatttttgtcttgtaaacaatgcttgacattggtaaagggagtttttacataaaagtttgtggagaacattcagacacatgattactttaaccctttattatactgtgttaatttaagatgccttcaatactttgtgatgacaaatggttataggcagaaaaggaactcccttatacattccatcccactacttataaatgttcatgtgtgaggaaatttttactgatattagtgaggctgataaaatgatactaaccaaataatgcataattgcaaattataagtgtgctttgtaattaagcgcattcatccatcttaagtagacacccaagagttgagaagaggctgataattgacgtatggatcattttgtctttcaaaagagtatttgaggttcaaaatgggggagtaaatttaccctatgtgattagaaatcaattgagaagcaatggcaattcaaaatatgatttatgctctttagtaatttttcaattaatattatacctgaggagggagtttctttaaaccatgataacattgtcatttacttcattcaagttgaaggaaaaagtaatagaggctcttaaaaagtgtgtcttagcttaaagcaaagtaacagtttctacaatatttcaccctgtacaccttgacattgagccccagataaatagtgcaggtatttagaaaatataagttgagagtgcagtttaaaataatattcagcacatttaaacccacaaaaatttaaatcttcaacacaaaatagacaagaaaacattatagattctaaagcacttggaacataataggatatctttgaaaattatgttttctattaatccggagacaacagtagaagttggtaataggcaatggataatacagtattttggtcctgctgatttaaatttttcttcttttcccatttaagttaatccaataaagtctgactgatattttgctattgctaacctgctgtttgctgatctgtatttttctgaagatagaccgaatagaaaattcaggcttgtgttaatgtaaaagaagagctataaattcaatgataacgtttaattaatcttttattattaccatctttgaagttcaggtaataaattgcagacttggccaaaagtacttcttctgattcattgctggaggccagcacttcatgtatcatcaaaagtggacagctttctttatttcatgggttatttaacttgagaaagggaaagtaacacaaaccttacatttcttattccagctattcttttttaggagccaaagtcaacatttgtatttccctagagcatctcgctttcactgtggaatgtttagaaactgaaatttcttcttttttaacaaccaactcgtctgtgcgaatgcatggattttgttgagctaatgctgtttttctggatctttccttctttccctgtctgtgcctcaatgcctccccaactttgcaatgtagcaagctgagcagttgttcaatcagatgtacaacccagtaagtcatttctgaaagttcccgctgtaacatatcaaagcatgaggatccattgatcaccagtcacggtgtgccatactggggaggttttgaaaatatttgagtttcttcccctttccgttctgtcaaaagaaatgatctgtgctgaggccactgccatttcttttgaatgtgaaatttaaaaattaataactcaagaaaatattgccaactctgatattacctccttcttaacctcagcccaaagactatagaaaaacaaaagtcagctgaagatctaggcttatggaactcttccttaaatccttcaaacacaagcatatctaggccgaaagggataacaacatttgtaaaatagcaaacaattcaatatctgttttattcaagtgacagaagttaaaacaggtttagatttaaaaacagggttacgctctttgagattggtaaatacttgacattactgtggattttgtaacagttaaaggcatgccatttggctgaggacaaaccataatatagtctcctaataacagatagtaacaattctgattatagcttaatagagtacaaaaaggtaactagtaaaaatatttgtaaaatgagccaggtgccaccacgaattttttttatcctagtgacttgtgtgcatttattaatatatgaagcagtttgttttttaaacttattaaagaagaaaagcttttttgttcagtgaacttaagtggcttactgggaaaatacttcataaagatggctagagtttatcatttggcagatgtgatctgtgctatcatgcattctaatcacctcctatgtataaatccccttatggagaaaatgaatagcatggataaaggaaacaattgcacccacaactttttatttgttaagccactgcttcaggatacatacagcttgatctgcaagatgttcaggtgtacttagttagattcagcctccaccctccattctttacaacacattttatttttgcaaacagaattcctaaaaccctgctggagcatctttgttaacctctttttcaaaatgcagattttagcagagaagcaaaaaataatcagcttaagtttcttttcccttaacatttgaatagaagtgctaataagcaggctcaggacagtggagatgtgaagaaagacaaataagactggaatatcttcaagctcgaaaacaccctgggaaaaaatgagtgtttaaaaaaagttgtttaaaaaataagcgaaataatcccactgcaattgtttcatacttactagttaggaacaggaagaaaaccaaagaatgtcatgttttgggtgtgtgcatgacagatggggagagccttgttcctgcagcagcaaaaatataccaggaccatgctaggagttcactctccctgtcaggataggtaggaccaaagaaataactctcagttagcttttagaccatttctagaaatatcagtgacatggcatcatcaacttttacttcacttcaccccagtggtgcgtctctaatatgccagcgtgaacttttcagtcttttcagtgactaattcaaaagtcattgactgacttttctcctcaagttaattaaactaacccattggtttggcatcccgggaatatagccaaactctcattattttaactccccctgtcttggtgtccaattgttttttggactgatagggatgcagcatgatggattttctacccttaattgtcttttaaaaatgactatgtttttcttagttgtaaaaataatatatggtcacagtagagaatttgcaaccatatggaagcctatagaggaaaattaaaaaataacaggacatctcacggcacagaaataattgctggaacatttggattgttctccacctagacatctttttgttgttgctgttcttcttctctctttttcttttcttctttctttcctctctcctcttgccttctccttccctttattcctcctttccttctctcactcttgtgttactttttctttttcttatctaacactctacttcaaagtgtttatttgggtttctattctatttttttttacattattagaattttctcatataatgaactattcctccaaaatactattttaatgattgtatactattctactctatttgcttattcctctaatgttggtaatttcttcccccatcactttttttttttttttaaacttaagacgaagtctcgctctgttgcctaagactggtctcaaactcctgggctcaagggatcctcctgcctcagcctctggagttgctgagactacaaacatgtgccaccgtgcttgcctccttcctgtgccagtgatttgtaaagatcccaatagttcctactatcttaagtttcctaggaattccaccaaagcatgcttcttccagcactgattaaaaatggcctttctgccgcaccctggccaacattgagaattgtcattttacataactttgacacatgtttaggtggaatttttttttgcctttttaacttttctttctttaataactactgaagttgaggttttccagtacatttattagctttttgtattttttcttacgtaagtagtttaaatcagttaagcacttgcttttgagtttactgttttgttcattggtttatatgagttattctgtgttttatatagaatttttgccagatttatggcagttttatttagcctaaatttttttatgtatatagagaacaatttttaggttcttgacctgtacttttctttaggctttcctcactacctttattctggaaactattctctgatttcacttacctatatttaaaatgttttaattttgcttttggtatcaagttaagccctttatccatctttagttcatttttattcatgttgagaggtgaggttctaattatatttttctaaattatcaactaattatccagcatgatttatcaaacaattctctctttatccactgatcttgatactattttattgaatatgaagttctcatttgggtgagtgtcttagtttctaagcatctgttcagttttattgatgtctctaatttgttgggtcaaaattttaattattgtatctttattatatttttaaatatctagtaaaacaaattacaccttaattatttctgcttttcattttgtcttaagtctttagcctttaattttctatcattccaagtaaattttaggatcactttgtcaattaaaacacaaaattgttgattttaattttaaatatatttaatctataaaataattttagaactatttatatgttcccaatattatttctttccattcataaacctgatccaacttgtatttattccagtggctttttacagtgaagtttaatattttcccatgatatttcttcttaaagatagtcttaagcatatctatatatatttaatttttaggttgctattgtaaatgatatacttattattttattttctaatcagttatcatagctaggaaatttcttttatttttgtatgtttattttctatatggccacataacaaatttttggtgaattatagtatagttgttttttgttaaataagataattttatagtcaattctgtctgacagtctacactatgtcagagtaaacaaggattaagcttttaagtgcttctgcaagtatttttatttctagggtcgaaaggaaccttttactttttatctccttttactttagtcactctattgcacaaagtaatatctaatgacatttcttaggaacctaaaattttgccttgatatcattatttttcttataacctttctgcagcttaactatcattctactcctggagttttgtcttattattataacactgtgcaggttatcttcagttgggttctttttcttcccttggttcttaattctaaacaaataatatgcgtgtttcatcagtctcaaataccttgtttgctgtagcccttgtggtcattgtatgcagagatggtatcgggagtctttcaaaaaattttaataaatctttagaccttctgggtccctcaatttagtgcttcatataatacccttgttgctaaaaggcaaatgactgatttggaggcactgggtgcaaccttgctgttggccagggcacatttgagacccctctgatgttccccacacttggggtacccagtgcctagtaggtatccatttgaaatcctatctcttctcaacacatatttagcagggctcacattttacgtaagtgtttacaaaaaacataacaaaagccaaaaagcaggcatgtttcattccagagagatagaaaaaaaatcttgttaatgtcctgctttgtaggtcattacaggacagtatagtcccaggaacgtaatgggctgaattataaatgctttcacagtcattgtttggatatagcagtttctttttatgatttttgaagcctatttctgaaaagtattcgactcactcttaaaccagttatctcccagcacagtggaaagttacaactatttaagagataattccaggcatgcacatagcatgtgtaaacacatgcatacacacaaacacataccctataattgatccaggctttcagtgtctaaaaaactcaactaatatttgcaataacactcaacatttgaagctacatgttttgtttgaggacatccagataattacctcagttctctacattgctaattttaggaaatcccataattaaaaaggattgcattaataattacagttttgtttgggggatctttagaagtattaagcatacagttgttcttttgtgtgtatgtgtgtgtgtgtgagagagagagaaagagagagagacataagaatatttatttatatttatttatacatatcctatttgttccatctatgaaaataatttttttggtgtggttgttttaatacacaaatttttgaatattctgaatgcagttagcttgaattgtgagtgaataatttcctttagaactaagatatataggggctgggtgtggcggcttgtgcctgtaatcccagcactttgggaggtcagggctggaggatcacttgagctcaggagttggagaccaggctgggcaacatagcaaaccccatctctaccaaaaaaaaaaaaaaaacaaaaaacacacacacacacacaaaaaaaaaaaaaaaaaaaaaaaaaaacagaattaagatgtataacatttcaaaatacatcattattagtttccaaatgtattatttaggctcagcaatgatgcctggtattgatatattttaaatgaaatttaattttctaaattaggaacctaaagttttgccttgatattgtaatttttttttgtaacctttctgcagcttaactatcattctactcctggagttttgtcttattattagaaacactatgcaggttatcttcagttgggttctttttcttcccttggttcttcattctaaacaataatatgtatgtttcatcagtctataatagagttatatcagtctattatagagttataatatgttatatataacatatataatatataatataaatattataactcaataatcaccttaaaaattttcttttaaaatgtaatattttatttataacttagaattatgagaagattgaaattcttttagaagactgtagtcaaatataattttcaaaatagtttctataccctgttctgctgttaagatatgaaaggaatattaaagcgctgtcaatggacattaaaccaccaacatgccacaatcgaaatcatatttctacactgcctaaatttagcaaattattgctaaaacccagaaacagcagggaagaaaagtcatcaaatacattcgttaacattctgcttttattttatggtcatgattaattatttgtttattttgagggaaatgatttttaattaaaattggtagggtttatttcaaagggaacgtgttatataatgtaataattgaatgttccctgccttgtttcacagcaggtttctggaccaaagttaatactttcctttctagggatctggattgatgaactgccattttattggaaataatcaatgaccagtctttagaagattaaatgtaaatagacgtatgattttgatacttgacaaccccatagtttggctttagccatttttggcttcttaactttcatttacatatagtattaatctgaagttttgccttatttcctgaagtagttataaattctttcactaaaataactactaggttattataactataagttaatatactgctcatcccaagccatggtcagagtcctcttaatgcctgatctaggctttcaaagtcagttcacatcaaaacccagaggcctgcccacatcagtgagactccagagtttgttttggttattcccatttgcggggacatttccttacatatggaaatacaagaaatataattgggagtccctcaaaacttactgatgtagtatgcgatgcagacatttctgaaatgtccttttcccatttttttgtgtttctataagatgcttgagagttgctctaaatgttttaagaaatatttttgagcagaatcggatacctggatttgcctttaaactgacctgtttaatcagtggaattaaatctctatattaatgaaagaatgcttattgatattcctttagttttaatgatggtggatgtccttgaaagtgacgatgagcttgctatattcatggtaaataagatctgaaaccatcaaaagaaaactcacaccaatttgtgtttttaagaggtaaattcctgactaatgaaaataggaggacaaagttgatgttccttagaagtatagaaagggcaagccttcccagaccttgttggggagctaattgcaaaccaacatattcttaaggaaaaatattactgtgcattttcaatttatgtcttgaatgcattagaatgccatggcaggaatttactgtgatcatgatttattcaaatctgcttttttcgctgtagtgtctaaagtatgatagatccaagtctgttacctacttttgatctctatcgggagctgctagtcagattaaagaactcatgttgttatttgaaaaggcgagaatattgcctaaatacaaataaagtgcttatttcattccatttttggaggaagctcaggactcataattttgaaggaagcattggctttaataagctcaatttcctccactattttatttagtgtagaatcactcatgtctgtagatcatggtagaacacattcatgctggttactagttaaaaatttcagcccatcctctgaaaagttgtgactcaggctgaatagagctggttatgtacaatatcttttgtaaattctttagaggcttttgcctccaatacctaagcttagctggggactcaccagccttcccagtcatgtgaaactctctttcattgagtctttacatggaccctagtaatgatccaagaagcagcggtttccctgtcatctttatatgactttttcttaaagctttctgttgatttaaaaacatttaaatgacattttaatagctctcccaacaattctggcaccaagattgaaagtggcttgacataagttcttttgcctgaaaatcagtagatattgatatagagatagagagatttaactcacaggtattcttgaggttgtctattcatttgattgattgattgattgattgattgattgagatggagtatcgctctgtcgccaggctggagtatagtggcatgatcttggctcactgaaacctccgcctcctgggttcaagcaattctcttgcctcagcctcctgaatagctgggactacaggcgtgtgcctcaatgcccagttaatttttgtatttttagtagagatggggtgttaccatattggccaggatggtctcgatctcttgaccttgtgatccacccaccttggcctcccaaagtgctgggtttacaggcgtgagccaccgcacccggccgaggttgtctatttattttaaaagtctcattagcacttgaagtgtgttctgttaataatagataccaggccagtcgtaaacttggctctggtcttcattctaatgacatgacctaacttcagcatcaaatgatgtcaacagtggtacagtctagattcaggcactttttttcctaggctttctgtgcttctaaacatcccatgagtcctttcaccatacttacttacttgtttgaaaagactatgaattcatctgatttcacccactgttgaaaagtggcgttgaataatcatcttttcttcatggagctaaaataaggaatatgtgtacatacctatctctagcagactacgctgtctctgtaaacctatcagggaggctttttttttttttttttttttttttagggagtatgtagtatcttgtcaatgaaaatcaaataaatctattaacttagctgagtaacaagctgtatttctgggatgcatattatgaaataataattataataaaaacaaaagtgagtaatatctccccccgtgtttgtcattttgtagttttcatggtttttaggctaattaatttgcctaatcttttgtaaatataagatgcaggactggatttagaatcttggtcttgcaactagtaatcctgtacccacttattaaaaacggactataataataagaaaaacaaccaaaataagccacagcaactaactgctagctatttgtgaacttttaaaaattagcatcaggaaaggagttttaactgtcctaagaaacaggcaatcaaaatatacgtattcatttgttttgagggcttccagctgctcattactcagtcattaattcttttttaaaaatcttaatagccttgtttggatagttcaagaaatgtcatgaaaaggtttttaactgctgtaaaagaatggtaatacagtatgaaaatgaaagagaggttaacacgaagtttttctttagcaatttaaaagctgtgtattttaaatgcttttctgtaacaaaagtaatgattcatattgtcacaaatagaagcaggtatatggagtagttactttcttttaaaatagaatttctgctctacatttttaaagtggagattaggaaatttattcattacttaagcttaaaatgaaattattagataaatatactcctaaaggtatgttagctcaggattctctttcagattattttaattgtactgaaaaagtttaataatctattataatgaaacacagagtgcatagtaaataaatgaaaataaatgttttctgaaaaatgttggtaaaagggaataaaccagtacctgatagtgtgttgaattgacatatttttcttgttttttttttgtgtaattgagtttatttcttaaataaggaaatcttaggtttaagaacatgaaagcaactttttcccctttatcctcatgcttaaataatatgttacatgcaaaaatattatttctaaaatgattattttgtcatatgaaatttattttatttatactaatttttgaattttttttctattaaatcattgcaaagactgtcaaaccttctaaccgtagtattagtattaatttttctaaccatgcatgattcattcaatcccacagtagctgtagcttgcttgccttgttttttccctgaaattttcaaaaaagtatataaaaacacaataaatatctgctccatgtagcaagacagcagaaaaacttaagtccttaaaaattgttaacatttgattatatcacccatggattttggagatacatacgtatatgacttatctgaactttctatgttgaatgtgcactgttgtataaactacttgttttttccctgcctgctctttgaagaagtcaattaggaataatgggaaacaaggggtaggcaaaacattgcagtgcagtgttatttctatctgtctgggaatatttcagccaaaagtttattttgggaaaaaaaaaagctgtaacgcactctctcacacacaaacccacaaatactttggctgcaaattattctgcaatgttgttgctgtgttgttgcctgtgtcttttcttgtgtgtgaagctgccacccacccatgcatgtgtttgcagattcttgtctgtgtacttgttcatgaattagctcatcctcctcctggtttaggttaaatttatttaagagaatgaggatttatgggtataactgttagctggaaagcccttcctcacctccaagcctcctttcaaactatatttcctgctgaaatttctcagtggaatgacatgttcaattattagttaatcagtctcttatatgttatctggctttacatgtgcccttgatagttcttggaaaataatccaatattgtgttgttttggtgtctttgtattggaaatggaagcattttgtatgaatcacctccttaactgtgaggagttgaattgtcttaggtctgcttatcaaatgaccgggaataaagacatcacagtatctaaccctactttttggtggaaagaaaagctaaaagtagcaacatttaatggaacaaaatatcaataattgaagaaactcccctgtgaaactctaatattattttaaaatcagcattcttctaaggtagctgaaatgtgtgatttttctattttgccttttcactgacaatatacccataaatcttggtggtgattttctctccaaagttaatttctggaccattggtgacagcactgtctattgttctaaattgttgtcttaactacattctttaaaaatgtaatgttgaaggcacataatattgaagatgactccaggatgaaccctgagtttgcagaccaaataaaacagctcgataaagaggcgtcttactaccgcgacgagtgtggcaaggcccaagcggaagtggaccggttgctggagatcctcaaggaggtggagaatgagaagaatgacaaggacaagaagatcgcagaactggagaggtaaattttacagttatataaattgttggcagtgagagaacatggactgcgtggttgcccatctccggttgtggtggatttggactgtacattcatattacaagttagaaacaagtcataaatgaggaatatggcctgtgaaagatgacgtttctgtggaatactaagaatgcaattggcttatcttctgagggattatatacttcttcagtgttgaagaaaatagtggtcaactttcttgagtgatgtccatgatctagcgtttttccagcgaagtgtgtaagaaattggggctttgactacccaaaacctcagttcttttccatcacaggtaaatatttgtggtttagttttgtcttgatcaaacaacaacaacaccaccaccaacaccaaaaaccgaagaatatagttgggaattcttcattcaagatagcggaagaaggaaggagctcatatcctttggatgtctcttggcacatcatgacaaattcatcctggaggtttatctcttaagaggaccttttaaatacatatacttgaataggtcctgcatgatagcaaattctgtgtaaaaacagggagtgttgcatcagagtatttagattttcagataaatcatatccgtattgtatttatgtatagtgtggatgctaaaaataagcttgctatcaatgtcttttcctgtacttcatgtaaggaaaaaactttctgaaaaatcctacataactccataacctctgcagatttcttattggttcagcagtaaggcagaatttgtctttcccagattcaatccatatggaagagatcaccaaattttgaataaacctgtgaatgttagccagctttgatcgagacacttgtgaggccctaaaggacttcaagacatacacagagtagctctctatcatcttgtggaaagatcatgggcttcagtgacagaaagacctgagttcaaattttgcctctgctttttgccagctgtgcaggctggagtgcagtggcatggtcacaactcactgcagcctcgaagttctaggctcaagtgatccttctgcctcggccccctgagtagctgggactacaggtgcacgccactacacctggctaatttttaaaaatctttcgtagagatcaggtctcactgtgttacccaggctggtctccaattcctggactcaagcaatcatctgtccttagcctttcatggccttgaatcttgttagaagtgagtgaatctctaacaacctattcaaatgatgctttgcaagcaattggtccccaggtaaagtggaacatgtatatcattatgaacaaatgctaaaacaaataaattatcaaggccagatatggtggctcgtatctataatcccagcactttgggaggccaaggtgagaggatggcttgagcctaggggtttgaggccagcctggtcaacacagggagaccttgtatctacaataattagccgggtatggtaatgtgtgcctgtggtcccagctactcagaaggctgagacaggaggatcacttgagtccaggagttcaaggctgcagtaaattatgagccactgcactccagcctggggtcaagattcctctctctaagaaaagaaaaaaaaatctcaactttgtctctgtattaaacaagtaggttaatttccaataaaatttcaacattttccggtataatatttggtacattcaaattccaaatcaattaatatttctcttcataatagcattagtttgatgataatctgatttttattcattgtgaccaattttagcagtaaagtcaaggatttcatttttttttgaggtaactatcccaaatagaatccttaaagggctttgttttaattttaaaatgtgaggatgttctgctagtctgctggttcttaaaaagtggggagcactgtgattttagatggatctattttggaactacattttagaaccaaaatttttcttagaaaaactgacatgagatcacaggaaagttatgatcatgtctctttcattgattaggaaactgagatcttgaaaagttaaatgaccttcctgagattgggcctgtagtcagaaagatgtgaaactgtaatatgggtttcctgattcctagtccactgctctgagaagtggtgagctatgtggaggatgccctagataataatattaaaaattatagtagttttatttgtaatactagggtatgtatattgtatgtatattctatgctcactgtgtgccaggtactctgggaagcacttgacgtgcaatactgtgtaccttttagtctcacccacaatacagaaactgtcattattctcattttacagatgagaaactatgatttatacagattaagtaacttcctccaggttgcagagctcataagaatctaatcaggattcaaactcagggctgacagatgagccattgagaacaatcccttccgctaatgggccagaagaaagaagctagtacagcagcactaaacagtcaagcagccagcatacagccttcctgagcaggcattgctgctgggctgcaagagatctacctctttattagcatacaggagagaaagtgatgtgcttcacgcttagatggcattttttctatgctaaaccagccccccagaactgtaattgaaaatcaggacaagctactataaacatttacatataaacagcttaatggtctaattggacaaacaggtcttagctggacactattgcctttaaatcatcaagaatattcagatttttatttcttcaatatggaatgcattaaagcagcagtgattttacaggcatttatctttatgtactttctgcacattttctttatctctgcctttgcctccccttaaagctgatgcctcccaggcactgtaattcataaaacgtgtggtgggacctgagtctgtcccagtactctgcctgcccgtgtcttgcgtccagcagcagagcattgtctgggaaatgtctgagcttcagccccagcccaggcccctaaggaggtgggggtggagattcagaggggaagtttcttgggaaaaaaagggctcagccttggcctgcctttctgaagcattatctgctgtgctacatgtgtattctgaccaaaacatcttcttccagttgtcaagcaacctttttcaaattgggcaatattgtcatttgctggataaaactacaaaattcatacctcacaatattgacaactaaagagttcttagcaatgtgacatgtatctccattttggagccatggagaaatgtttgcaattaaatttgtaattttgaaaaccaaaaattgaacttgaaatagatttgtggtctctggcttgtaatgtgacctaccagagtgaaaggacctcttttaaaaggaggaaatgttctaaaatattccagaacttcaattgtatgcaacaaaaggtacagggttaggaataactcagacaaccttgacactggccccctcctctctcagaaggcagtatgtgtttactttctattctgttaatcttcccattccagatagcacatggctggcatttacacaatgcatttacctcttaaattccatgtgcgtggtgtttctcatcagccattaaagattttgctttttaaagtgcatgttgctctagtgtggtcccacgtgcagttatgcctgtaaactcttgcacggcccagtggggagcttctgccttggactgcaggcagctcaggggagtttgctactaggtgggtggtgggccttgagcaagtctctgagagttggtccaaattcagctgaagtctttattccatctccaatgtcagatgtcacgtatattacagaacctagtgtctaattaaaccttagaggcagtgaaatatgcagtgcttctgtgtcagtgcccatcaaggtctctgagttttatttagagtttcagaattaatcctttggtgacttaggggaaagagagaggttaatagaatctgtcaagtaagacctgctgccactatatttctcacatcccgcccatgggaaggaatcagtttgggtgacctttcatgtaattatcttaaatatgttagggattttgttggtatttgtctagaggatggagaatgcccaaattgagccctcaatcacatacctccccaatgcggagaggaggctggatccctgggggttccactcgtaagacataacatcagaatggaaaacagccttccacttaattatctggttggagaaataatatcaccagacatttggacactgagaaatcattttagatgcctaaaagagccttatctaagtttgaggaagagaatgttattttttcttctgatttgctcaataatgtactaacataatttccttgatgcctttcagagctccattcaaaatgtaaacttgagcattattattatttttaaattatgataatatcttttagaagtttcatggtacatggaaaaaacttgatgccagttttatttgttttgatataaatgtttcttgccgagtaattttcacttacatttgttaatgtatttgaaagaatttcttgaaaacaagtggcagatggctatatgccattcctagcaactttttggggaaggtcacggacatcacagacacctttgagaatttgatgaaaactgggagcccttgaaagaggcaactacatctgaaatgtgtgcttgctatttcagtttaggatttcctaaggcttggccacagaccttgatttaattacctttgatccagaaggatttgaaatggcagcttgggccagtgttgccaaagtccccacagtgatcgtgtcctgacataactctcattttagatcagttgcgcatttatgatcacaaaacactctgcagggggatttcagatacaagggattatcaaatcaacactttccccgtgtggttaatcttaaattttctctttcagttgtatcattgtaatcaacactgttttcatttgaaatgttctagcttaagctttatcctgaggatttattttattttgttttgtttttccttcccatgtgaaatacctaaaactacttttttatagtatggaatggtggggccccattgagcagaaagctggaaaagtatttgtttatccactttgtttttgcaaagggcattttacagatcaacaaaatgaatgtccactatgtgctcctatagtagcctggaagatgaatatggttttttgtttgtttgcttgtttttattttttttgcttgacaatagagattattgttttaaccaatgagacggacatgctagatatttttatacaaacaaattaaaaagtattataacttgatattttcagtaatgaagtcggaacttcgtatttctgactgaaaaaaatcactctcagcttggaaagttactctgtccttgctgcggaagctgataggtgggtggcacaccaccaaaagccctcctcagggggtctttgatcattgctatgtgcagtgctctgtaagcatctaaaatggaaatctttgaaccgaaagccaaattgctcagctccttttggttttcaaggatgaaggaaaaatatctcataggatataaccatccaacttactggttcaaataaaaatctttctgacatgagcacttacccaggtctaataccttagtagtttccatttcagtttattaaataataaaattttatatgcacacagataggaactttctctataaatattcctccagagaagggctgatgctgtcattgtactgtgggagcacacctctggttcacatcagtgctttttgtaattatacatatcagagcagctaccagtttctttggtatgatatttaatacaacagcttacagtgtgtgcccagggcttttgggggtaatataagataaaagtttgcttcgtttagttataaacctgctgatataacatctgttggctatatgtttaaaactaatgcatttccttccttttattctcttttgctatcccttttcctttctgcttatcctccaaattgctgctttcacccttgctccaatcagcttgactctcaggtcagtaatttcagtttttcttctaactgcctttccctcctaagctcaatttatggcttgcacttgtttaacaaacacatttctgaaatggttttcctcgggccactgcatttccccccgctcatttcattccatgccttgggaaggtttattttatgaaaaggatgtataggtgggaaaaggcaaggaaaaagatggaaataagtcagtgttggattatttaattctatttctggattataaaatccatgagagaaattttcatgataactccccagtgcatttctcctgagcagttcagaaaattgactgcaggatgatacaacgtggagccatggataaaaacataatgcaggatgctgaatttaacctaggagaacaaaatatctgcccatgacacagcaacttaaaagctaaatttaacagtgcaaactgttcagacttttcatttaataaatcactgtgttctgaaagatgtataatactgtttaaaaagtcacttttgaaaattatcaatgtgttagtaacatattgtacacacatgttatttcctgacattgttttggttttaactttctaacttcaattttattatccataaggcatactttaattacctagggcatagcatatggaaccaagtgtaagacctgattcattgttgactgtgtgtaccccaatattaagaaatgaaatgggcgttttgtctgaaaatgcatcccaggcttgattcctccaatgtaggaggcccaagcccataatttcttcttccttaagtcaaggacaacttctctttccaataaaacatagtaatatgtagtgatttctttatcattcaatcaatgagtttactaaaggatgctcattctaggatttgaggctatctaaacttcaaaaaaagaaagcatcacatcaatgtggcagtcagtatagttgctctattgagaggcaagcgataattattttcttctctgtacacagggtctgcaaccctttattctgccccatcacccaaaccaccaggccaatccattgactacagtaccaagttatttcaaaacaaggcatgtctttatacacaaacctgctcatctactgattttgtcccactgctggcttccaatcctggtggctcatagtccttgaatacttctctgccactctcacataccacactgcgtatcccccaagaactgcctgaacttcatcgcggtgcaggaaagcgtcattctcaaaagttccaagagatctgatcagagattaaaagcatggcccccagagaactgctcttattctcaaatttaatgactcttaatttactttctggagcagaacaaatctggtgcatctgtgtgcagaaacacagacatcataatgggcggtagggaagggtgggatggggaaggcttagaaacatgcatccaaaccttttctccaagtttttgattcactcatttaatgaagcttcaagcttttctccttgcctgcctgtatccccctccttttgccttccctttgctgccctaacctgtacctcttaatattgaagcacttgagatccagggatcccttttgctcccacacctcaagcttcctgtcagggcctttagttttttacctatacactactgtggttttttatgctctaggaacttattgtgtggtagtttttttgttttttttttcctatttcatggtgaaagaacatgaactctgactctcagaagacagggctggaaggggtgatggatgtccagtggttctctggacaaggggcagggtgtgttgataggatgtggcaaaatgcacatgccaaatctagttggatgaactataggagttacatcaaggttcatatcattccaatatcatttaacctgttgcctcaaatgaacatgatgaaaatgtgcaatcattgtgaataatcatctctggttatatttttagtgtaggaagaattgggcagctctgccctcttggaaacaaaaagtctttagagtcctagaagctttgttcaactttgacaagtttccagaattaactgtgctttattcccaatgacttccaggtttaccagttaaaataagataaaatgtaataattgaactgaatgcaggatctctgactatgtactttctttatatggcatacagttgagatacatatgtatgtgtgtgcatatatgtatatatatgtgtgtatgtgtatacacatatcatgtattttagaaaaattgtatctagtctttcttaccatagtttatggtttgccctgcacatccccacctcctaatctgaagtttggaaactgcagtaactcttgagacttttctgtgtgctgtggactccatgggaagttctccctccaactactttttcagatgacttcatttcctcttcaaactctatgtagactctcatgcttaaattcaggtggacagatattaagtactgggtttggtaaaatgcaagcatcatattccaaatctgttcaggtctccactccagtaaactccatgtctgtcaagaatgtcttcatacacaaacaggtgggaagctggagaggtttgtcaggatctctgtattgtactcgggggagggtttacgtgaaacttttatatttctagtaactatttgtgagattagcatgtgacttatgacagatgaggttatctccaaaaatgtatgcagcaattgactaaaaaaataaaaagtatcctttgggattcagttcaaagtcctgccagagaatcaaccaagtaaaaccagaagacatagacttctcccaggccctctcggtcttcagcccactttggatcccaggtcagctgattccttgtttgggcctcagtgtcccctcttggagaagagggagccatctttggagcaagtcttctgggatcctgcctgcacatgggcatcacctgtttgatgaaggggctgttggtgatggaccgcgtgcactgccctgcaagcaggctcaagctgatggctggcgcctggcagcaggcgtgagctcgttattatagagtcacttcaaacacttgtaccaaaataaactctttgtgatgtttccccaaagctgaacactgtgttttcaatccctcattcttctagcaaaaggtgaagtcactcctcccagaactcagaggtctgttgcccaaataaataatgaaaaacacctttgccagagcatccctttagtgtcctgcaatttgttctttgctagggtcagtattttgccccattccctccacaaatatatagtgagtgcctactgtgtaataggctaggcactgtgtgctggcccagcatttccaaaaaatacctgacgaaaaactgaccaaaccatttaagaaatgcggtgtgacatttttcttttttatattcatgacataggttgataacaataataataatagaaacaacaggagcagaagcagcaacagtaatacatttggtgttaattaagtgccagcactgaattaattactttttttttttagtgttctttttaatgttcacttctcataacaactgaggttgggactattattttttttccatattaggtaagaggaaacgtgttcatcaaagttgaacattgtgctaaatttatacagttagtaagaaaaggcattggtttttttaccccctaaatcaatccattttgatttacagatgggatcttttgccacttctgctccagttgcatagtaaaagcactgagaaggtctgcagtaaggaaacctgtgcagttctgttcaatcctcggttttctgaatatggtgttcattgaatatattccatgaagcactttggggaaaaactgtcctgccagctgtgcagccagcctctcctttcattctgagatttatctcccctctccagccagcctctccttttatgctgagattgaatgcctctggttcttcctgtacagatcctgcccctctaaagccagggcaggagttgcctcttccaccaaagccttccctgagcccactgactgtgtgggctctgtacagtgtgttgtgccacacatgggaggcggcagtcatgctctttaatgctgttgaacaaaggagcaaccattgggtttgtctcaccccactctttcttttctttgtccccatggagagttgctggggctctttctggaagctgagttgtctacactggatgtcatgtctggcttcagacatgaggccctgagaaaagatgtcattggttttctatcaagtcgaatgcttgtaagttcaagaaaaatgaagacagaaataaaaggagaggggaaaagatcttcatctgaacttctctcactttcaatccctatttccttcttttcctctctctccctctcctccccctcctccttcctcttcttccttgactattcattgaaatccttctgcaagtgagagtctgtgctggctgggtgttggggatatagcagtaaaactgacatgatccctcccctcaccaaattcagagaccaatacttcctgtaaggaagaatttggccactaagaaaaataatttgtatcagttatactaataattggaaaaaccaggtttcaggtgtgcttttccccctttttcctgttggggttgaaggggttatccacaggtcagaaaattatatccttctttaaagctgccttattctaatgctgacatttctggtgaagtgtcagaaaattttatgcccaagcaaaactggtagaaagccagaaatcggctgattttgctttaggtgcaaatattttattggggatggaaaaaagttgttttccctgatttataactcctgcagacataaagtgggttctatatttagaaatggttttgaacccttgaggcgtagccagggattggtgcttacacctttccgatcctagccttggtgggacttgccatgactaatgttttgctgagccagctccgatttatagaactagggctttatgctgcatgttgtttttctctttagcttttgcttgagttgctgttctggcactctataccctctagaatggtgaagactgaaggaacacaattggcactgtagttgaaacgttttatagttcagtgtgtgtctgagattccttggagaaacaacaacagcaaaattgaaggatggccccaggtaggccttataagtcatgacccagaataagagataccaagtcggtaagagttaatcattcatctgtacttttttttttttctaaaaccttttcttttccctgtttctctcatcctcttggcttttggttggtactaccatatggatgaatatcagcaaatagtaaatctctcaagatgtgttagctttttctgtaaatgctgagaaggggaaggaatttaaaaaaatagtttcttagtattattataaatcactttctagaaaaataatatcttatttcctttatatggcttttcttatgaaatgtgaattctatcacttcattatgcacaatactagctcaggttgtagagaaacccaaccatcctgtgactggactttcttccatattgggtgaaggtgcttggaatttccacactgtgtagtgtcacatctttgtgaagtctacattttggggggacctatttaaaaatgagtgggcactgtgtatgtttgtctgaggaaaatacattgttgttacgtataacaaatgctttcgacattttttttgtggaggattttgatgattttaatatttgctgctctctcattttactctagattcagagtaatattaagctaaatagatgtgaaaaataaaacagaacccagaaatcagctgattttactttgggtacaactattttattggggatagacaaaaagcttttttttttttttttctaatttacacttcgtgcaaacatagtgggttctatagaattatttttgcataagaactttagttttagaaattgtagactgtgtttggggatgggaataaattttcccttgaagagcctctatggttccttaaaaaaaaaaaaaaaagaaaaaaaaagaagaagagatagggtctcgctctgtttcccagactggagtacagtggtgtgattgcagcttgctgcacccttgaactactgggcccagtgatgctccctcctcagcctctcaagtagctagaactacaggcctaccaccatgcacagctaattgaatttttttttttttttgcagaggtggggtctcactatgttgctcagactgatctcaaactcctggtgtggctccttttccagtccaagaacagtgagactcatgttttaactccagcttgcagattgacgttctcatccagcatttttgtagattggtagccatgttaatataagtacctctcttactggcatatacggagctgtatgtacaataatttatgcttttaagtaacttttttcagtgaaaggtgtaaagtgtgtgattctcacagtgttttgatggaatgtactatttctagtgagattccacccataattttgaagacataatggtgaatattagcaagtcttgagacattttaacctgggatgaatgcaggatttcatacatagaattgcttggcaaatttttactttaggtcctgggaaaaatccctttttcaggttttgagaacataaccaccacccgtctcacatgggagcatgaagtaacgaaatagtctctcaccagccattggtgttggtcaactggaatattctcgtggctgaacagatcttgatgtgatgtgtgagttgaagtgtaagagagtggttttaaatttaactgcagagccctctgctatttaatcatatgtcagtttgatggttccaagggcagcatgatatgttgctcacagataattaccgtggagagaatgagttggttataataatgaataactgaagaatcttctgataacctgcgatgaatgggccttggtgagaaacactcactgggtaattggcagataggtgtcctatcgccttgctgagtgtgggtgctcttctgccacctaaatacgcaaagcaggggctttttagggattcctaagcagataaagaagcagtgttctaggatttcacttgtgttgtctctcacagacctattattagtttatattaatatttcattcacagtccaagttattcaagacattatctattgttagaacattcagtgtagaaaactaaatagactacctcctaagaaacaacatcatcattgctatagcacttgggacacagtacttcctttctttaagcctatctctgtatctgtaaagtggagacaattatattatagcttacctctcatgtgcatgtggttgagatgcacactgagcgtggaacacagtcaaggcacataggagatgctcagtaagtggcagtgattgtggatgtgacaaagattttcatgccaagagtaacaggtgagagtagggagttgatacgagagagaagccggctgcctccgttgcttttctagttgtaaaaacctgagttgccagaataaagactttagacattttctcccaagccattgagagatttttgaggaaaaggttgaaaacagaatcctgctgcatgcttcccttgaccccagggatatgaataagtgaacatagaaaaatgaacttatgcttattgaaaagtaatctttatatataaatatgtaaactaattcatacaatccttgtttgtcctatataaggacttattttaaattttcctggaactagagatccaggattcagctactgcctttctgtattcatgtataaaaagatctgatattgcgtttagaggatgggccaagtatttaagtgtgttccttaaacatttatctcctttattcgttaacttatttgctttcatcaaatagtgatggtatgtctgctctgtatcaggcactgggatgtaactggcactacacccagaagcagcatcgtgagagacagaagcagatccgtagtatttataatatgatatctgtgcaagtggtataatgtaattcacactgttctacaccttggcttttttttcttggcaaactattttggagatcttcccatatctatacctaaaggctttctactctttttcacctctgcatactatttaattgagtctgtctccttttgaaggacttttaggttgtttctagtcttttcctctcatgcagtctgctataattaataactttgaatagacttgatttcaagtgtatgtgaatatatctgtaggataaattcctaaatgtggaattgctagggtactatgcttataatttttctagattttaccactcgtcctctacagaggctaaaccatttacagacccatcaacaatgtgtaagaatgcctctttttccataaactctgccagtgcaatgcgcttttcaaactttatctttgttaatatggtaggtggaaaatgacccttaagtgcagttttgatttgcttttattttattacaagtgacaatagacatgtttaaatgtgtttatactttgtcatattcttttattggtctttttcttatatatttgtaagagctttttatatattaggaaaatgatacgtttgtctttgatctgacatttgtcacttttcttttatttggctaatggtggtttttgttatgcaggttttctttacaaaattattttacatagtcaaatgtattcagtcatctcttttatgtcttctgaattttgtatcatacttagaagccccttccacactacaagactataagaacaattgtcctgtggtttcttttagtaattttatgatttgtgtcttagtctgttcaggctgctataacaaaatataaactggggagcttctgaacagtggaaatgtatttctcacagttctggagagtggaaagtccaagatcaaaggtaccaacagattcagtgtctggtgagcgcctgctttctgactcatggatagagccttctctctgtgtgagaacaaggtggaaggggcaaataggctccctttgacttcttttataaaggcactcatcccattgctagtcacctcccaaaaggccccacctcctcatacgatcactttggaggttaggatttcaatggatgaattttctggggacacagtctcttagtatttttatgttctgattttctgcatttaagtctttgaaccacatggaatttatcttagtgtgaggtatgaagcatggatataaatttattttttttcctaggccaagtgaactttaaatgtcactttcatcatttgctcttcactggagctagacaggcccaagttaggtttgtctaagttcacgtagtttcccactagaaaatagggcacactcttacttgcttgttcaatatctgtctttcagtctagagtagaactttgatctagaaaggacctgtcttatccaaccagtgcctgcaaaaatagtagacacttaataaacatttacagaatgaagaaataatgtgagttgtaaagaaatggagttataaggaggtagaaattatgcgtaatttgaagctgtaaaaaaggcattcggagtggaatgtgagtcatcaaggcagtgatggaggggaaccaagtcaacagggggtgaaaggtgagccaactcttgcttcatgagacaataaaacaaccctgggtccagagtcaccttggacccaggatgggttttccgtactcttctctgtgagacccagaaggaatataattttcttctttttcctcttgggaaggccaatttctcagatttccttggtttcggtgagacccacctgtataatcgagatccctggctaactgtggcaggatgtaggaacaagtatggaaaatatgaccagagttaagaacaaagagatcttggccaggctgtgttttagatgctttgggatcgctaggtagccctgcccagtaggcagattggaatgaaaatctgaaatttggcaaagaggcattacccatggcgcagggtgacaaattctatatgaatgtcatggacattcagaggagagaggagttgggaaatttctatgaatgtggtggtatttgtgctggactagaaaaatggaaaagattttaccagatgtagaactagatggggagcctaagcaatggcaagagaggtaggaagatagaaggcatgctcagaagaaacggggctgtctgtagcttagactctgcggtagggagaagaagggcagaaagggctgatcaggacagaggaaagccttgagtactgagataaaagattttgaactttttgagcctgggatgaacataacgaggagtatcttctgggaggattaatcctgaaccatctctgtgctggagagataggcagtagcccaagctagaagcaataatgatgaataagaagacacagttttaggggatgtagggataattaatgaaatttttttaaaagacaaaagtacaaaaatcttcagcctgtatctctatcctccttgtttccagaagaacaaggccatgtttccacaacagccagcaagacagaagaaacaaataaacagacaaaaaaacctagctactaagagagcaggaagaaaataaaggcatggtggaagaaactatggaaattggaagaaactatatggaatatggaaactatatggaatatggaagaaactataggaaattatgttcctataattgcagcagaaataagaacaggctttgtcgagtacctatttgctgttagccctggtcctatgcattctgcaaggtttaattcatgttttttttttttatagcaactccaagacagtaggtgctattactcagtcccatttttgagatcgggaaaccaaggctcagggaagttaagtaacttgtccactcttatacagctattaagtagtggagccaggattcaaacttagccatttcggttccagggccagaatcataaacactgtgtctgattccaaagcaaggctttttgtgctagtatgaattggtttggctcaagcactcctgggaccatagggactactttttaatgtgcttcttttggggtggaaagctatttctataatacaaaggattccaggcgttgatgaaaacctcttataatggaagttgagaagctgtttgtgttggcagttctagcagcttttttgagctgctggtccgagtctttgccctctcttgagccggaatgtgaaattcctgtttttgaagtgagtttgagtgggcctggtgagtgggccttcatggaggcagtggcttcgtagactggagacagtcagctctggatgcgcttcaaggatcgtggacggcagagatgggggaagacctcggtcatccatccttctgcctgcttaagatggttccctgcggggaattctggggaagcagccaagagaaaagatgtatttccaggaggggttttatgcctgttccaggaatcattttttgggacagttcttcatggccccacacagtgtgattagagaaccgcagcagcatcaaagccgaaaagaaatgaaggcctttgttttgatatatgatggttttccttttggaaaacaactctctgaaggggagatggacttctctgcagcacagtatctgtatctgccttgatcttgtctgatacaagtgggagtgctggcagcacataacgaagacaaggactgagaactcaaaccacgtattagcccctgtccggctagtaatcacactgtggaatcgttccttcctcatcgttatgtcaggtcagagggtaggtatcatgccatcaagatgtagcatcttcctcctacagagcttaggtgttttttatttttttccttaaacttttaaactttaaacttttaagctgagattactttgtcggtatgcctgatagaaaggatctgtgctggcttctcagttctcccggctgctagagagagtgggatttctttccttgttttgtttttcagtttgtttggtttctcttctcatctctgatagacatcttacttttatatagttttctaaaattaaaatgtttgggtaaagtgactaactaaacttccctacattttaaatgctatttttaggctgtttttatcatacgatcaactaagttttgtaaagtttaaaaacacacaagacctttctaaaaccctatattacctctgtatttttaatgtaatttgggggaaaaataattctaagtgcctttcttggaaaactgcactctcatttgttaagcagttttaatgggccagtgtctgtgcaaaacactggtgtgcaagaatttttctaatcccaacaaccctggaagggtagtatgatttgcaatgggcatatgactaaactgaggttagtgaggttatttgtaatctgctcaaggtcactctggatttgaacctagataatctcaagagcaaggggcatgtgggaacaggcacacatggatattcccttgcatggcatcataaaaacaattttaaaaaacttattctgaaggcagtggggaacaggattgtgttttagaaagatgtctacctgttacttcccatgcaaccaaaataggactcatcaccacttctttcactcatcctcccactactctatatatttggcacttaggtgtggaagtggcacaacgttcacctgtttatctaagatagaaaactctaagtggcctgtagctcatccctcactgtaactaatccaacagattccatttctttccttttgtttccccactctcaatgttgctgtcccacttggtaatttggacaattgcagtagcctccagagagtcacaatctgtcccagtctctgtcctctactccagataaaatcagtgaggcaacaccctgtgtctggaggcccctgttccctcctcctcgcaggatgggcagaatatccaactccacctcctggctttataagctcttcacaatctggccttgagttgttttcaagtctcatcttaaaccctaagtacataaaatgtcactctaccccctcattccccattcagtgtttgccttcacccaatgttttctcattgtttgcacttgacagaccattcccatctctctatattggagcatacgtttcccattgcctaaatggccctttctttctatatacctgcaaacctctatacatccttgaagttcaaatttaatgttactccctgatttctctcaaaagacgatagttccacctggtctgctataaagacacatgcacacatatgtttactgcagcactatttacaatagcaaagacttggaaccaacccaaatgcccatcaatgttatactcgataaagaaaatgtgacacatatacaccatggaatactatgcagccataaaaacagtgagttcatgtcctttgcaggggcttggatgaagctggaaaccatcattctcagcaaactaacacaggaacagaaaaccaaacactgcatgttctcactcataggtgggagttgaatagtgagaatccatggacacagggaggagaacatcacacaccgtggcctgttggggtgttggggacaagggaagggagagcattaggacaaatatctaatgcatgtggggcttaaaaactagatgatgggttgataggtgcagcaaaccaccatggcacatgtatacctgtgcaacaaacctgcacgttctgcacatgtatcccagaacttaaagtaaaattttaagaaaatcacaaataaaaagcattttgttatcatttcccagctccatgtttctccctttcactaaactttgaatggtctaatgataaagatgataacttctttgtttttgtgttctcaatgcctgacccatggctcatgtttcagaaatattttgttggatgactaggtggatggatggatggaaggatggatggaatgataggtacatagattggcatcagggaagccaaatgggagctatttcagtgtctggacaatgaaaacaaaggcatgaactgagctagtatcaataagaattgagaggaggtaactattttgatagatattttaaattaaaatggtagagcacagtgatctattgtgtgtgatgttctgggaatatggaagactcactcctctttgactcccaatcttgggtggtttaatgaagataaagggtacagaagaaggagggtgattttggctatgaggaggcaacagttgagattttaatttcaatatattaagatgtatgtaggatatccaggattgttcaacagacatttgaaaatttgagaaaggtactgatccttactcctccaccacccagagggtgatttcagttcctttctggcattccttctttcagctccattctctctctccagcccccttcttcataccccaatctatatgttactgacatggaaagatgtccaagacatactgtaaaatgtatagtattgtccactgtatttttaaagatgtgtctatgcttgcattatgcctaaaaaatttctagaaagattgacagaaaacccttaacagtgagagtggtttattggggaagatggagggacaatataagttttctttttataaacttttttatagcatttaattttttattactagcatttgtaattttttaattaagatatatttgcataccataaaattcacccttttaaagtgtataattaagtgattgttggtatattcacaaggttgtgcaaccatcaccaccctctaattctagaattaaaatttaatcaccccagaaagaaaccccatacccattagcagtcactcccctctccctcatttattccctctttcccccagcccctggcaacgactaatctaagtatttgagtatttgagaccttttatttaattgggattatatattatgtgtttttgtgtgactgacttcttttacttagcataatgtatttgagtttcatccatgttatagtatgtatcaccatctcattcctttctattgataatattccattgtgtgggtataccacattttgtttatcttttcatcagttgattgacttttaggttgtttccagtttttagctgatatgaaaaatattgctatggacattcatgtgcaagttgttgtttgaatatatgttttcacttctcatggctgtatatctgcaagtggaattgctgtgtcccgtggtaactatgtttagcttgttgaggaactgccaaattgtattcaaaagtggctgtgccattttacattcccgctagcaataaataattgttctaaattctctgcattctcaccaacacttcttcttatttttctttttgaccatagccatcctattgggtatgaagtggtatctcattgtggttttgatttacatttttctaatgactagtgagattgaagatcttttcatggtcttattggccatttgtatatcttatttggagaaatgtctattcaaattctgtgcccatgtttaattaggttatttgtctttttattgttgagttgtggtatttatatattctagatgctagacccttattaaatatatgactgttagtttttcttgtatattagtaatttttattactaatactactatagtaattagtaatattactaattagtaattattagtatttgatatgtccttttaaaatcctgtttaatacacaatactaaatttttttaataagttgtaaagggaatagttttaaaaattttgctctcagagaaagtaagttgatttgtgatttgttatttgcgctattataattaaacatgttgtttacaaataaattactagctgacagctttatattggcactgcttttttgatggttcaatgaggtactacattttgccaaaactttaaaataaagcgaaccttgaccccaaacatatatgctcctgcaacacacatgcggccatttatatgaaataaatgcttcctctcttttggtaatgtcttagttacctttgaaatggatgcttaccttgaatatttgcttagtttttatgtctaccagtgtgactgaacttcaaaatttgagctacttccaaccaaataatttgcccatttaaatgctcagggtatggcctcattttatagtgccataaaatgaaatttaaaaagcctctccagagagctgtgattaccatttttttctttagttgttagccaagctaataaatattcttagcagttctgtcatcgtatgtcatataaaactagatctaatgatcaaacctaagagaggatcccaagcactacagccttctgtgtggctctagaggaagaagcaattcacctgatcattagacccttgggttttcggaagcaggacttaacactcaaccctgaaaggggtgtatggaggtgctcttgcaaaggctggcttactgcaggtcaactggctgcttagggaagtgaaggtagaaccatgtggccctgtgatgctatgtgttcttcagttgtcactgcagagacatttggctgggactggagatggtcatactggcttctctcttcctgtatatacagtggtgaagggtgtgtgtgtgtgtgtgtgtgtgtgtgtgtgtgtgtgtgtgtgtatgtgtataaaattcctgaccagcgactttccagttttccagcttttctggctctccagcataccatcttgggttctatagcacatgatctctctttccaaaagtatccattaaagcttgggacctttctcaaatttttgacagccagtaattcataaaggaaaaatgaattaagtccattttacctttaattttctcctgtagggcaggagagttgtttggaagtgattgctgcaggctgttaagacagctacttagctttcagggctggcaagagaaggatgaaaagtaatgagttaacctgctaagaatttggccattttaatcattcgagtctgggtatactttgtctccatttatactgactggggaaacagttatcttgataagcaaggatttatctcaccctcacctctcagtggctgcctggattccgagtagaatagacccctttatgtagcaaggggaatgggcatgttttttatgagttagaaaaagaaaaaaagccattggtatttttttaaagttcttatcagcaaagagcattactgagaaatccaatagggtagtgatgacattcaattttatttgtaccaggaatgcacagatggctggagttagcagctattcatttttagcacatatctctcattattgttaatgagaattacacagacctatcaaagggcggaaatagaggagagtcagtagtatcaaataaacgtgtatcatttttgtgcaaaggtcacatactttgaataattcctttctgtaattgtagcttcccattgttagtttattcttgttgaatttgtgtgttgtcatggtgtttttgacggcctggagaaaagcatttcagcaaactgcacaggtctgagacttataattagtcattgcagcttgtgggctcttacgcaaatagctcaatcgagatgtgtttttatgtaaaagtttctcttgattaattgcccaggaaatgccttcagttcatagagatttctaaatctatatcagaaatattctactcccaacaatttgttcggtgagaaaactgtgattctttttctgagtcatcatgttttcaggtgttgccaggagttttcttttaatcagtttccttcaaacagcaacatagaaaataaacatcaacagccagggaaattactgttccttgtcatttcacttctacatttggaatgtaagccaatactctgattttctagaagatccatattaaaatataatgttaaaaaaagaaaataatagaaaatcaagtaattaaaaatataaggaaagcagatttgagttcactatgaaacaacaagttattaagaatttgacactttatttttgaatagtatctgttttgtggtgctatatataccacagactgggtaatttatactgaacagaagtttacttctcacatttctataggatggaaagtccaagatcaggaagctggcatctggtgagggccttcttgctgcttcagcccatggtgaaaggcagaaaggcagaaaggcagaaaggcaagagagggcaagagagtacaacagaaacggtgagagagggctgaacttgtcctttcataaggaacccactcccaggacaacagcattaatccattcataaggacggtgcctccatgacccaaacacctcccattaggcccccaccttccagcattgctgcataggcgatcaagtttcctactcatgaactttgggggacacatttaaaccacagcagataaaatgttgctttcttcatgggttgggctttgaagatgttgatttcataagggttttcagtttcttcagctgagaaaggggcaagtttttcttataaatttcttctttgaaggaagaattctgattttataaggtacaacaagaaataatttaggatttataccagaaaaagggcctaatagtaatcagaatcactgcatgggctgagaaatacgaggttgagaccctatcatcaggaaaacacctaatttttgcaaatcagttccttttttctgctttatcttgaatcttaatgaaatatttttcatattcatctaattagtgttggtgtttttcttaaaaaatttgacttattacctactagtatagaaaaatccatctatacaatatgactttaaattatttctcatttctaaattatgctacagctacatttaataaagagttatccatacattatcccataggaattttcgaaaactttagttatttctcaaatctcagctattcactgataacgtttccttagatgctgtatgaagaatgttagagtaagcttactcctgtctgtctattttcaaggagtatcagatagtttttagtctttgcaatgtctctgttatacagaaggcagagcctacatgtaaaagagagatgcctcacaagcactgtttagggatatgtgtgtgtgaaataaatataaatatatatgtatgcatgtgattgtgtgtttgtcctctgatgggaaaaaatgggtatttactgagttttctgtggtgagaaggagagaaagcacttggaacagcccatggtgggtgggagtcatgtagctttggataaacagtcttacagctgcccagtgaattttttctttttggtggtaggattatcatggttagctctgataacagggaattaggaagtgtggtaaatcagaggtattcagttaggaaagtgacatgaattttggagtctaatagattggggtggagctccagcactgcctccctctagctagatgagccttctaagcacgttgctttcctgctcttcctcatttttctggtctatgtaatatctatgtcataagattgtcgtgaggattaaatgaggtgtatatacaacatgaacattgcctggtccaaagagatgctgatcaaatgctacattctatggcatacatgcttaggcacctgagttggagatcctagtggctgctctgtgggttttagatagggtaacattcctaaatgtttggccaccctgcccctgggagctctagaaacattgccatccaggtggaaactagaaagggcatgaaaaactgtgggtacccaggattttcatgaatcccactaggtaaagttcctgtcatgactctagtatggaggattatgtccattgaggaaataggcttggtcaagaagagggaaggcttatgttccaggggtcaggaatctgtacatgggctctcaagacttatttgaccctagccccttgtttgttggttttgtttttgttttttggtaacgttattaacataccctagagctagtactggtagaacgctatttggaaaccactgggttaggaaaaatatgtcatcaagtgaaactgaaacaggtgacattttagcggtggattttggaagtggttgtgttgaggcaattgtgtggggaagtggtttgttctgtcttctcatttaatcagggggaagtggtttatgccctctttgccgataattctgccactttgttatccttcattgatttttgcttcatccaccacccaccactgattctgttttactcattcacatcagactaagagaagaggtttgagttacgagaagaagagtggaaagatcagccatttatttttgtagtgtgttgtcatggggataaatacttgggaaagtgtaaggatgcataaattaccgtaaccccccattgagcataagttaagccttccagatgccttaagttgcattaatgaaaatagtttggaagaagttttggacaatggaaaaatgaagtctgttaggtagatactaatgtgaatagtccctaagaactgtttgaaatgggcagtaaaatgattatgaaatatttagaaagaagaacacaaacacaaaaataaaacaaaggtttaagaagttttaaaaaatagctaacatataatatggacattggttaatgttcaaatctgtgctgtccaatagggcagccattagccacatgagactacttaaatttaaattagttaaaattaaataatatttaaaaatcacttttacagttgcatgggctgcattttaaatgtccaatagtcacatgtggctcatggctagtctactggatagcgtagaagtagaagatttccataattgcagaaagttctattggatattgcatatgagagacaggattctgacatggtcccatgatctccaccccctggttttcacacccttgtataatttcctccacttgagtgtgggcaggtcttgtgacttgcatctagctgatagaatatggcaaaggtgatggttgccattcccttaaatagggtatatcatatggtaaaggtgatggagtaccactgccatgattatgttatattatatgaaacttcatctcagcagagtggagattctcctgctagcctcaaagaatcaaacaggcatgttatgaactgcttaggtagaaggccacatggcaaggaactttgggtggcctttcagaccagagagaagcctccagtctctagctaatagccagttaaaagctgggaacctcaggcatagaactgcaaggaaaggaatcctgccaacgacctgaatgagcttggaagcacattattccccggttaagcctgcagatgagaattgcagtctggctgacaccctgatttcagcctggtaagaccatgaacagagggaccagctgagctgtgcctggacttctgacccacagaagctgtgagataataaataaatgtggttttaggctgctaagtttgtaggaatttgttatgtaccaatagaaacctaattcagtgctggtttaaattatttttgggttgatccagtaagccacacctcagatggaccagatcctaaagagtgtataacttgctttattgcagctggtgctttgcctacctcatagaaaaaaaaaaagattgtagctttcaaaagggaatgtctaggcctagttattatgttccattctcttttgtggccaaggcctcagtaatgtacgatagtattttattatttttatatagcataatagatgccatgatctttggcatcatcagaacaatagttcaaattctgcatccctaactttttaagtatatgatgttgggcatattatataacctctctaagcgtctgcttcttcatctgtaaaatggggatgaagtgccctccatgtaaggatgttgtttcatttaactgagattatatttttacagtgtttagcacagcatctgatgcataatccaacatttgaacatggaagatgcttttattacttaacaatgttttaaaattgatttctgatagcaaataatataaacgccaacacattacttccatactctaatttggaaaatcatcatataagatttttatcttcttatacctccgttttattttatgtctggaccactgcagcccaatttcagatgggatgcaataaaagtaggtcttgcatacacgaagtgccccttgtgcttataggctgccttggctgtatattgtctgggcaaatcgccctcaacctctggccagactgcggaatgttggtttcctccagcgttagcccccagggggtcaattttcacagttgccatatgtttttatattgctccaaactgtaaatacagctgacaccctaccaaattggccctaatgtggctgtgtctaacagtggagtcgtaggcttttagaatgatacagtactccatggaattgtggcaattaaatgaatgttttgttttcaaagtgttcagattccatttttttaatttgaaaagaggtaaataatgtgcaaagaggagatatgaggtgggaagagggcaggagtttttatcttatgtcttgtccctgtcttgggtttgcccctttggtcctgaagctctgtcctcagacccgttacctagtatctctatagtccttgcccttttgtccttctcttacaaaaagggaacgttgtgttgagcttctgtttttatcttcacttactttgttatctccaaactctttgtctcagatttaatctgtctgtacaggaagaagaatcaaactcattgtgatacacttaggttccaggatgtgaaatacaatacaaatttctgcttttggggctatatccatccatagaaccttataattttttcaaaaggtgatcaccttgagattaatgggttcagagaatggaaattaacagggaaattgcagtgttcccttgttggttttgtgttctgcttcatagctgagtcctcatttcaataactgttgctgccctgtggcattaaagctgctgagctctcaccttccatcctgaagctcttctggtggaaagctaatgttcccaaataatgacctcatctgtatctagttctctaatagtcaaccaagctactggccaggggcgtcctgtgaagtttggagtggtgtgtcttgaagtggctgaactacagaacagacatagtatcctgagatttcccatttgtgctccatagagctttgtagggttgatttggggaagggaaagtgggacagtggtgggaaggaactctgcaacattctgcacagttggttggcatagcatagaggttaagagttggagatagtctctggagccagaatgattgagaatcttggctctgatattcactagctctgtaactttcgacggttccctcatctgtaaaaggagtaaacaaataggacctacctagtaaggcctttgcaagaattaagtaagttaatatatgtaaagtgcctagagcacatcatgtgatgtcacagagtaagtaatatgagcatttgctgctgtggtgattatatagccctggtctcatgttctagaccagggttcagcaaattcaggcccacaggccaaatctgaccctgctacttgttcttgcaaataaagttttattggaacacagtgtatatattaatgtatatattgttagtgtatatattagtgtatatattgtctgtggctacttttgtactacatgagaaagtagaggcaaagttaagtagttttgacagaggccatatggcctgtgaagtctaagatatttactatctggccacttacagaaaaagattgctgaccacttttccagactttggaaagactttctcagcagcataaatgagaacaagccatcagtctgctgtgaactatgtagattttaaaaatcatctgttgaatacaaattaaattcagaaagagttacccaggcttttttttcttttttgacctcggcctcttagatttccagtttaattttgaaaattagctttctaggaatgataactctaggttgtcattgttagcaccagctaacagtactcactagtattcatcatcacctaccaccctgaggacagtaggacttggcatgtcagggtgcaaatggaaggccagtgtggcttggcggtggaggataagataagacttggatggtaggagttagatctggtagaagtcaatgtgaagaatcagtccaggttttttgtggctttttttttttttttgactgggtatcatttcattggtgaggaactgacaatcattttatgaaattgaattttttttaatagaaagtgcctttctgaaaacagatgtaagagagcaaacttaattcatgtaaatccctggatgcacattcctaaataattttaagaattcacataaagcatgtggcaaaaaagggggacttgtttcatccattgaccaaagtgagggtcagttccagaaataaattaaattaaattgtcaccagcagaaatctgttggtggcaatggactaggcattgtgctagacccttagtgtagagaagacaagaaggtaggtgtgatcactgtacagagggtgcctatagcagaacaaggaagacagaaaaggagcagaagtgtggtgagttcatggcaagacaggcatggtgtgatttgggagttagtaacaggaggacctaaatttcttgataggccaagacagcttccagaggatatcatgcttatactggggtgaaaaaataaatatgagttatcagtgatgaaggaaggggcagggtgggggtgaggtaaacagtttctagaagaggaaactgcttgttcagagccgcagaggactatagggcttggcatgtcagagtgcaaatggaaggccagtgtagcttgggggagtagggtgagataagacttgcacagtaggagttagatctggtagaagtcagtgtgaagacatatggatatgtatatttttttgagacaaagttttgttctttcattcaggctggagtgaagtggcacgatcttggctcactgcaacctccgccccagcggagtagctcagcctcctgagtagctgggattataggtgcctgccaccacacctggctaatttttgtatttgaatagagacggggttttgccatgttggccaggcttgtctcgaactcctgacctcaggtgatccacctccctcggcctcccaaagtgctaggattacaggcatgagccaccatgcccggccaacacatgggtggttttacaggcagtggagatccaatgaaatgtttttcgagggaggaagatataatctatttgtatactttctgctgcccagcagagagtggattgggtggacaattggagccagcatcctcgtccaacttggacatgatggtagcttgggccagagaggacatgggtaggactcattacttcactccagtgaatatcctggggatggactcctgcttgtctggtggtggaatagtccataaggaattcaaaatgcaaataaatatatgcttacaaattggccgagtgctgtgaaacaagtgcatggggtgctgtcagagattctcagtgataggaggggcatccttgcatttgatgcccaaaaaagggccttctgaggaggcattacttcaactgagacttaaagggtaaaagtcagctgtgggaggagtggtggctgtggagaggaatcccagacagggaaaatagcctgtgcctataccttccagtgggaaggagctgctgtgttattgcaactgaaaggagactgaattcctgattctggggctaacggtgaggatggtgtgggatgagactggccagcaaagttcactggtgtgcaattttattctttgggaaagggaagccgttggaagattgtatgccaacaagtgcatgatctgacttactttgaaacacccaatcttgctgttggatggagaatggatgaaaagagaagcaagagtggaagcagggagaccagggaggcaagaagagacctgtggtccaggcaaaatgtgatggtggcttcagctctcatggaagcaggagcaatgtttccctgtttgcactcctgcgctattggctctgggcagggctttgaggcaccaggtggatatgtggagccacaacatactgaagcaggggatattttcatgcgggcacagatggcagaggaaccctgctttgaaccctcctggaagtgcatctgccaccagctttgaccatgtggaccaggaatccggagcatatagtctagtctacagtgagagcgatgtactgtgacaacatatttaatgcttaacaatgtgaaaaataaccatcccagggccactattctcagccctacatgaccaccctgtgctctctggctcaccagacctagatgggaggccaagtgataagaaatttgtttggtaaatagtaaatcagagccaggctcgttagttaatcacgtggccctgacatctgtgtgtggtctgctcgcaaggaagagcatcttattattagatgcctgtgggttcaacattgagttctgaggaggatgagaaagctggcttgcctttttccttggagtttcctgtgggctcatgccaatcttaccaagtccatcaggaggggtaggagggcatctgcagtcacccaggatctctctgctctccatccttggggtcttcctgaataggctctatcatttcttagcattggctttcaggcactgggttctgtttacatttaaggtggtgttacatccatatttgggggaggtttcagggtcagaatacgggagaatgttagaaggaatcagcccttcagaacctccgccagagtgaaatatctacaaggaaaataaacccttcttttgctaattgttaccttctgctgtgtcacctgctaagattgctcccaaggttttcttggcttgggtaggaaagtcaatggtgagtgaagtgggggagtagataagtgctctagaagagggttggggcagggggatcaggctcttgatggctgcagtggaccgtctggagtggctgctgcaaagatactggctgcagtggggaggcacagctggggttgcatgctctgtgggtccagcgggatccaagaacaggctggagccctgccccttactgagttggcacagcagaagctccatgctcctgggcacagctgcagcttcccagctgtggctctgggcccatgcatccctgcgctctcaggggccgggaagcccccagtgcccacaggctcagaagtgcctgttcctgctccctgtcctcttcccactcctggtgcctgctcctgtgtggagcaaagttgtggccaagcctgggcgctgctgcaacctggccaggtgcgcgcatgctcagggcagcactgacactccagcttcctgttgcctcggccctctctagactttgggtgctgacgagcacaggtgggaggccaggggtgctgaggatggcttggcatgggcctgcaggcacccctctacatgaatatcctgggcactgtggatggcatgttgatggcagtgggaggcagacaggtttctgggcagaaagggacagatccctggtgaagccccaccttcaagccagggacagactgaagcctgggggctgggctgcctgttctgggtggagtctgaagcccagagtgagaacttatgatgccttttctgggcctgcccatggccacccatggaacaatcagcatgcactttctcccttctgagcccatgaaaaccctggactcatccagattcacacagatgttgggactaccagctgtgggaaggagctacctgcttcagatctcctcgactcttcaggacaacctgcctgtggataggagctacctgccacgagtagccaggagctacctgctgagagctgaacactcattgggatgacctgcctgcagaaaagagctacccatttcgggtctcctgagagccgttctgtcactcagtgaagctcctctctaccttgctcaccctccagttgtccatatacttcattcttcctggaagtgggacaagaacttacgacccactgaatggtgggacagaaagagctgaacagaaacaggactgaaacacacccccaactcaccatatagtgggcggtgagaaggagagaacagctgcggctctttgggaagcccagacctagggtctcccggagccagggctgtgacaccctctctgaggctctgtggtacctggtgtctccaagcttccaggtaccaccgcatttcctggtgcccgcagtggaagttgcttgtggtacacctggtccagctgcagcctcacacggagcaggcgcctggagctgcccccccctcctccccactgcagctggaacacctggctgtgcgtagtagtcagaccccatgcttgctcacacacccctcatcactccatgcctggcttgcccttggcaggcatgggatctgaggtggtagtgtgagccgagcacagcctgctgggtcaagtgggttgaacgaacccactttgcttgtggcctcaagcaaaacccaagcaggggtgcggctggccacagaggtttccagctggtggaggaacaccctaaggatcctgtgacactgttatttataaagcactcactgtgtgccaggaactattttaagagccttaggtttattaaatcatttcatgtccccatcccctaatgagataacttgactagggttacagacttggtaagggatgccgctgcaataagaatgcagctgacctggcaacaaagtccttgatcttggacatcttactgcactgcctcttggtccccttggtcacatatgattcaaccattttatcaggctgaacaaggaataggaacatcttcctgaaggagggttttgctagtggggcctgatgctacaaggtggaggctaaaattgtctttccctccaggacgttctacttctcaagttttcaaatctggacactccctttgacacctttcttttagctatcttatgctatgttatcatgttcttggtgtgtcctgctggcctggtaaatgacaaatgatgtcttttttaagtatgttggcgttgtgagatttaactgagggtggctttgtctctgggcccttgtgtagccccaagcaccacagaggaggtggaagacacaatgcgcgatggtactcacctcaggggagcaaggaccatcggtagggagaggaggaagaataaagcaaggagggaagccaggatggaaaatgtggggatgtgggcttgggcatcctgctgcatggcttggacaaggacttatgcagttgaccatgatcaaaactagtagccaaacagctgggctgttctggagaggctgccacaaggtgcaaaagtccatgagatctggcttatcctggagctaagtcttcagaccttgctctggcttctggctctttgctgggaggagagttaggttcaagttgccacagcaggccagatcctttctcttcctggaaaggatatcatgctcatgacatttagcacatttatgcttgctataaaaaaaaatccttagaatatttatgaaagcttcctaaaatttatagctttgctggagtactgaatggtatttacaagcttcaaaaaaaaaatgaaataatctcagtggttacaagtaaaagcttctattattggaaattctgcatgcaatgtgcattgtcagcttctgtcgtgtgtgtgtggcccatctacttgagcagtcatttcaggatcccagcttacttacctatggctgtcatgagcttcctgcaatgcttccattaggataacctgctaggaatgtaactcatctcattattaaggagagtgtaagtgggagctaaatgtgtgacataaagcattcaataatgcattccaaagtccattgtttgaggtatttggaatacttgctgttctgaaatgggtaaaaagacactaaatatgtgtgcacaatattgcacaagacatgattacattcttcttactgtaagctaagagtgaaagagtgaacatgctgcggtctgttctaaacattttaccagtactaactcatcaacccctcacaatcaccctatgagttagatacagttattgttttccttgtatatgtgaggaagcttaggcacaaaggttaagaagcttgcccacggccacgcagctagaaatggcagacttctgatgggagcccaggcagtctgcttccgaggtttagccactgctctccctagaagattcatatggctgagaaatagtctttcatgggattgtgccattttacacttgcagttaaacatgcatctacttatttgtccaagagaaatgaatgcatatatccacaaaaagactggtataagaatgttcattgcaactttattcttcacagtaaaagaaaatgaaacagcccaaatatccattaacaaggaaatagctaatcaaattatagtgtattcatataatggaatagtactcagcaataagcaatgaactgtaatacaaacaacaatatgaataataaatctcaaacctttatgctaagcaaaagatgacagatacaaaaggttatgtacgatatgattccatgtatataaagttcaagagtaaacaaaagaaatccatataaataaagattagagtagtgatcacttctgggaagagggaagggccatgaggcagggtgatggcaatgctctatattttgattgaacaaaaacctttgacttgtacacttaatatttgtgcatcttcatgtgtgtatttataccccacttacacacacacacacacacacacacacacacacacacacacaaacacaccaccatacagtataaattgaagatcccatttcctcccaaaactattcccttcttcagtcatgaccactgtttttatagactggtgtggagtttccaggagtttccgttcatatgcatgtgtgtctatatacatccaaataggcattcctattttaacataaataagatcagactatatgtattatttatatttctgctacctgcttttttgagtaacagtatatcctgaaggcttttccatgtcctttgccttaatctttttagcgagcctgattttatattatgaatatacttaatttcttcagtttccttctgatggatgattaggcaattttcaaatttttacttttacagttgtaatggaaatgtttatatattatttatatatatatatttgtgcacatgtgcaagcacttttgtaggctgttttactagaagaagggtttacttgggcaaaaggaaggcatgctttggtggaaattgccaaattgatttccaaaaatactttcgttaattatactcctcctgaccaatatgagagagctagattcctgcattctttccaacaatgaatattaccaatctttaaaagtttttgaaagcagatgggtaaaaaagtggcatctttttgtttctattgagattttaaaataagttttgattttctccttgttttgcaaatatgcatatgcccttggacaaacatatgcatctcctgtcctgcactcctagctatgtaattctagaggtctcagagtctgacacgttctcaccagcaagttagagaacactttattcttagaatttgacagataattctagtgaaaatggcaggattctgttctctctgacatgctttcttaatatggtagtcattgttgaccttgaacctgttggaaatttttaatttaattcaaattccttgatggcaactgaattttgaatagtgacatcccttgatttatgaaactggtaaatttaaattaaacattgaaaactaaccttaccactatattttccaaatacttcttttaccataattgtttttatctttttaagatttgcattttgcatgtattcgtaatgctgtttttttttttctggagaaaaatttcaccccaaagaaacctttttttttttttttttttttttttttttttaaataatggagcaagtcagtctcttgcagagccttgccaagtggatggggatttggaaaagagtgatacttggttctggggcaggatagtaagaaggcattgcagtctccacgaccaggggccttaccttctagattgtggagacatttgaaagctgtactgaatttagcactttgattcattcagtgtgggtgtacttctgcaggtaggggaagatgtggagactgataggtcacttatagattttattcttacaaatgctgaagttgttgctagcaaaaatcactgtggtcattttttcactgagcatctgtgagggcattttctcttctctaagagatctagtatttttaaatttcatgactcctctacctgtatcccttataaattgccattttaacatgtgtttcaggtagccttagggcttccctgagaaacacttgagagaggggttatctggtagtgaggctctgctcacctattccaccccacttcttgcttctttcctacctgtgccagagaaatccttcttttcccttttgactttcaagtaagcattaagtaaaagaaaggcttcaactgctagaaatatgtgtgaaaactgtggaactacttcaggagagtgtggacactatatgtagctattgacagtttcatgaacaaagacaagatgatcattctcatccaccttgctctgcatctctctaattggcccaaatcctaagcagtgccattcaaaacccaactttccattttcagtcactgttgtcttaaataagggagtgtttaaaggaatggctggagataggcctccatcataatgtcaaaactagagtaccccatttttctcagccactcattctttttttttttttttgagatggagtttcactctgtcacccaggctggagtgcagtggtgtgatcttggctcactgcaacctgtgcctcccgggttcacgccgttctcctgcctcagcctcccgagtacctgggactacaggtgcctgccaccatgcctggctatttttttgtttgtttgtttgtatttttagtagagatggggtttcaccatgttagccaggatggtctcgatctcccgacctcatgatctgcccacctcggcctcccaaagtgctgggattacaggtgtgagccaccgtgcccggccgccactctttcttaattcaggaaagctttaagggacacgtgggtttagaatatgcttttttctttgggattgaaaaaacattgcagtatccctgaaagtaaggtcactgtgttcagactgctccaagaactttgtgggagctctttcactgtgcaaatgatgtttgtaataataatctgtatttgtcacccatacttggggcagggggacttttagcagttggttctatttaacactgtattctaaagtaataagattatttctttttaaaagtaccctctaattaaacaatcacactaatcatcctgacctctccataacatcctgttactgagctctggccttatttcctaaggaactggaaaatgcgcctgccttaggttagcatgggctttggaaatactgtgtcctcattcaattagaaagcaagagggcattcttaacatctttatactaaccaaaagataatttcctcaaagtggattagcatgcaagtttgacttggtggcttcacgtgtgtatgttgctgtatcaggtaaaaatggagaaatattggacaaaaattaatgcaactcaaagactaaggagatggttattatatcatactttatgtcctcttaataagtgctaccaataatatttaaatcatggcttcagttagtgtaaatattcataagaagacaaagtgttcagaatatatatatatatatatagagagagagagagagagagtgtgtgtgtgtgtgtgtgtgtgtgtgtgtgtgtgtgtgtgtgttttagagatggggccttgctatgttgcacagggtggtctaactcctgggctcaagcgatcctcctgcctcagacttccgagtagctgggactacaggcatgagccgctgcaccctcggactgtttttattagcaaggagtacactgttagtactagataatattattctactaactaaacaatgctcttgtgcttcgtttgcttggaatgggagagagtaggggggtacataatttatgaggactagaaataagagtttcttgcggagagcagttttcatttgattttaattgtttcaatttcacgtttgctgtttatcatctagttctcatcttgtttacattttaaaacagcagtgattctcagtatgttttttactgagtcagggctcagtaacagtggttgacctggcaatgctgtggtatgggggaaagggatccgaaaggaccccaaatgattctgctgctcgtccctcctcttgtgtcaatgctcccgagccctccgtactgccctcctacctcctcatgtgttggattagatttatgacagctgctgtggacatggttgcctaaatctgtggaatgttttgctaaaagctgctggtgcaatagtacacattaagcttataattcccattgttgttttcttgaacccattctttatctttagtcttttactcacttgatcactttatgattttgcactttgacatcctgtagattcattaagaagttttactccaagccccagagctttatttaacattatgattagccaaactgttattgtgtttgagctaagtgatgacaatgtatttgattggagcctcataattgttattttaaaatcaaagtaatggattatgatctcagaataagaacatgatccaaaagaataataataataattagaacagcaaccaattagaagaaaataaatgctgtatcatggaccagaggccctatgagcctgggccctgcctacctgtgcagtcccatctcccacccacatccacccttccctggattagcctcactgcagccttccagtttcttctttcctgtcttggaaattacacgcattgttctctctacttgggagctctgccactggtgtttctcttggttagctccttgtagtctcacccacagtctcactttgctagggaggctttccctggccacagcatctaaagtcatctccttccactccaccacctgtccacacatgcacatcactgtctctcacagcatgctatttgtttccttcaacgttaagaaacctaagttgtgtttccttggtacttgtccatcttgcccactggcctctaagctccatgagagtgaagattatacctgccccatttgccactgcagccccagtgccgtcctgggacctggtattaagtggatgctcaatacatatttgtagttgaatgaatggattattcagaagtatcatctttttcccaagcccttatccagatagcctatacttagtacttcctgaatctatttgtgataacatatgatcttccagtggtagaatttaaccaagctgtgctgacttttctcaggcatatgaaagatcagaataagaaggtggccaacctcaagcacaatcaacagttggaaaagaagaaaaatgctcagttactagaagaagtgcgcaggcgagaagacagcatggctgacaactcacagcatttgcaggtaagcacaggcttctcttcttaatcgctaaataactagagatggactctctcagaaatgtcaccattggtgccagaaaatatgcacagaaatggtggactttgcctttgccctgagtctagcactaacagggaacccagtaggtctttcccagggagggtcatcattttcagaatggtggccatgaaaagccaattacggtagagcctggaaatacaaggcagagtcttttggttcctgtacctcaccttaaaaggtaagggctgcatttatatagttggcaagaaacttaaaacatagaaatgtcttccttttcaatttatatttaaattgttttgggaatagaagaaggcaaatgtgtgtgtattatcacagaaggtatttgggtgaggatacattcagctgatcccagacagtttacaaaaccagttttgttttgttcaagactgtgaagctcagacacagatcattattctgtcttctctgtgaatatagttatctttcaatggacagccatatcttagaaacaaaccaactcactggaaacaccaatttttcctcattaaccacccttatttttggccaaggagtgctccccatgtactcaataaaacattcaagctaaaacagggcatttgctttgaagtttctttatttattccagtgtgcctttaaacagagcagttcaagttggccggagttcatgttaaattttggttattaattagtgtctttctccagttatatattaggtttcctccttggagataggagaagttagataatttcaatatgtactcatagttcatctttttaattggccaaaagagaaatcagtaattattccagtgtaggaaatacaaggaaataccttgcatagagcatggcacatgaggactagttagtcaatattaggtattttttttttcctttctctgtgtcctagacatgccttctggtgtcactgaaggccctttacattgatgcttgatttggagtgttcactgaatagtgagacaatagtaggtgggcccaaaacttttttttttctttttgagatggagtctccccctgtcgcccagactggagagcagtggcgcgatcttgggtcactgcaagctccacctcccgggttcacaccattctcgtgcctcaacctcccgagtagctgggactacaggctcccgccaccatgccccgctattttttttgtatttttagtagagacggggtttcactgtgttagccaggatggtctccatctcgtgacctcatgatccgcccgcctcggcctcccaaagtgctgggattacaggtgtgaaccactgcgcctgtccaggtgggcccagaactttaaagacgacctgaccttagggctcaccttgctatggtgtattattccgtaaaacaaggataataattgcatctgctccagagtagttgtgagagttaaagagtcaaggcatataaataatttagaattgtacttgggtacagaccatgcccaaaataagcattcatgactaatggttgttataataacaaggaaaaggcaaatgaaacattaaaaacgatttgtttactatatgcagaggtatttctacagttctaatctgatatacaatgagcatcaaagtttttgtcttttctatatatagtaatttcttcttttctgaggacacatatagttatggaaattaatgtcttgttttggcccatgaacttttgtatagcaatattttcataagaggccttgataactacctcataacctcttcataaaagatagcatggtctggaattgcttagttgcattcctgaccaccccaaataaaggatagcatttgaaatgcaataaaaagtaatcacgattaattttgatgaaaatgtctctggttaaggttaatagagagtaaacctcccactttcctggattgttaagcagatgtgctcagatgtagtaattactgccaaaactttctggaggcacttgccttttttaatattgctattgttttgagcatttcctgtttacaagttagcctgttaagctttaagtgtcagtcagccaggatttagcttggctggttggtggttgtggcattggcacctgttaattttgatttattctacacaagcatttggtaacaattggatacactggcttcatgatttcaaccaacccaacaggtattatatccagaaaaatatcatgtagagtattgcctacaacaataatagctagtggatcaggcttcaaagaagagcaccaagagattcaactagttggtatgaaagtcggaaacaaagttgaatgaagatagagtgactatgctttttattgttcaaaccagaacacaaaaggcaatagacaaaacctgcgtcacctcagtcaaacctggatatatagcacagtacgaaatattttacaaatccagtcttctttatttcataagtttacagttttccgacagaaattgcaaactcaaatgtcttcagggtctaggcttttaacataagaaacaggcttgtgtgtaggaaaaataatgatgtctggttctttctgcctgttttttattgtttatttttggtagagatgtgtcagttagcaattgccataataatgctgtgctgtgcaacaaatcacccaaaacgcagtggctttttagtaccaatagtttattcttacagatttgcaggttgactaactggcccagctgctctagggtgggtttggctgggcacttctactcactgcacatctgtcgtggtgcctggggcagctctgttacacgtgttcattctgaggccaggtgtcagcaacccagggaaaactaatgacagttgctgaagcacaagagaatgagcaaaaacatactaggcctcataaggcctactcttgaactgatattgtgattttcacccttggcattggcccaaagcaaagcacatgaccaagtcacagattggaaaagttcacttgactcacaaagacaaaaatgtacgggagtagatacgaggagaggtggagaactgaggccaatcattcagtctatcaaaagagacaagccctggagaaatatttctctattataagaaaaatagcatatgcataatgaaaaatttcagctgtaggtggccttagtgtgtggatatagttgagggtggtggggagctatagggaactcaagaacccttactcatctatgggagtagtggccactaagctctggttgaacactgctgtaaaggtgggcctagggtgatgggacctccgattatccaagacagtccataaaatgggaatttgtatgtgaaatctatagattttagaaagttagttgaatttttaaacactctgggatcctgtgaagcacatgtgcacatgagttgcccattggcttgcggcctctgctgcatggcctggcactctgatcccagtgggtctacattgtgtaaataaagtgactaagaatacaccctagttagccgaacttgactcattggaaagaggtggcagtttagtatttgttctgagtcccaattttgtttgaagataccttgaattattgtttctcagaggaaatcaccactatctacaggaatagggaatgttcttgatttagcttctcaaatcattttttttggagcattgacaaggagaacaggaagggaaggatgcagaaccgtggagttgaactggccagtgttcaaatactggcccttattattattagcttagggccttgagtatggcagagaatctctctgacccttacttttttcatctgtaaatggggattacaatctttacctccctgggcaggttaaataaaataaggtttatgaaagaatctagcacagtacctgacatatgtggacttcagttactagagttttctcccagagagactgataatgagcttttagtcatagaagacagtgaccattgggagtatcaaccaacaaattctttgcaactattttacactgatgagtaatacagatatagaacacacaccagtaaatggaaattcccaataaagcattaaaaaaacattttgggcaataaggaggaaaattaaaacattcttcaagttaatgttgaattgtgtgtgaaaggtggatgtgaaagatcgtgattttcttgtataattctgtagagcttttcccagaacacagattattgggcatgatatttatgtctgaccttggggctttgggcttctgtgtgtcccatcagagcccacatggaggtttttcaacaaggtgtctttccagagattcacactaaatcgtcatttccagaatgggatgccttttttttttatttttttatttttatttatttttttctttttaaagctctagctatttctcactgagtaaatataccaatttgaaaccccagtggatatccttgtagattttggctgcatttttctatgtgtagcttatcgagttaataaactaactttctaaaaaatgtacaagccaatgttttgtgctccttttctgttatatgtctgcagaattctcttcaatttattgcctgaaaactaaagtctgttcttgtgtgcttccgtttccaaattataggttcccagggaaccgtaaagtttcttctctgcccgtggttaaacccaagtgtgatcattttaaaaagcaaatgaatgttctcatttattcttgtccttttaatagaattctaaaaaaaaaagctagaaaggcaattttattttttaatttgtgcaaccctgtacagccaatatcttttttcgaaggggacttcctttactttcctcctccaattagagttggaatcagctaacagaggaagtgtaacaaacaacataaacctcaaaaatgcatagctttcagcaaaacatatagttcattatggagttcccaaggtttgctaagttgtttctttgcagaaggacgtgtatatcttaagcagcaattttttaagcttcatatctaaatgttcatctctccaagccactaagttaaattcatttctttttcaattccctgagcttaaaattgttactttaaatgtgatctatgttcatgtgttatggtacacttacctaagtactgccattagaagaaacctgaccagcagagttaagagattcatcattgtcaaaatgagtttatttagttcctagttttccatggctgtttggtaggcatggtgtagagtgatttagggaggcttcatttcagccatcattttcaacatatggaaaagatgagaaaggtcatcctaacccaggtttaaaagagaatccacatttgtttaaatttttattagaatttaacatcatgatttgtttttaatgctgtgaagtgttttatttatttgttttgcagttttctaccttgatgggtagagattgggaagttccattaagttatggataaatcctatcacattgttgaaatatgaactgaccctcatctaattttttcagactctgttcatggtttcagacgaagagaaatactcaagtatttgttagtctacagaggacaaggaatgttgacgagtaggactgagggtcagcacagaagtgctttctttccttggggatttattttgacatttgtttttctttcacactataatcctccgcgagccaaaaaaacgacttttgctatagcaggcccctgtaggcggtctcagaaaatcttatttgacaatcagtttcaggtagccttgagttaaaatcattactctttgtagtaactcatagactgtcaggggcaacaagacatcctgtgcaatgtatttgggaactaactatttgttagaaatgttccaagaagccaagtgcaatcgtgtaaataaaactgttatatgtggagtttttcttctttcctcccactaaagtatgacttgtttttccaaatgtgcagtaacttgcatatttcttctgagaaacatcttctgctttttcctgtggatttctgacctaatcctccacttcatataggctttctgtacaaacacaatatatttctatggaaaagagaggtttactcttaatcaagtgttgcctaagctacctactaaattaccccctgaagacagagtggggttcattattcttttccaaagggttttcaggtttcactccattagtggctcttcagcagtccttggcaaagtgaatgtttgtttgccgaaggctgaagatcctgctgaatgaaacgcaacatatttctcaaatgtaatcattgttattatgggggtagagtttgaaatgacaagccttggggtgggggttttggaaaaagaaatcttgcttgaatggtatagtcatctcttatttattttgagggggctttctaagcaaactcacactattttttagacgttatcctattttgtggcttttggtccctgaaatagaaatcaataagggaaaatcaataagtgtcatccttttgtgagctccagtgaaaactagaagcagacgtggatcctttcctaaaagaaatgctatgctcagttctagagagagaggagggctgggcttgtagagtctgtcttgcctctgtttacccctgactctgatctatgggcttattttgaggtgaagcttggactataaactggagaccccatttttgtatgttcattaaaaccactgctgatgattcgtttagtcaataataaaacaagcccatctaagccagagtcctgtgtgctttctaaaatgctttcgtggggtgatcttcatgctggatcctttttctggccttgaggattggtaggaccagtttatctatctttattttatagatgaggaaactgagagtcagacaattgttcagtgactggtctgcagtcgtgagtctcattgaagataaagccttaaggaggtaccaaaagcttgagagttcttcctgtgaagattagaccaagcctcaggtttcgtacactgaaaaaaaaaacgcttcctcaggcaaaagactcggaaccagaatcatgcttcaaaagccactgggaagggagacctctgaggtgtgtgtttgggagcatctatatcttcttctattctattttactccataacacgtgcagtatcattttcaaagtaaatacggtgaaggcattactgaagaacccaaacattgaaagcaaaaggactgggagaagaaaaaaattctgacagcataccttcttactttttccaaggtagaatttatgtaataactcacacacaggacttgtgtaatccctagggtgcaatcgtgttcaacatgcatcaaaagggccagtctagttaaaccagctctccctggccaggataattacctcaggtttaccctgagttatcgctaccagaggttagtcaggggggcacctgcaaattacagtgcatgacacactgacatcaataacctctttccaatagctcaaatagatgctggtatttcagcacatcactgcccaaggcagagacctgggcatggttaacttctaaaaatgttaactttgacttatggcttgtccaaagcattgccaaactatatattcaaacactccagattaaggaaatgacaatcaatgacataggcaatgatttagatggaaatcttgcaaaaggaaaatacaactattaaatcagttcctattcacttaatcgtctgtcctgtaatacacatttgggaagttggtaacttgaatttatgacacttttaatttcttctctgctattacactttccctctacatcttatttatgttgcctggaaaaagccctacaaggtttgagcaatcataagtttttcttactagaaaggaccttagacgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaaaaaaattagccgggcgtagtggcgggcgcctgtagtcccagctacttgggaggctgaggtaggagaatggcgtgaacccgggaggcggagcttgcagtgagccgagatcccgccactgcactccagcctgggcgacagagcgagactccgtctcaacaaaaaaaaaaaaaaaaaaaaaaaaaaaaaaaaaaaaagaaaggaccttagacttcatttaatacaagctccttgttttgccgatgaaggaagtagggcccagcaaaggcaaatgacctgcccacgatcctagagggagttattggcagaggggagaccagatcccaagccttctgcatccttgcccagtgccatttgtgcaacccactggttccataaggtaagactacctttgataggatttgaatggttaaaatcttcaagcttatacctaaggcttgtgcccctcagcattgggtattagattgagcatctaaaattatataaaattagttagttattgtgaataaactaagctttatgtatattttataacaggatattctatcatttcctgtgcctctcttatgtctttaaaactagggtaactaaagaagtagtaaatcggtggtggagataattactgtgagaacagagtacagagtttaggactctttagataataaataaaaattagtttaagttatttatatctttgccatttttctccatccatgaaaggatgtcacccataaagagagtcaggaagtctcttgtgatggaaaacaagtgtggatattttagaaaattcaaccaaaagaataatagctgctttttattgagcaatgaagtaggccaaggataatgtcttcagttgtgttccctgggaaattgagactctgagatgaacatgcaagaagtttattgagggtgctctcagaaagggagggaagtgggattaggcacagggaaaagtcaaactgtaatgtagttgcagcaaaggccgtagcagtccctatcagttgctctggagctgagatagccatttggagggctgttgactctaattgagtcaatagaggtgggcaatgccaggagaagggtgtaatcttagacaaggcagctctcagggaaagcacatccctggcacttggagactgtcttggtcctgaaggggcatcagggcagtgcatctacatgtacagcaaacacctgatgtgtctgttgcaccctcttcattgacacccatggcaggtacacgcaactgatcccaagacaagtcttacccacccagcttaataattcttttcaatattagcagccattaaaaaaagcaatcatagttggccaagttgctgtgtacacacaatgaattgtttaattgtcccaacaaactaatgaagatgttactatctttgaaaccactttacagataagaagattgagacttagtgatgttaatttaagcaagagaaagagccgatgctgtttctcaggtctcagtcataaactggacacctttctttctcctgagtggaactgtttctttgcatgccttttattgggcacagtaactgtatcaacagtgaagatgctggtcaggcccctccaaaaacatagaaaaattaggtggcataaacttgggtaacggggttttgcatggattttatggaaacggattaagctttattttaagtagtgagttagacttaaatgcttcttaaatgtgtgtaagactctgccttcagttcatcaagcattcccaatgatgttttttgaggacttttttgtgtgctaggcactgtgcaacctactgagatgtaacaacaagtaagacaaaattccttacatttgaatatctcaagatcttttcttctgactaaagatgtcctccccccagcatttgatttgcagtagcttctgaaagtaaaccagaacatgcattactgggctgctgcgtgctctgagacagaagagtatttgaaagaggtaacaatgaagttgtggctgcagctggactcttggctcttgcatgctagaacagaagcttctggaaggccttttggacctcaggtcatccgtggggccctgagcttctgagtgggtgagagacgaatgtatcaagcaggaagtgaggggatctgggttttagtctaggctcgagtgatttttttttctctaagcctcagttttctcatctacaaaagaggggcttgtattgaagtaaggccctttcaactctgaaatcctggggtctggggactaattgaagggtgcacatatgtggtgatttaaaagcaccttccaagcaggggaggctcatgggccaactagtgaggctgctgccaaaatagaacatgcaggtcaggagcagggatgtcctcccattgggaatctagggaagtcagtcttcttggcaccatcctggtaatatagaatacctggctttaaatgtaagtcactctaagaactctgttttccatctggagtgcagggtctgccattttgagaatttcatagtgtgcactaacacattttgttttctttagagcaatcggttataataatacatccaccaattgttacttttttggtgcaagatggattagaactctgacagtctggacacaagatacacagtgcaggaacttctcagaattgagccacctggcttacagacatttctcaagggaaggaactatgtggctttaaaatgtaattgtttgtgaagtagattattgttttaataagccactatgtcagcaggggctatttttctcctaattgttcaggtcatagtgagctgtgggaaaatagaatagagactaatttgactaaaagagggttgatataatctagattcacatttcacaaaacatgtttatcagagtgatggttctatggaatactataaggaaaaggggtttcatttgtcaaatgcctctggaaaataatacatattcttttaggttaagaatactgtgcatattaacatgttaaaggctctgagaagtcctgcagtcaaaagaaatgtttgatattcttcaatccagaatttctctaaatcacttgacaaagggagcccttttctttcccactagggcatttattaacattgcaaagtattagcattttatggaacttgggcaaatgccgatttaggcaattcttactgatgataactgacatatgcaattacttcttggattagagtttgaggttggtcaaattctgcggtgatactttattaagcataatattgtctttgctgaatcaaaattcacctggattgcccctgccactttgttgaaaaacagctctgttataatgattaaccaagaaaattctaattctaatgtacttttaaaaaattgtacctcattaagaaaactgatatgaagcaaattgaaaaatgtttatgaaaggtacagtaatattttcatctattatttcttgatcccagaatccacattgatttctaattacaagttcacattatgctatactccaaatccaaatctgataaattttttttaaaaaaattgatgactgttttgggggaaggtgtggaaatatttccaggtttaaaatataaaattgaaatttttaagtatccattgttaattgtaacttggatgcaattttacctttttttctgctaaggcaatatggaatatagtgctctaggctcatgttatgctgtcaaagtcaattatacgggttgaaaatgaagcacagagcgtccctgtgtcattaccagcagacttgtttttattttggttgtacttttttggctgtgaaaggatccttataagaaattagaaaaccgcacatttaaaaatgttaactgttaaacaatataaccttgagtgtacatctcctagatgcctgggtctgttcagacatgggcctgtgatttctgaatgaactgcacctctcttaacctgacttaatgacggctttaccttttactcatcttgcaaggttattttcctcctagtggaaatgagagattaaggtcgttcttgactgttgcttggttcaccagaataaagtttcacttcacaggaattaccacatgtacgttagagtccagtggttgagaccagggtagtagttagaatgagatcatagttagctatgaagtctgggagatatatggcagttgggcaaggacattcttttctgtaatgtttttaattctcaaagcttattgtttcccatataaaaataaggacatagctctatattttaaatgcttctgaaatgaaagttttaatctattcattcattccacaggcatcatgttgggctctgaaagaacctcttggtttttcgaggctgggttcttgcttctctctcatgccctgtctaatggacagacagaaccatgaagacctaatcataagacatactaggaaatgtgggcgtagggctttttggtagattggactaagcagcactacaagtttaaaacatgaaccttctaagtaaaggcagcttgagtttttccacccaagtcagctcctgcagcattgctggggctccctgcatgtgtttctaggctaagagctaggcctctatccctggctctgatgaccacttcttcccgtcatttatgagtcagtaaatataatctcatgtacccaaacataagccaccctgaatacaaactcatctactatttctcaaagataaattttcaagtttcaatatagaaacttacagagatatagataaaataatcaagatgtctacttatgacatttatattatcagtttagttacattcaaaatcatttattacacaacatgtgcttttttttactcttgtatttcatggaacaatgtcacctgaactctccacaagcctcctctgcctaacagtcagtgacccccctggaggtgcttttccatcatctggtgcagccttccctgcaccttatcttcccctctgagaggtttgaccccagtaccttaggaacccatgtgtgaccaagtagctggagtcttgaacaaagccacagccatctactcagatcattagcttgttttacaggttttgagtaggtgtgaatgttttttatctctttaccaggccgggctgtaattgcttttttgttttgttttgtttttgagacggagtctcactctgtcacccaggctagagtgcagtagtgtgatcttggctcactgcaacctccgcctcccaggttcaagtgattcgcctgtctcagacttccaagtagctgggattagaggcctgagcctggctcatctactaactggctaatttttgtatttttagtagagacaaggtttcaccatgttggccaggctggtctcaaactcctgatgtcaagtgatctgccccacttggcctcccaaaatgctggaattacaggcgtgagccactgtgcccggcctgtaattgcttttctaagggatgtttttaccacgtgggttaagatcattggcttctgtgttgactcccgatgctgtcacttactagctgtgtgttgtgcaacaaggttgataagtttcgggtgatggtagtacttgcctcctagtgttgtgtggtcatttagaaaacagcatccggcacagagtaaatgcaggttgatgccgtgatgatgttgctaggatgctgatgatgtcatgttgtttttcagcatttacactggtgagggctctgtaaagaccttacttaccatagcctatagcaccctgtgccattggccctggctctctttgggaccccctgttgtcctcccattgtttccctcactgactgctccagcactccagtctccaaaccctccctgcccttggaacaagctggtcccttagctagaaggttctttcttcaggtatgtgtgtgagttacttcttcatttcatgtaggtttctgctgccatgtcgttttctcagacaggctttctctgaatgctctttctaattaatagttcttgtctttctttatgtttctgtctttatttttcttcatcacttatatcacagcctaaaataataatgtacagttatttgtatacttatctgtctttcccatgagcacataggcactttgtccatcatccctcctcctagaatgtaggactatcttacgtatccaaaacagagttggcccttggtagacattcaataaatactttttgactaactgaatacatgagttattataagtgagcagagttgcaaataagcttccatagcagctctgaggattggtagtggcttctcagcatgcaggagagaaggactgaggctgtatctgtgagggaagagaagagtgccaacgccaatcagcccatgcagggggctcgggagagagcaggagtgtgtgttctgcctgagactcaatggagacctccttcgaagtgaggacctgtgtcttttcagtgcctgataggtaataagataattactattaattattcataaaatgagatgcatgaataactgaataatcagataggctaaccatgaataaagaatgcactatttagattttgtcatgaagtttgtttgaacagagattttctgcaagaggcattcttgttggcatttgaagatgtgcattattgttgagctaccctagctgtttttcatttctccttgaagttgcagagggcaccttcctcattagaagctgcttggaatggctgtctggagagcagggagggcagcgtaacaaaggggccagaggaaacctaatttccaccctgtcctcagagcaatggccttgtgtggcaggcaccctgtatgcacacatgtagggcacatggcctgcagactggaaaaattttcagaaaggtggcaaaatgagccagcaggttctcagagcaactttttcttcatactttggttctctaagtgaagccatactttttctgagtgtttagatcttggccaatagcacttatgtgagcaaggaattttctcactagccaagagtttgttcattgtctaattgacagatggatggagtaattgagctattcagcaaatgcacagtggtcacctgctgtgtgccgggctccatgcagggaacactaaacctgtgtaagcactaggactacgtcacagccaccatcttcaatagtctagtttttggcactcacatttcaaatgaatgttttccttctcagctatcaccccgtggaactggtattcacttcccagcatggcgactattactcaaaagctttctggaactcctctggccaccttgaaagccatgcaagagatcatactcttttgtaatcacatgttcttacctaaaacccagcatttcctattttgatcagcagccttattctccagacttggttctaaaaaacatgtggctataaagttatgcttctggcagggtactgtgcctaactctgaagatggttccaaagctgtttcccaaaatgtcatggagtaaaggctacatctttggagtaggtcacagcctccaaggtcactgcttagaatggggattatgtgcacagagatgggaacagtctggcatgttttgtaaccttatctttttttcccccagaccgcatgatttttttatttgaaatgaagcaagctaatttttaagcatcatataaataatatactgattgggttttgaacttttcaaatggctccttctatactgcagaaaattcaaagtcatttgtaatcacaaaaagacttcatattgccaaaattatgtagacattgtggatgatgttgattccttaaaggcctaaattatccagaaatttcctgagttcttcccaattttttttctttgtctagatctggatgttgtttcttttccattccccatttcagaagggaggctgcatgtcagtggccatctcttttcattcttcaatctagagttacgtaggcctggaatccattccttcttctagcacttcacagctgtgtgattttgagattgcttactcttgctatgcctcagttttcttatctttaaaatggggataagaagactagctacctcatcagtttgtatgaatcaatgacttctcaatgtaaagtcattgtcacagttctttatgcatgggagtgtactctggaaatgacagtcacaattactgttgtcatcattatcattactacacctagcattgaccaaatattcagtcatattctgatatgttttaactcgaaactcttagggttaaactgtattgaagatttgcatgcctgttctgatacttttgcactgactgggagaaaaatgcaagatttatgtctttgtatactttttcccagcatcataaatttttagaacttttcttaatgtttggcagctagccataccctcattgagcacacatgcacatatggtatatatgcgcgtatatagatatatatacacatatgcatatccattttcaaatggttttattttcttgccatgaaacatcatggcctccttaattttgcttgctagagttagatggctgtattttccacctctaaattaaaaacccaaagaatttgacacataggcaccaaagtggccactgacttcacacagacagatacttgagacagaaagccctttcttctttgtgctcacttggtgtctggcttcacctggttgggcaaagtgaactatgcgtaggttgagctaaatatggccttgcatacccacgcactggaggtgggcaaagggttcctgtaaatcgagaggctggacaccgtctccagtccagaggccacaggagtgaggtgactgaggaggaaatggcacggctcctgtggccacgcggtttgcctgcagttggtttgagccacatagagctctccaaacggactttgacggctacttggttaatttgattgatgctatggggaggcaggatccctgaagagtatttatatagccctgcacatataggctgcaaaggcagccacaaaaccaagctaaacacaaattttagccatgaaataaattttagaaacactgtatacttccctgttggtttaagtgcatacaggtatcgttattctttcttctcatggctgaagaattgtgtttgctatctttattgttgcttaaattttgcaattaaaacttgacttgccaaaacccatgtacagctgtttcaatgagaatttaagattcttttctttggtttcatttttgcacagagggtaggctttctcacttctaagcctaaaggttggcatttgagattgggcatggttactttctttattctctctcttttttttttttttgagacaaagtcttgctctttcacccaggttggagtgcagtggcgcgatctctactcactgcagcctccacctcccaggttcaagctattctcctgcctcagcctctcgagtaggtgggattacaggcactcaccaccatgcctggttaatttttgtagttttagtagaggcaaggtttcaccttgttggctaggctggtctcaaactcctgacctcaagtgatccacccaccttggcctccgaaagtgttgcaattacaggcgtgagctaccacgcccagtgctttctttattcttcaaagtaattaacaataccatttttgctggccagacctatgtattaattgccttctttttttcatggctccttattaaaaggtaagtatctcaagatagtttgcctcattctagctgagtattcgctgaaaaaaatttccaggatggctcagtcatcagagtcatctgttacttttggaagattttactatagttctgtcaaggaataaagaatcccactggacacttgcttttatgagtggtgaatgtattgggaatatattttaaggggtaccagaaaggaaaagagggatgattgtgaaatgaggagtgtgcagtattcaagctaagatctgaaggcagagcagaagccagccatgcaaatatttgggggcagtgcatttcaggtaaaggaaacagcatgtacaaaggtccagaggtgagaacgagcacagcctgttcataacagtatgaaccaggcagaattactaagaaaacatgatatccatctcttagggttgttataaagattaaatttgatgaagtgcattaaatacttagccccaggcaagcaatagcaatagatgtcataataataacatcattattgccttcatctgctttaaagttcttctcggtacatagaaattctttaaaatactttaacagacataaaaggaaagaggcattatatttttagtgactactcaggccttttagaccctaggttatccatcatggaagcttttctctagcctagctttccttacttagacatactgtctgtcttcaagcagatctgctttgattcatgaatagagacaagcaaatggaagttggatatgaaatatttattgcagcaatgagaacttatgaaaacatgggaggagacttgttaggttctctatttacagaacaaattctacacaaatccagttgatcgttattccatagttaagttatagaatccaagatgatgagagttgaaaaaagaagtaaaaattttaagtacagtacaaatgcagaaaacagcttaagcacatgcacagcaaatgatttttataagatgaacacctttgagccaacactcatgtaaggacctagaactttttagttaccccagaacctctccaagaggtcttgctcaaaccacaccacttcctcctttctttttttttttaaattatactttaagttctgggatacatgtgcagaacatgcaggtttattacataggtatacatgtgccatgctggtttgctgcacccatcaacccatcatctacattaagtatttttcctaatgctatccctcccctagccccccacaccccgacaggccccagtgtgtggtgttcccctccctgtgtccatgtgttctcattgttcaatttgcatttatgaatgagaacatgtgctgtttggttttctgttcctgtgttagtttgctgagaatgatcgtttccagcttcatccatgtccctgaaaaggacatgaactcattcttttttatggctgcatagtattccatagtgtatatgtgccatgttttctttatccagtctatcactgatgggcatttgggttggttccaagtctttgctattgtgaacagtgctggaataaacatacatgtgcaggtgtctttatagtggaatgatttataatcctttgggtatacacccagtaatgggattgctgggtcaaatgttatttcaggttctagatccttgaggaattgccacactgtcttccacaatggttgaactaatttacactctcaccaacagtgtaaaagcctccctatttctccatgtcctctccagcatctgttgtttcctgactttttaatgatcgccattctaactggcatgagatgttatctcattgtggttttgatttgcatttctctaatgaccagtgatgataagccttttttaatattcttgttggccgcataaatgtcttcttttgagaagtgtctgttcatatccttcacccacattttgttggggttgttttttttcctgtaaatttgtttaagttctttgtagattctggatattagccctttgtcagatggatagattgcaaaaattttctcccattctgtaggttgcctgttcactgtgatggtagtttcttttgctgtgcaaaagctctttagtttaattagatcccatttgtcaattttggcttttgtcgccattgcttttggtgttttagtcatgaaggctttgcccatgcctatgtcctgaatagtattgccaaggttttcttctagggtttttatggttttagatcttacgtttaactctttaatccatcttgagctaatttttttataaggtgtaaggaaggggtccagtttcagttttctgcatatggctagcccgttttcccaacaccatttattaaatagggactcctttccccattgcttgtttttatcaggtttgtcaaagatcagatggttgtagatgtgtggtgttatttctgaggcctctgttctgttccattgatctatatctctgttttggtaccagtaccatgctgttttgatttcaagaataaccactctcctgacttctgtggtaatctctgccttactttctgtattagtctgttcttgcattgctgtaaaaaactacctgagactgggttatttatttatttatttatttatttattttcttgagacggagtctcactctgtcacccaggctggagtgcagtggtgccatctcagctcactgcgtcctctgcctcccagggtcaagcaattctcctgcctcagcctcccaagtggctgggattacaggtgcccaccactatgcctggctaatttttatattttttgttgagattgggtttcaccatgttggccaggctggtctcgaattcctgacctcaagtgatctacgtgccttggccttccaaagtgctggattacaggcatgagccatggtgtccagccaagactgagtaatttataaataaaagaagtttaattgcctcacagttccacaggctgtacaggaagcatggctgaggaggcctcaagaaatcttcaatcatggcagaaggggaagggaacgcaggcatgtcttcttatatggctgcagcagaaggaagagagcgaaggggacagtgctacacacttttaaacaagcagatctcctgagaactcattatcacaagaacagcaagggggaagtccgttcccatgatccagtcccctcccactaggcccttccttcaacactggggattacagtcagacacgtgatttgggtggggacacaaatacaaattatatcaccttcctttgtaatttttattatccatttgcctatccctatatattataacttagctttgtccacttttttctttccttatttgaaagcaagcttcaaatttttcccattggaagaacaggaatgaaataaaagtgggcatgcaaggaagatcaaaagtcaagagaaaaaaatatacaaaacttgaactcagccagggctagcaggtaagaggaagctgcttggagaaattgagaagggcagggcagtacctgtgaggggtgtggctggctcagagccccttacttctgccattgtgagggagtctcttctggagactcagagacagtggacatcaggatggcagtgctgagcaggaagttttagggggagctctctgtttacactcttctggagctcctcctctgaaggagtcaacagctattttcccagtccctgtggcttaggggaggggacccagcaatcagtagatagaaaaattgagagaaggttcaaactgggagcctctctctactggctgaggaagagggatcttggtcaaggagatggggagtactccccaccaaagaggttaactccccatggcaggaacaaagcaatggtggatagtaaccaaaacagtatggttctggcataaaaagagatacatggaccaatagaacagaatagagaacctggaaatagatccagacatctacagtgaactcgttttcaacaaagttgccaagaatgatacattggggaaaggacagtctcttcagtaaatggtgctgggaaaactggacatccatatacagaagaatgaaactagcccccagtctctgccatatacaaaaatcaaatcaaaatgtagaaaagacttaaatctaagttgtcaaactatgactctcctaaaagaaaacactggggaaactctccaggacattggactgggcaaagatttcttgagtaataccccacaagcacaggcatctaaataaaaatggacaagtgggattacatcaagttaaaaagcttctacacacaagggaaacaatcaacaaagtgaagagacagcctacagaatgggaaatatttgcaaactatccatctgaaaagggattgataaccagaatatataaggagctctaacaactctataagaaaaaaattgaataattcgattaaaaaatgggcaaaagacgtgaatagacatttctcaaaagaagacatacaaatggcaaacaggtatatgaaaaaagtactcaacattattgatcatcagagaaaggcaaagcaaaactacaaggagatatcatcttatcctggctaaaatggcttttatccaaaagacaggcaataacaaatgctgggaaggatgtgagaaaagggaagacttacgcactgttggtaggagtgtaaccactatgtacaaccactatggagaacagtttggaggttccttaaaaaactaaaaatggaactaccatacaatgcagcaatcttactgctaggtatatacccaaaagaaaggaaatccatatatcaaagagatatctacactactatgtttactgcagtactattcacaatagccaagatttggaaggaacctaagtgtctatcaacagatgagtggataaagaaaatgtgatacatatacacaatggagtaccattcagccataacacagaatgagatcctgtcatttgcaacaacatgggtggaactagaggtagttatgtgatgtaaaataagccaggcacagaaagaccaacttctcatgttctcacttatttgtgggagctaaaaaaaattaaaacagtgaaactcatggagatagagagtagaaggatggttaccagaggctgggaagggtactggggttggagtcggggagtggggatggttaactggtacaaaaatatagttagataggatgaataagatctagtatttgataacacgacaggatgactagagtcaacaataatttattgtatgttttaaaataactaaaagaatagaatagaattatttgtaatacaaagaaaggataaatgcttgaggtgatagatacctcatttactctgatgtgattattgcacattgtgtgcctatatcaaaatatctcatataccccataaatatatacatctgtgcacccacaaaaattgaaaataaaaatgtaaaaagtacaaacaccccctgccataaaaagcaaaaaaacaaaaggatggtgcaactttgtgggatggatcattccctagggatttttagggaaggagaagaattgagtgggacaaggcttaattttgagaagttaccctgagattctgcttacctttgcaactttcctagtatgtgccatttcatgatcagtctctttatggttgttaatgtaaaatctaagacaaacctaaatagggtttatgtttccttttggaagaaacaggaggctctggggaacagtttaggaatgtggaccttcagatgggcaagcaaccagttactgggaaagcttctaatgaggcaagtccccaaatgatctgatagcaaaaacagaatggacaggggtccaacttagaactgatttgccctccactctcagggcagtatcagggatctgaattttatttctggcattgctagtaactaactgcacaaaaacaaatgaattaaaaaaagcctttggaagttacttgaaggcagttactttaaaaatatttattgagctcctcctgagtgccaggaactgtattatgcattgggtattctgaagtcaagaagattacatgacccccatcttcatagatttgccttccagccacagagacctgaaataggaaattaatgaaaaacttgtggagtgctgtggaggactctccaggggctgcctggctggaggacctggcaggaagaggccatgatgctcgagttcacctcctaatttttcagatgtagagacagaaggtgataaaggaggatgccttattccacggaatgcagtttgctagtgacagacccaagattcaaacccggatcttacttgtgttcaactgttctgtagtccatggaacataggtacatttcacaggtgaaactggaagaccaggagcctgtttctgaatattatttatttcaatccttgataaatgatataaaatctttgtgtgtccttcaaggtgtaggacttcgatcttttagtttttttttttttaaaaacaaaaaacaaaaaacaagctctgttagggcagcaggtggaatgtagaagccagcatgctaggtcttggtttgaatttaggcacagcatgtagaccttgaatttactccatgggaacatatttttccaagcttctggacgttttgctgttcatttttgtctttttctatcctacatgtctttttaaatttagttacccatgactggtagtgcttcaaatcttcaacaattccatgtcattttcccataatcatttgacatctatttaatgatgtatacactatttaagacaacttgaaaatattttaaaagttgtagaaataataataattcataaacctaaatagtaaatgggtgcccacccactcaaatctcttttctgggtgggtcattggaaatatgtacttgctaaaattccctccattgtttaaaagtgctgtgtctaatgaaatactacaggacagaaggtgttcatctaaggcatggcctggttgtaaaacacacagacacacatgtgatatacattttatagctttgtgtattttacaggcaaaacattgaaacacagtagaaatactaccgtgtacagtaaagccagctttaatagtagcatcatatggtcgtttgtctctgctggccttttatttatgcgtctgtaattatgatttccagtacttgttactgggatatttccaaacttggttttgtctttaaatcttttcttcttggaactttttccagatttcctgtttgctgggtgcgtagttctcactgtaatttggaagatcatattggggtatggcttggtctggcttcacagggacatggtccaggcatctgcccagttgtccaggacagaaatctgagccacccttagttcctttctgtctccaacatacccctgttctcacatctaattgctcactgggtcctgctgattttagcctctaaatatttcttgaatctgcaacctcctcctcatccctttcataccctgactttgttctgatcttcatcttctcttgcttagattatgcagtggcttcctgaccaatccctctgcctcaagccctgattctgttttgagttactctctatactttctcataactgccgtacctaagatgttcaataaccctgccattgaatgcaaggtataactctgagatatttattgggacattcaatgccctccgttgtcttaccctggcttaactctcatccccattttgcacgagaatctgcctccagctttaggatctggtaacactaaatagatccattctctatacaaacatatcctgctctttgtttcttctggctcaacctgctccatgcttaccctgctgtatataattgtgtttgagcagtttgttggaagtggcaacagattaaataaccttgtttaagctttgaagctactttgcaccagtcttcagagagatgtgaggatataattctctgtactgtccttagcaaggtagtgcatactataaccaaactggcccctagtcagatcaagctcacacagggaatccaagagtatatccacacagggttcattttgaatggatttgaatcctatattttaaagcatccagcttctgtgggtgggtagaaattgaggagtgactcccctactctgctgatccatctttcaggttcccactaggagaaagccttagttcttggcttttagttctaactctacattccaccccctgctccctctccccacagcatttctgtgctcttggattctttctttctgcctcactccaccttctgcttggagttctgccttctgtgccaggtcttcattcagctatatctgggtccacaggatttttgcggagagaggaaggtgatgctcaggtggggctagaaatggctttaaaaatctaaaggtaggtgaaaacaaagagtaaaaaggcccctacagagatctggactgaagatagaatatctagaacactggttggccaactatggtctgtgggccaaacctggatccctctcgccacttgtttttatgcatagtttcattagaatgcagccatgcccattcatttgtctgtagctgttttcataggaaagaattgaggagttgcaacacaggccatatggaccacaaaggccgaaattttactgtctggcccttggcagaaaaagtttgccaacccctgctctagaagacagtgaggactttcctaaggacagctttaattctaccagtatattatatgtactagaatctctacctctctgattttttgtgttgtttgatccaaggtgcttttctatggtatgtgtcagaatcccaaacagttgaaaaggcatgaacagagagtagggcaaatctgtctccttacatctataatattgtgtccccagcttaataataaggtttttaatatgtaacattttagtttggcttaaaataaatagattgccacctggatcactacagcaaatagatttcattttgggagacagctctgattaattggtggctgccttaaccctatgttgggaaagattatgaggtcccaggggactcagtgcaaggcagtgctgtaatcgattagtgatgtctgtcagggctggtgcacagaagaaatgagatccatttgtcttaagctagaggcttctccctaaagcagtagaaaatttaaaggcatgaattgttgtgattctgtctaccacaatctagactctgatctgaggtcactaagaggagagcctctacaacccagaatccctttatttgtagcctatcctggagctgcaactgaagagacagatttataaaagctattgcttttataaataaattgaaaataattccttgtttgctattatatcttctgaaccaactttttttttattgtggcaaaatatatataacataacatttaccattttaccagtggctttaaatacattcaaagtgttgtgtaactatcactgtcatccatcccagaactgaaactctatatctgttaaacagtaactcaccaataacctcatacccctggtccctggcaacctgtgttttattttctggctttatgaatttaattactctaagtacctcaaatgagccgagtcatacaatatttttctttttatgtctggtttatttcacttaactcgatgtcttcagggttcatctgtgtgtagcatgtgtcagaattttcctttttaaggatgaataatggaatattttccattgcatgtatatatcacattttgtttattcattcatcttcaatagacacttgggttgtttctacttcctggctattgtgaatcatgctcctatgaacagtgatatatacatatctgttcaagtccctgcttttaattcttttgggcatctacccagagtggaattgatggactgtatggtaattccattcccaatattttgaggagctgccatactgttttccacagtagctacaccattttgctttttcaccggcaatgcacaggcctccaattcccccacatcctcaccaatactttttgacaacagccatctcactgtggttttatttgcatctccccaatatctggtgatgttgagcatcttgttcatgtgcttattgtgtttcctttttttgagagctgtccattcaaattgagtcaacttttatagttaattcttactgctggtttctttaaagagcaagagacagatgcagtttcagctgggaatttccctgtgggggacctggaaggtcttgaggacagttacgtaggatctctgtttgattgtaattacaagccaggaacatctgagaggaaaaagattctaagtaaaatggggatgttttgaagcaactgtagaaattaagacaaagaaagaagggggtagggggagaagagctgtttgatgtttttctactggcatcttttcttcttcccaagagtgagagaaaggggaggggagacacagagagaccaaaagtgtgttgcttccgctggatttctgtttaaaataagccccttgcaaggctccaaagcctcaaaacccacaagtgacatttttaggacaattttttttttcagtgtggaggcctttgattatctcaccataattactatctttatgatgtttttcccctgggtggctatattttagtgaagcaaagtttgagttggttttgttagaaacgtcactctgggagcatgaatttaccttgctcccagtaataaaaatagtttaaattaagctttaatgtacttaaagtaactgatttgaaactatgtgggtcagaagtattctgagacagttgctagaaagttctagtccacttatttagtttgaagactaagtgactggaggaggtatgtctgggaagacttctgaatgaatacatttctctgtatgagctaatgtgtagggcaaagcagtatctctgggttgatattatacaatcgttagaatttagcaagagcaaagaggtagagagagtctgatatcatttaacaaagcttcacttaaattaggaaactattagttatattaacagtagaaattatctgaaagaattgattaaccaacaatgaatttgtttttaagatgtcccattaagtacttttttgatgttcccaattgcacataattcctagaaaacatgatttttcagttataagaattaatactctccatatatggactacattcatatttaaatctcctattaatacaaaactagtagaaaagttatatgctagttctttttcatttttgtggctcaaaataaaataaaataatttgcattttccaactttggctataatgatcttagaagccattgcattgtattcattgtctcagcatctcattttttaaaaaccatattcaggttgattgttcagtttgcgatgacagaattttgaactgtcatattgagaattcccagtagagaagcaatctccaaaccttgcctgataaaactctgtaggactgatacatgtgggaataccgccttcaaagaaatgaatgaggagttcagtgagaatcaggaggcaattctcagagctagatcggaccctgccccctcttccccaaacaccaacaccataataaggatgatagtgtttataagagtttaaagggtcataactattttgggtgcagttttatggatatatttttatttaccagagtcagccagatttcaaattcatgttggtgggtaattaaggttcacactgattcaattgaagccgctaatcccatcaattaaagcaaatatgaaccatgtagttaataatttattgcctaattgcacaaacacattcacagtcagtttttactttagtacataagcagcaaattgtgagagaggttttagggtgtgctcagaggtttctgcattcccaccagaaccgagtggttatgattcagtctctgccatcaaacttagccccctaggtttgaagcccagtgtcatcactttctagctgtgtgaccttgggcatgtcactcactctgcccctctgttcttctgtggtcaaatgggataacctcatagggttggtaggaaaaacaagataggaatttggaaaagtgactgacaaatactgagcatccaatgaatgccatacaattattgtcactgttatcattattaacctccccacttcctcttcagttttgcagaatcacgtgctctattatttagaatgaattttacattcaaatccttctttaaaattgtattagaagcagataaagaagcactaaagggttcaagtagaattcatgttgatgtatgccattattaaaatagaattaagataacaagatatggattaaatcttacataatattatgcatgaaatgtgttgattgttacctccagggagagatgatgtccttttcagtgaagcccatcacccagatgcctgttgagtttttggacagttagcaatatccttctcacttggggtgtgtgtgtgtgtgtgtgtgtgtgtgtgtgttttagtgtgcctgtgtgtatgtgtaactagatcttctcatttaaacaacagttgctgattgttgatgaaatatttattcgtttagtgcctttttaaaaccaattatgaaatatttcaaacataatggaaaatacagaaaatagtgtaatgaaatccatttacccaacactcaatacaaattaaattttacttaataaataaataattttttcatatttgcttgacatttttaaagagataaaatattttactccatcctgattccatgtatctccatttttctcaaagagaatcctctccaaaatgtaatgtgcatccggccatactaatttttatacttatttgacatatgtgtgtattcctaaccaatgtagactatttttgtaattttactagatgttatgaattcacagataatatgtgctattattttctgcattcttaagtgcaacataaatggcttcatactttcttctttattcattaacttcacttattaggccaattactcagtggcctcctccttattccttgaacgcacaggaggcccttccaccttggggcttttgcacttgcaattccctttgcctaaaatgcccttcccctgatagccactggctggtttactaccccctcaagtcttatttacatggctctgccttagggccttcctgggctaccccacctaaaattgcaagtcggtcatctccttcttctgctttattattctctttagcactcttcactgtctcagttattacacattttacttattttcttctgttttggctgtctcctaccactagaatacatgttcgttgaagataaagttgtgaggttgtgggggtgtattccagatacctacaaattgttcaataaatatttgttgattgaataaatgtgtatcactgggcaattcatgttaatttcttaatagtatgtttttgaagtttatccaattgatacctgtagctctgttttattttcattgctgcatagcgctccattggcatcatacttttttaaatgattttttttagagacggtcttactatgttgcctagattggagtgcagtggcatggtcatagctcatgacagcttcaaactcctgggctgaagccatcctctcacttcagtcttccaagtagctaggactgcaggcatgtgccactgtgccctgctaattttgaaactttttgtagagataaggtcttgttatgttgcccaggctggtcttgaactcctggcctcaagcaatcctcccactttggccacccaaagtgttaggattacaggcgtgaaccactgcatcctacctacatcatactttaaatatccattttttggtaatggttgccatattagttatttttgtatttttccttttgcaaacaatgctgtggtggacattcttgagcatttctctttgagaaaacgtatgagaatatatctttagtgtgtatttgaagttaaaattcttgtttatatcaggaatctattgctgcataacagaacaccccaaacttactggcttaaaataatgatttacacaatgctgtgttttggcatgattctttagctagtcttcttcatctagttgcagtcaggtgatgtctagaatgagtgaatggtctgatgtggccccacttacatatctggttgttggtgctgcctgtagctagggcacttcagatctccatatggcttcttatcctatgatagggtggatcagcttcctaacagcacagcattcttaagacagtgtttcaagaagaagcttcaaggccttttaaggctttgactctgaaatgcacacagtgcatcatttccaccacattctattggtctaagcaagtcccaaggccagcccagatttaaggaatgaaaagctgaaaaaactcgtggttatgtttttctaatctagcaccttgggccataattttcacacatctttaactttattacatattgccaaatttctctgtaaggtagttttaccaatttattccctgactggcaccaatttattgttaagaaggaagatattcggaggaagagtgagacaaaacagatgctcatagatcaccctgcccccacctttttattttttaagacagtaaaccctgagggagtaagtctctgctataccttcaacaaaacctgattcctcttactcctagatatacattacatttccagattacattgtagctagaaatggccataagaccaagcttcggtcaatgaaagtaacttatccttttccattttcagacctggaatataaatagctttggtgtgatctattgtcttatctctatatgatatctagatatagaagatatactgggactctgaggcccaggctaaaggatagtgaaaccactagacagaaaaaatttgagctagaaataaacttataataagccaccgagatttcagtgtttctctgttagagcagctagcattttcttaatcaaggcaactctcaattagcagatagtgtctttatttgtagacttttggtctggatgagaattaatcatctagctccattctcaaagatataactggtatccacaaagcatttagaaaaatatgtagcagccttattgagatataattcacataccatgcaattcaccatttaaagtgtagcattcaatgattttcagcatattcagagttgtgcaatcaattttagaacatttttgttacctcaaaaggaaactctgtacctataaccagttattccacactccccctgcccttcctcaaaccccagcttccagtaaccactaatctgttttctgtctttatggatttgcctattcatacatttcatataaatggaattatatagtttatagatttgcctattcatatatttcatataaatggaatcatatagcctatggccttttgtatctggcttctttttcttaggataatgttttcaaggctcatccatgtggcagcatgtattagtatttcatttattgttaggaataatgttccattgcatggctatatggatatatcatattttatttatctgttcattggttgatgacatttgggttgtttctgcttttggccattataaggaatgttgctatgaacattcattaacaagtttttacccctgccatttattttttcttgcaaaaatcttgttagaaagtgtataagggtatacaaactgatttactagaagccagtgggtttgaaaagcattttatttcaaaccattggcatcatggaagaaaaactacaacaggggaccttcatgatggaattttgggaactagtgagttaatggaatcctcttcattcttcagattatgacctaattttcatatggcttttctcaaatatatcttgtttttataataatggaataattacaatacaatacaaatcatacctcatggctttgcactttagtgcaaaaaaacccctagtacttttgattaattaaactgtttactcatttatttagcatatatttattgagtgcccacccctgtcctaaatactattccaggtactaggaacagaagggcaagaaagaccaagtcttgccctcattaacaaaaaatacatgtttttaaaatgaacaagagagttggagattgtaatatatgctatgaaggaagtcagccaggccatattatatacagtgtggcttggagaggcagcagggctactcctgaagctgaataacagtcaggagccaacctacaagcactggaatgggcgaactctgggtggtaggaacagcaaatgcaagctacctgcagtgggaacacgctcagtgcatttgctgaacagagaacataccagtaggcatggatgagtgggaggtgtagtcggtgtaacttttgatgatactatactagcgcacatgtgattattaacgaagaagcatttttacttctctgcttgcatattctaggttctatgtgatttgacaccaactggaatcttagagatagtttttgcttagtgtcctggaattgcattttggattccttgtgttgtgaaaaatcacctgttacaagcaccagtctaaaaatctgtcagcaaggcaataaacatttggaaacccaagagtaaatctttccaaaaacctagatttttgtgtaaaatgagcctaaagtcaattggcatgctaggcattttatgggaataaattgggtgctttgtgaagtacactcattcttccaggccactggaatattctcactgaaatattctcaccacgctgttgccacagtgagctgaatgggtctgcagtggttgaaggacttagcactcctctcagaatggcctggcttgacctcgcagcagagttcatgctctaggactttgcatcagcagctctgtgtgtgagttgggatggccttattacaaatactatgaatatgcatgttctattttgaaaatatttattactaggaaggacttaagtgatttttttgtcttaaaatctgtaatcattttttaaagattcaaataaattttggagccatctgtaacttcttacattttaggaccttacttatccagaattcttgctctctacaatacagcaataaatttaggaagtgatcacaaagcctctggataggcacctccccaaattaagtcagctcccctcgatgatcttaattgaggctgttgtctttctgtatacatgtactactagtgagggtggttatcttgcttccaatccttcagccagtcagaaggtaggaaagctattacttgtcaggtgtattgacatccataaggatccatgggatgttattgtacatccccattagctcaaatgtcatgtgtctttcatgaatccaaattcacttttctcataaccaaatgtatagctgtcatgtgacagaattttatcaagaggcctaaaatattaaaaacacagccatttctttctgaaaccaaggtgtattataaattaatataagtgattcttggttctcgtgagtttgattttatatgctacatacctccataacagccctttgttgtactgcagactttttttttaattagctaaaatgaccgtttctgtctgttctatggaaacgtcttctgtaagccaacataagcgtcataatctttgttggtacagcaatgatcgtataattatattaattttaaaatcactatattttatttttgctttaaaaagtgctgaaataatgttaaacagcatagggtttatatacttggtaaagtagagacaaatatggaaattactaatatcctgacaaatgtccatcctgagacttactcaggacactatggatatgagcatttcaacgatagggtggatcaaattaaaaagtgtgtatgaaatatgcgacgacggcatagattttataaaagactgaatctgaaaggcaagatgcttcaaaattagattatttttaaaatctttggttctatcttaattgtttgctttttatatgcattaaaataatgacctatgttcccaaatagaggactgctggtatggttagcacttagaaggaagaatgtccagaaagaaagcacacctctagctcctcaccttccatcttgcaatggtgggtgtctagttttatgggataaagttcaagagatcatcaaagtcaacttttaagaagtagctgcttcctttgtgggcctaggtttacatgtgtttacatctgctggttggaaaatggtgcaatgcatgggccagttgtttcttctggcctgaggtgaagcttagccagtaggtcacttgcatcaggggagttcatgaattctcagaccttgcatctaaggagaggacgagtagtagggcgatggctttctagaagtggtaagaatcaagttgtatgtgtatcaacagaaagaggatttgggtaggagtgggtaccatgttaaagtgaaaagctggcagtattcttaaatcttaaaggtgacctctgaagtaagcagattcgtggcctgtgagttttctgaacttctgtttcatttttagccaatagagagtgttaagaataatgtaacatttaaagataagagacccagtctccagcccctagtttagccaggtttgacattagagggagtgagactaagaacagaaagggtttgggagcgcgtggctctggttggtgggaaactagcccatacagaaaaaacctcagttgttgactaatttctgtgtatatctagagatttcagagacatctttgcatcagagttaacaaacttcatgaaaataataactgaaaatattttttaaattgatcacttttggagacttttctcaagatgagtatccagtctccttgttcctcactcctggttcagctgggctgtgttatctttaaaaaaaaaaaaattgtcataaaggggcaagaatattttattagtttaagaataagggaaggaaattggaaagtcccgcttcaatctaaggtggattcttttgaatctctagcttcaagggagatactactagaaaaagggtacagagtggtcttttattgatgcagtgttagctagaaccatgtaaagagtgaatactgaggcttgctcatcactgcatttcctcctgtagatgactgtgtgtgaaaagtctggatgatgggcatgagcaagggaggtgaggtggtgagtttaatggacagtagtgtcaagtcttgtgtccccatcttctttctgggaaagtcctgtcccatagatcaaaattctccattggaaaaagtcatcttccaattgtcccttttctttttccataaaatatttttttttccttttgtagaagcaatttttaagtataacgtcagcaaaaaagtaagttacaaaaaatacagaaaaacaaaaagaagaaaataaaatatacctctgtttctggatttttgtggtttttcaggagaccaatttataggtatgtgcactaaaccataaagatgtacatgtccttcgaaccagcaagtagctttctgggaatttctcttaagtaatcaccagattgttggcaaagaaaatatttagatatgatttatctactcttatttataaattaaaaaatttggaaataaccataagacccccaggaggtgattcttatagattacactgtggccatgaaaaaatgaactagatcaatatttatcgatagagaaaacatccatgttattttgtcgagctaaaaggaaggaccagactggacaacatagcaagacctgtctctaaaaaaagaaaaatagccaggtgtggtggcatgcacccatagtcttagctactcaggaggctgaagtgggaggattgcttgagcccaggagttcaaggctgcagtgagctatgatcacaccattatactccagcctgggcaacagagcaagaccccatctctaaataaataaatgcaataaaaaaagaaagccataaaacagtatgtgtagcatgattgacttgttaaaagaagaagcactgatggaaaaaatttggaagtctataaaaatggccctcagtgttcctctgggtcctgggtttgtgcttgtgattttgttttgcttttctttctctctctcatactttcctgtatgtttaatattaacaagacataaatatgcattatttttataattggggtcaaagtatcagtaaagctattttgggtttgagtaatgagaaatagaaaaaaagagcccatgattcataatcaaggaaaaccactgttaattccctgatatatttctttccaaacagccttctctactatgtgtacaaatatgtgtatatgtacatttaattttgtcttagaaaattagaatggctctttattagtttagagtgataaatatgaccatcaagagggttggattttcatataaaagtaaatatacacttacacatgcacacacatacatacagtagggtaataataaagacaaggcatttgactgttcttcaactgaagtcacttttcatttttttcttgcttcatttttaaactatttcagtgtgctgatgttatcaaatgaatgctactatgttccctataaaatgatgggttgatttaatatctgttggcaacctccatggtcatcattatctttctcactcgcactggcaaccatcaagtatcattgtagggctgaaataccagctctgggatatctcttctgagatttcttctctctctcctcacctgtgggtaggtaccaccacctctctctccacaccccatactatgctggttctggtctagtttaagccaatatttataccggttctttaaaacggatgtctgatcaatccctaccaccaccaatgaggaaactcatacagccttcctgattaactggttccctttggtagatcactccaatgtatgggggttcatttgggtttcagctgtctgcatgcccctttaagtgttgtgcccttgctggtagaagggccattcctcctcctgtctgtggtctgtatagagcacccacaatcaaattgctcctttgacctttcaagtttgagtggaacaagagagaccattcagctggaaatacctgaaaatttggttatatctacatgaatgtggcattatgacttatgatatttgctactttaagtccctagtggtgattttattttgtggaggtgttagcaaagaaattcacctcattgaagaaaaggaattttagtgtcttaaatttttccctctaacatatgagaacctgaaatctcattcatgctctgtgaaattgaagaaattgggtatttgggaatgcaaattggtggtcctccaagcaatatgggatctaaaagtgttaaatcctttcataaataaaccttgattcagactggaatgtcttggcttgatcttaaaggtgatattataggagacatatagccgttgactggccttaaagataattatctgcacattccagtcttagtctgccatcagcggcagactagccgcttacgatgaagtcaatgctctttcccttactagaatattaccttgagacaggcctccaatattacatttagacaggatgtttatgaaccactctctgcttgtggactttgaaagcacaagaaatctctcaatagtggcaaatgttatctttgaagccttctagattttagtgctgtatgtgtcttagcaatttgggtttatttcccattgggccacgtcctcctctctttgggttggtgattttcttttttaaatttgtaaatttgaggttttgttagacctgttaagttacatcatcagggtatgtgcatgtgagtttttagatgaagttgtgaaataaagtctgttcatgtggataatttccttgggacaaagagagggacagagcgcagggagggagggaaaggggaagaagagaagttatttgctagactatgagcaccatgagtgcagggattgcatccctcatccctggcatagtgccacaataagtgtgttgaattagtgaaagaatttctagaaagcttgaaaagtgatacatttttacctttaatccttacaacagatgttacaaagcaaaatattctagtggttatcagactgtagagactgacagcctgggttcaaatcccagctgtgccactcactagctgtgtgactgtgggcaagttgcttaacctctttgtgtctcagtttcatcatctgtaaaatgataatgatgactcaacagggtgctgtgagaaataaatggtattacagacgattgttcatactcacaagatttagatccatgcctggcacaaaattaatgccatgcaattgttaattagtattaatacttattagttaattagttttggggtattgatgttgactcttagggaaacccctagaatatttggtttatctctcatttccagcagagttagaaacacatatttatatgtctacatatatacatatatacacacattaatgttttgtttttcttgctttcttttgttttgttttgttttttttgtttttttgtttttttgttgagacagagtcttgctctgtcacccgggctggaatgcagtggtgtgatctcggctcactacaacctccacctcccaggtccaagggatttttgtgcctcagcctccggagtagctgggattacaggcgtacaccaccatgccagctattttttttgtattttttagcagagaccaggtttcaacatgttggccaggctggtctccaactcttggcttcaagtgatctgcccccatctgcctcccaaagtgctgagattacaggtgtaagccactgtggccagcccaatgttttcttaaaatagagttttacctttatcttatagactagtcattgattcaacctaaacagaatatttagagaaaaaaaacaacctgaatacataacgtatatgtatgtgagagagggaaggctttttgtattcacatggacaaaattcctcaaacaaatgaggccttctcaatataaatatttttccacgtaaatgattatcattggccaaatttatcccatgatatttggatgcaaaaacctaatattttgtgttttctaagtcaaattaaatgttaattgacaacccctcacctcatctgtcatgtttggtagaaaaataaatctcagactttatgagggtccctctctgtccctcagggttctcttaatttgcccagagtgattgagggaaggcctgtggtctttgtcccagggtggctgcctccgggatgctcagggtccgtgccaaagatagttgctgacacactccctcccatggctgcctgaacctttacccttaggtttcagtcctctgcttcttgtctccctgctctggagagcttcttggaatggaatgcacttcaaaccccttctgtctgtgagatctacacagccaccgcaggcagaaatccccatctctccaagcccagctactccctgcttattcaaactcattctgacaatttgactccttggaccaagatcccagattcttgggaacaaagaccttttatctctcctctgtatcaagagaagtacaaaactccccaggactcaaacttttggccaccttctggagcaggagagggaactctggtttttagtctgtcctgatgtggccaaggaatgttcccagttgagttataccaacacataatttcagacgccattgtgaaagaagtgcagcaccgaaacacggatatgaaaggatctagaggaaggcagcttggcagaggggccgagatggaaggggctggcattagactgacttcctgtttgactgctggtcctaccattttccagctttttggctgtagacctatttaaccatcctgtgcctgatctgtaacatggaaataatagtgggaccttagacattgttctgtccggtaagtgggccagagtctggctcaaaatgggtattcaatgaagatgcatgtgttattattcgagggactacttcatgtcaggattgactctatacttattgcccacagttttctctgcattacttaagttagcttgtcccctatggctagaaaaggtggtccttggggcaggcacgtgacccttttcttccttgatggtaagctagaacagcattccccagaacctagagcacaggagctgatatggcaacccaacgtgtaggagttgtggtgacccccctgaatgttatggatggggctagaagagggcttaaagctcatctaattcatgagctcagtttatagcaaggaaaactgcgtcccaaagaggggaagagagtgaccggccagctgcctgctcttctatcatttctaactccttccttctccttgtcagcattctcggactcacctgccagcccagcccacatctctccctggaaggcttctccctctgagcatcgctccctgactcttcctttcctcctctgttcactctcagtcccctggagcagaattctgctttctgaacatttcctggcctttcctgcctccctgtcccagcccatactctttccttgctagaatgctctttccaccaaccctgcttgacaaaactctagtcatcctttaaaataaggcctcaaaactgatcattcatgatccagatgtggcctataatgtgtgtagttcaattcaggcaggatatttttctctttgattgaagcactaattaaaaaataagatttttttcaggaaaattcagatatgtttgcttcttttgataaatcaggggatctggccatgtagaacctgcatgtttacatggtggaaattagcagcagctaaagggcatttcccttcctggccagcatcaggccttgacaataactgcttcgccctaccagcctttgagttggtgacccctgtcatttaaacgctatcacttctgggaagcctcctctccctgtgtgttgcttttcccaatgtatcgtcccctctttgtttttgcctctaacactctgctcctccctgtctgcctcttctgtagcagaggtggaattctgccctgcctattgttggttttagtaaataatacttatcgtttatcaagtgcttactaagggctaggcacagggctgagtgtttcatggatattttaatctccagtccttgctatgaccctgagtgaagtgtgttattatctccaatctacaaatgcagaagcccagagagtgtaagtggcttgctcaaggtcacacagctggtaagtggcagagaagggatctgagccttcatcagtccaaactcagcgtctgtgtttcctcatgttttatactgatggatctctcccatcacactgaaaactatggggtgggcaggaatgcccttctgtagctctgttacatcaaattacagaatacacattatatcagagacaaagacctctgattcattttctccagtcaaacaattaagcaataatgctaatatgggtcattacagcatcttggcactgagtacgtacctgatgctattctagacactttatcctgcaatctcacataatcctcacaagagccctgtgcagcagggcatgatatctccatttacagttaaggaatcagaggctcagcaaggctagctaccttggccaaagacatacaggagcaagtggccgggatttgaactgggatctttcttaactctaagtcttgcattctttctctacccagcatgtttttgaaccactttaccatataaaagctactagcctactgataaatccggcaagcaaagccctcttgcatgttttctcccagcaatacaggtgacatcaccactacttcagctactggttcttttgcagacactttctgattcaccactgtgtgctaggtgttgggtgaaggccagggtgcatacatgacaaggcagtatctgttttcaggaaaccttaccctcaagatgaagactgggaggcaagcacccctatcatctgggccatcactacagaaaaggcaggattcccatgccagtgatatggctgcggcatcatcatactcagcctgatcaccctctgattgaatagaaatgagccagggaatcctttgcataaattggttcctttcacagagactcccccaaacacagaaacactcatcaacatggggtcttttccaggatgaatgttcacagcctctttgcctgtaaagataagtctcctgcaaaatggtgctcactcttcctttcccgattacaggcaggcctacaacatctgtgtttgaatgccctttggaaagtgggcaatattgtgtgaagcagtagttctggaacttgaacatgcatcagaatcagaatcaatcagaagggttgttaaaacacatattgttggaccgcatcctcagtttctgattcaataggtagaaacatgggatgggaggatgctgagaacgtacattcaaatacatttccaggtgatgctgctgctgctggttggggaaccccctgccactacttttttttttttttttttttttgagacagagtctcgctctgtcacccaggctggagtgcagtggcgcgatctcggctcactgcaagctccgcctcccgggttcacgccattctcctgcctcagccgcccgagtagctgggactacaggcgcctgccaccatgcccggctaattttttgtatttttagtagagatggggtttcaccgtgttagccagggtggtctcgatctcctgacctcgtgagccaccgcgcccggccccccctgccactactttgacaaccactggcataaacatcaggtattgtttttgctaattctagttatgagtcaggtgagtacttactaagtgtcagccatgtgccaggcctcaggatgggtattacaaatacaggaggagtaagttagacatggagcaaaaagccttgtgaaggaaatgggaaggtacatagaaggaaattcttaagtaaagtcatttaaaattgtgacacatgctatgaggaaatccaacttggagctgagatgaagaataccagggacaggtgggaggcaggcagctcctttatctgaagggactcagaagggcctttgggaggtggtgacatttatgccaagacctgacagtttagaagatgcctgctatttgaagagtttgggagaaggggcctggaaacaaggcatggtaagaaagaacagattctacaaggcaagggttgcatgggatgtagttgagtaggggtcttgacaatacagggcccttgtcagctgcaggaaggagttggggttttatttgcaaggcaatagatactataccgcctctttcaaaattatattttgattttggaagtcaatgcttataggtgtgaaaattccttagtctgctctgttgtagggttttggcttcctccacctatacaaatggtgacttcccctcggagttactgttaagtggaagagcgtgtgctagggcctatggagggagggggcgggagggatgctgcacacacacacgaccaccaccaccaccaccaccactactccaaactgtgaggtccacaaaaaaagtaaaaagaagaatgtgcgtggtggctcacgcctgtaatcccagcactttgggaggctgaggcaggtggattgcttgaggtcaggagttcgagaccaacctgactaacatggtgaaaccccatctctactaaaaatacaaaaattagctgggcgtgatggtgcatgcctgtggtcctagctactcaggaggctgaggcaggagaattgcttgaacccgggaggcagaggttgcagtgagccgagattgagccactgcactgcagcttgggcaacagagtgagactctgtctcaaaaagaagaacgtgaaacacatcaagacataggcaacaagcttggtgatttgtctccttttttgttcatatttggaaacgggagctgcttttgttagactagagaagttgcatctggggagaaaatgctcttcccatgctcacctttggcttttaaaaggtcagctctgttgccaaacactgtaagttaaaccttagcaggaatgaccgtgaaaacgggctgagtcacacattgaaatggcaatgtggattattaactgtcatgcttttctttctgtctaaattgaaggagaagatgccacgaggccagctggctctgtccacacctcggtggtctagggtgttgaggagttcacatggccatcttgttcagaaatgtgtttccccccagacgctttctttcttcactgaagagtagagtgagttatactttattagactcatccagatgagaacatgttcatgatggtttctgcagcattaggaattcctgctttttttggttgggtctgctagagttgtaaaaggaagctttctggacattaagtttgtagcaaaaaggggtagaatgaggttggcaagggaagaaacaattttgatgtaataaaaataggattgttcaaagctgagatgagggctcttcttactatttggtattcagatgaaatttagtttggaagtcacatcagcgaatattatatttcttcagaacctctgctgtattttcgatcagggggcatcttgattttgctttacttgtgcagcaatcagaaaagccatagatggtttcaacttgtgtgtgtgtgtttattctatttttacctatggtactctggccattaaaatatgatctgtatccattttggaactttaaagaaatgattttggatgagggcaaaaatgttgtgccacctattccacacagttcctttcttgtcagtgctcacttgcactggcacttaatttgttgctgtacatgagaacatttctccatcacctctgaaaatgtctcataggcaaggcttttagaacctgaatttttaaacacgaaacaggattatggattaatctcaggcaagaaagtccccgagggctatgtaacctaacaaataagcctctgctcttggcaagtcccttcctgggctgccctctgttcctgctgttgacctactgggcaaaagagtggatgtgtgtgtgagtctaggcatgacttctctaaagatcaacatttgtacacactggagtcaccttttatacatagtgctactgacattaaccagaggagtgggcctgacagccctggcctccatgccagtgagaaagtggcctggctgtgcgtacacagttatctgaagggattcagcacaaaattacacagcctaattgtttttagtccaaaaggaactattgcccagatagaggtgcctttaaggtttctgaatgtgacccatcaaaatggggtattcatttcgatatatgtataattattacttattttaaataatgaggctgtttttcctcttgaactctgggtatcatggttttattatagctatatattcttgaagaaatgagaggaaaaataaggagaaatatttttaaacaaagcaatttaaatatttcagaagctgtacaagaaagaaaaagtcccagctgaagcaatcagatccttgagtgaacatttggcatttaaaaagcaaggaatccaatgttttcacttttatttgtcttgagactatttgataccagagttacatttgatgcagagttatgtttaatcactttataggagactagactataatctcatattggtaatgaaaatggtgaattttttttaatcagagaagagctactagggaaaatcatttattttgaaaatatagtttaaagacatacatcgtagaaaatgtgtcttttggggaaaacatagatgtctatttccaaagcatgatacaggtatttggtgaagcttggagtttaataggtgaatataaatggtacaatctggcagatagcttttcatcccagttgtgaaagtgtcacatgttaagatgtgagtatgttttgtttctgcccagatgaacagtgaatgtttccatgaatcaagataatccagaaagacaaaagttgctgattttaagcatgaaaattatgcacatcaggatgtgtactttggttgtttttataggagtgggctgaatttgacctttgccatccgcccactctccgccaggctcccttgggataaatcacagcccctggcaggggctaggggataatctctggtgtggagccaggtgagaagcagagtaactggtcctaggagcccagtgtcaaaaccccactctcattagttcagctggatggccagaaagcagtctccttccctggggtacaaagaggatgctgagcagcacgctgatgactggaagagaggcaaggtttagcggatctactcttgtgattgtgtgaatacttattccatttggagatggaaggaaagcataggaaccctctatttagctttaaaatgcagctaagttctgtcggtcagccttgctcatgtggtgcctctcatactccttaccagccgctttgtacgtggggagaactgactgtttgggtgggcgtctttgttctgagttttccctgtatgaagtgatttttcccaaggttaaccaattaagaactttttccatgtcgcagtaatcgccgagaggagggagccaagtcactgtgggggatgctgtgccctagggacgcatttgggaggatttccttctcctgaagcaatagggtcaacataaagcccctataaaatgttttaaataaaggagaaattgaagcggaagacttcattctggcacgttatgtctggtttttgctttcctcccactgaggagctaaccaagccagcagtctggaggatatatttagttggaggatgatgaagctttactgtgatttttttacttacctgaattataataataaggaaaccggtacctgctggtggtatctatgggttagcataagatgcactggtagctattgctgaacatgacacttaaaatgcatgtgtctgtgtttgtgtgtgatggtttgttttataaaaagggaacacaattatgacatttttatcacatgactcttaagaaagtcaatttcatatcctgattcagtcggtatcaagtcactgattcgaatgttgcttcacctagtgtgtagtcatccttgggactagatggcatttacaacatgaaaattatctgctgaagtcttcaaagctatgatattttgtggagggattcttccttcagagtatgggaatggcctcatcgatcttatggatagtgactgtggaagtgatgggatgtcactcacgtgattaagcatgttatttggcacagttgactttaagaaagggacattatctttggtgggcctgacttaattaatccttaaggtgagcccttaaatgggactgggcttttacagaagaaggagagttaaagcatgagatggatttgatgtgagggagattctccatttgctggctttaaagatttgaggggactgtgcggcaaagaatacaggtggcttcaatgagctggacatgacaaggtgacctcagacccacatctgcaaggaattgaataatctttcaactccatgagcttggaagaggaccctgagctgctccagatgagaaagcagcctgccaatatcttgatagcaaccttatgagactctaagtggagaccccagtcacaccttgcctagacttctgacctgtagaactataagcagccaagtttactataatttattgtacaataatggaaaactgaaatagaatacaaaaatcaactaaggcattttggaacagtgctgggatcaaaacagataatgactattctactccagtgaaacaaaagagacccaagatccatcactaatttatgttcatccacgcatttgttggtgctgactatgtgatagaaaatgagccagggattttcttgctcttgagggtcttgtggtcctgggtttcctcccagagcctctcagtagagtcccctctaacacttcttccattatatttgtattcaacaatcagtcttacatcctggtaaaaagtaaaccacttgaaaatcctttaccctttctgagcttaagttatccatcatttaaatggtctgcttctttgggaatatgtgagaatcaaataggatattatctaaatcaccagtaatgattacctttctacagtatggctccttttcttcttttctcccttccaacctccctcccacatctgttgactatctactgtgtgtttgagaagaggctgtgccaggtggaggatgcaagggtgctttggactctgtgtgcttaaaagagcaaggtgacatatagggaagccactccctattgttcaaggtagatcttgtgatgcaaggatcctgaggtatcaggcttggagtcaggcttgatttgagctgatagaaatttgtcatcatcaataggtgtctcttccagagccaagtcagtaggggaactcaaagtaaaggaaacccattttcttctccttccttggaattgtcccagcactgatccttgcattataagaaagtgggtttgtttgagaacaccaccctgatttgttgaatgggaatgaacagactctgctaatggaggtggccaagtagcctggacaaatggttttgattttctagggcctcacagcttattttgagtgctgaagaaacaaaattataataacaaaatcggacaatactaaacaaagcaccaaacaaaataagaaagaaaatgaacatattggacttccaaaacccataggaactttattagagaacaaagtgaaatgagtaaagtgcattgtggggcagggtggaggcggcaggaattactgttgacagctctagagtcaccaacaattgggctctccccaccggattataaccagtataatctaagggactctcagaaccaaagtacccctgccttaaagagtagcccatcttaaggtcattttggctaaagttagctgccattgtaactgccgccagagggccccatctttttctggaggactgcttcatacctgtcctttagaggctatgtttacctgcaactgctttttccatgggatcagaaatatttcctaggcagatctttcttagttgaaattggtttaattactctttttgtaaacatttgtaatacatatttttatcaataagtacaaagaaatatataatagagtatgtgaaatccctaaacctagaaacaaacccatcatgaatattttgatacatttccctctagtcttttctcctacgaatatgcaaaaaaatcccaacacatagttgagattgtattgtatctaccatttaccacctgctttcctcacttaagatttcatgagcatctttcctttacgttaaatctttttgcttagtgtttaatatctgacgaacatctcaacaattgggtgcccataatttattatttaatttctttgtaacacttttaaatcacacacacactctctctctcacacacacacactcacacacgtattccataatttttgtaactaatttttttgaagattgtatacatatatgtttgtgtatgtatgtattgtgtatatgtatgtaaatatatccatacacatacaaacttttattctgatttttataaataacattgtgatgaatatgcttattatatccttagagtaaattcgtctgggaaaatcccttattatatatccttagaataaatccagaaagtagaatcatcagatcaaatagtaattcattagttatactgaatttaaaagaattgaaatgtttgtttcccgtgaccaaaaaaggtaaatgttccacaaagaccgaaataatttctgaacatcaccattggacaacaaagttgtgaaaatggtatgttctcatattgttctttctaatgcagtagccaatagacctgtgactatttacatttaaattttaattaatgttaaattaagttaagaattcatttcctggtttgcaccagacacattggaagtgccgcatgtagttagtggcatacatattgggcagaaaaagttacaacgttgccagcattgcaggaagatctactgtgcgatgcttctctattttcttctccagttccttcatctttatgtttggaatttagcctaagtaagattaaaatatgaacaatgcatattttgtgtatgattaatttggtttgttacaaagcgggtttcttggtgaaaattttcacctttccactgaagatgaaaaatgtgatgcatcttttggaaaatgtaaaaaaaaaatggaaatccaaccctttgtcttgcttatgcatcctcttataggctgaaaatgaagtactagtgtttaagctaataccactgttgatgacaatctcgggtggttgcatgcttactgtgtgccaagcatgttgctgttgtactgcccgtattcctcacaaggtctccggaaggtgcagttattatttacattttgtagaagaggaagctgacgtacatagaggtcaagctcctttcctaaaatcacaccgtcagcatgtagctggggcctgatggggacctaggctttctgacttcagagtccacatcctttactatccctatactgcttctcaagaatgtcccaggctgttagagagaaggccatctctttgccacactgcagaactgtgacacacgtgtaataaagcctcccagctgctcgagatatacccctacaccacatacccagaagcacacccccacagcctttttcttgaggaacttccactgagcccaatcccatctggaatgaagagtgctcaagggcattttggagaaagtgtcattcatttgtactctgacactttctcatttaacagactctgttaagtcagatgtatgtatttttgcacatttcctctctatccttcttttattatggtgtgaagttttgttaataggcctgagaagagaagaggaaagggagaatgtgaaacgttgtcaaaatcaaagagttggagcccaaacaaatgttcttaatgtgggcatttgtttgcaggagaaggatcagaggcaaccaatgtaagcaaagctccttgatgcttaaacttcaatgaggagaaaacaaatcacaaacacagtcttagggatggtcaggtccaggctgaaagcagtctggggattttcagtttcaaccttttccaaaaggtgtcactctaaggcagcagtggggaggtgggaaggaggaagagatagaaatgtcagataagggtaattggaaaaataagattagtagtccttgttttaacaggtccttcagcctccagcatcactgtcggaggagttgctgctgctgacggggggtttaagcgtttatcttcaccttctgatctcagggtgaccttctgtgtccagagttgtgctgggccaagtccagctattcccacaggaccaattcacattccagatttgctgcaacctgggatatggggatttcattggttctgtgttctggtgcaaactgaaaactgccatcctcttgcactcaggatggaatgaagacaggaaaccaggatggatggcggagcctaactcagaagagcctgtctgtttttgaaatatggctttaaaaattccaaatcattaacagaaaatacacaccaactccatgctgacatataatttaagggaaaaaatagctttatcaaaatatttgagtatcagctcttgccaagcaagcctcttgaaaagcatgggaagctgccacgcgtcaggaagagatgcatggaacctggagtggggtcctggcagataactgagagagaggctggttttcaaatatttagttaaacaacacaaatgtatgtgtaagtttaagtcgacacatgttaatgatttaaggtcttaaacgggttttttattttattgttttaaggctccactgttcactttaaaagatccgacgatttctccagagccatgcgtaaacactggactttttagaaagccaggtgatgacttcattattctgaaagtgaacagttatgaattattcagatacagtaaatacagttgaatatttcctggtaacaactattttaaaagagagttttaatgatatgatctgcaacatagaatgactaatacaatcagaaatagcacacaattattcagggttttttctttttttgtaattgattaagctaaatcaacatctagcttgaagaaacctttaattattatgttctagatatgtaacaccaagccaatgtattttaaaaatgtaatctttgatataaaatcagaattccagtcttgccacatttgaggaccttttaggaaattattttaagtgaaacatctggaatattctagagacttctgaggtggctgtgaatcctgttttcactgaaaatgacattttagcaattaaacaccttttctaaaacttttttccccaggaaatattattgtctggtgaattactaatagatgtacttctaaaagaagcacatgctgtgttaaatagagacaaatgggttgctttcttgctggactgtcaaaagcttttattgtctcttaattactgtgattctccaactagcatttttctaaagaatgggaccacagggcatcttccagctgggccaccacctgcgcttccccaggctactccacttgcttgccttagggaggccagccacagtgcctagtgcaggatgggctgctgttttactcttttgcaccacccagtacttttctttaaaatcactattgtgattaagtaatttgttgattcccaacttccctgtggaaacccttctgaagacagacctgtggctagtgtccagcagagtgcctggcatgtgggagatgcctagcgaggtggtggaatgaaggaaaggagtgtgtatctcccaggtcccaggacagagcatgtggaatgcatagcaggaccaaaagccacatgcttctataccagcgcagaacctgagacatctttattgtgtctctgtgaaactcacaggttcctgggttctccaggcggctgctggggtggcagcgaacatagggcctccatcctttcaggagccaagtaactgagccccctcatccccatagcaaagagaaggtgcttgaagcaaacagagagcaagaacttgaagggtatttgttgaggatggcgaagggaccactgatttatggggtaggaaagtatcaagtttggacttacacttcatccatcattgcactaagtgggtcaaaggagggtgtttcagaatcacgtctttgtgctccccttcctcccattgcataggtatttattgagtgtggatactggtgctatgtcaggtactgaaggggcttgcaaagaagatggagacacagtctctgccctccagggattacagtccagttgtattatagcaactaagcatacatattgtgcagaatgggtgcaggcaatgaaaactgaaggcagttgggttgggtgaaagtagtgaggctaggaatgggcatgtgctggtgccttccagggtattaggcagggtactttccatgcattatttcactttacgcttatgtcaattctgtgtggctgcttctgcttcctctccactttaaaggggaggatctgtaggcttagagaggtcagtaacgtctagggttccaagacttggctgcattttggaatcacctggatctttaataaaatacagatgcctggctcccgccctcaaatattttgatttaattaggagcagtgtgaccacggcatcaacatttttaaaagcttcccaagggattctaacatgcagtaacctaaccaatcttaaaccaagtttgggaaacattgggttaagattggcctaaggtcaaagatcttgtaggtggaacccaaacttgactcatatctgactgcttctagagctccagcttttgatcgctgcaagctgtgaaggaggtcaggtgtagacagggccttaaagaatgggcagttttgataagcagaggagtgaatgtagggcagtccaggggtatatgtgcatgtgtatgtgtggttgagcattggtgaatggagcaatatgcagacatagataggctgaataattactaggcactgtattagaaagagttgatacttctgtggcactactgagtactaggcattgtgctgagagcattgcccatgtgaacccatttaatcatcataaaaaccctttgagctaagttatgtcattagctccacttcacaagaggtacttgaagctcagaattttgtaattcattgttcagctgccacgtacatgtgagaacatgtgatacttgattttctccttctgagttagttcgtgtaggataatggcctccagctccatccatgttgctgcaaaggacatgatttccttctttttttataaagtagggagggaagaagggggatgaagtttgaagaagtacctgttgggtataatgttcaatatttgggtgatgggtacacgtagaagcccaattcccacatgcaacgtacctatgtaacaaacatgcatatgtagcccctaaagctaacattttttaaaaaagtcaattctattattatattgtccccaaataatccttcttctgggcattttaatataatttgagtaaaaattaccataacctaatttttgcatagcaatggtaatgcttaatacatgtttaaagcaaattttgcctccaagtttaagttgagaaacctagaaaattttgtctaggttctttcatgaaggtaaacagtccagtttatttctataactttgtaatagtgcttattgaatattatttattaaatgtaaatactattttatttttcttacatgaaatcaatttttccacctgggaaaaaagttataattcacttagagtgaatttatacatctagtaagtggcagtctagctcctgaattatgtttctaagccactacgctgctccgcctcttgtgttaagaatatactaagtgttttcatatttgccaggctcagcactaagagctctgcaatcattgcttcatataatactataagtactattgttacagatgatcaggcaaaaccatgtcctcacttaggggtaagagtagagtcagaggctagggatacacacatgagcatatgcacacacatgtgaaagcccacatatacatacatatgtgtatgcatgcataattatgttctaccttattatacatgtgggaggggtgtcaaaagtaatgatagaagggaatgatggatccaagaaatatttccaaaatagagctctaggagttggtgatgaatggaaaataaaagaggaaagagaagatcaatgtggctctgaggtcttaaacaggaatgactgagaaaaggtcagggccttggaccaaaatggtggatgtgttagggagtggcaagttgggagggtgaggacaggtgataggagtttggtttaggcaggtgtacacgggtcaagagttggcttttggtcatcctcaatttaaagtaatattaggacatccagatggaagtgatcaacaggtggttaggtacatgtgaaagaggtcaagtgaggaaaaaggagataaagtttggagagacatctacatagaggtgagaactgtagagacagacctcaatgcatcccctgtatttctatgtggatggtggaaatgcctctaggatggagtcacaaggagaaagacccagttatgggctgcaggaagatgagtaatttgcaaaataaacaggggaataagttcctaagtgtcgtagtccatttgggctgctctaacaaaataccatacagtaggtggcttatacataacagaaatgtatttctcacattctggaggctgggaagtctaagaccaaggtgccagcatggtcagattctggtgagggccctctcctgggttgcaaactgctgacgtcttgccgtgtccctacatggtgaaaggggacatacagactccattgggcttctttcataaggtcactaatcccatataggaggcctctgcgcccatgacctaatcatttcccaaaggtctcaccccttaatgccatcatcttgggggttaagatttcaacatatgaattgtgggggtacgtaaacattgagaccataacactaagagaagcatcagttttaggaagatgaggagtggatagagcactgctcatatattaaaactgtatttccaaaagacaatttaattacaaaagaaaattctcatcatatatcaattatatacacaattatgtatatatttatatgtagcatctcaattatatgtgcataaatatagagagaaattataacaatgtttataatgtttacttctaggtggtgggacttgggaggatcttaactaaaaatgatgttagtatttaatcttcagaagaaagctaaaacattttcatacctggatttttcatattttttacaatgaatatactttattctttttcttttctttgagacagggtctcactctgtcacccagcctggagtgcagtggcataatcacagctcattacagttttggcttcccaggctcaggtgatctccttgcctcagccccccagggtagctgggactctaggtgcgtgtcaccacgcctggctacatttcttttctactttttgtagggatgcagttttgccatgttgcccagcctggtctcaaactcctggggtcaccatttgtgatcaaatgatccactggccctggcctcccaaagtgttgggattataggtgtgagccactgtccctggccacactttattcttattatcagaaaaaaattaatttcttgatatcagaagaagaagaataaatgccttatgggctacatcatctcacttaatgtgcccataatcatctgataagcaagcaatagggttccctatttacctgttgaggtaaatatggatgaggaaatggaagctgagaaagatgaaggagctcatctcactcacaccgtaataatgccatggttccaatctggtgatgaagacacaaactacatatgtacagtcaatcagttaaaatgttatttcaaagaagggacagagacttgggggcatgtttagctgtgcaaaccacacattaagaaaagacatttggcaagaagggagttacttgtggtctgcaagagtagaaataccatgggaccgcaagaataacaagcactttcctctggttgagagatgactgtgatggggagatggaggcaagcatagagcacttgataagaatcagacagttggctcatgcctgtaatcccagcactttgggaggccaaggcgggtggatcatgaggtcaggagactcagaccatcctggccaacatggtgaaaccccgtctctactaaaaatacaaaaattagctgggcgtggtggcatgcatctataatcccagctactcaggaggctgaggcaggagaatcacttgaacccgggaggcagagattgcagtgagccaagatcacgccactgcactttagcctggtgacagagcgagactccagctcaaaaaaaaaaaaaaaaaaaaaaaaaaaatagaaccagacagttcaccagtgaagataggccaggttatgctgggagttaccacccccaatctcagaggcaaagcacaacaaaggtttatattttgcctatgtgatgtgggtttgccctgggcttcattgtggtcactcagggactcaggctgaagatgatgtcatctgaaacttgcttccacggtcaccagggcagggaaagggtaacactggagttgaatgctaccacttaaatgtttctacctggaaatgacagtggttttaattggccaaagccacacccaattcaaagggtgaggggatgtggggtcctaccatgtgcctgtaaggaagagaactagaatattgtgaaaccaccctaatgatcaccccagcaggggagatattttttgctttctaaggcccttgttttggcagcaaaggaaacagttttcagttctctagaatgttaaacacaggaagaacccatggccatcatctaggaaactgagattccgagggtatagtgattgtttgcaaaaagttacagagagaagcagtggtcatgctaaaactagaaggatgtgttctgaggccagtgccccacatggtcctcggtccagggccacacaaattaggaagagtgaggagcttggcctgggaacttattttaaaactctgtctccaagatgttgagaggagcagtttcgtctcatctgatactagcagttactgatgttggaggccagtggcttctccatcagttacaactctgtattgtgtctcccaggtgcccagtttctccatgtgcttcttgctgaaatggctggagcagcctgaaatcattactctaaagtgtcatttaaagttgggttaatgtagaactagctagtgtttgccctaagcggtccagtggcaggtgatctaagatttggaaacccagctgagtagctctgtgtctatagattgcagatagatcagcttcgatgaatgagagagagattgaacaaatgagaataatggagacctcccactcctctgaaatcaatattatgtttgaaataaagaacgatttatgacagaaaaggaatcatgaggacacagaccatctcatatggagggtcaggcagactatctgaattggcatatggaatgatcataattctgattttttgggggtcactgctattttctatcaaaaatagaaaaagggaggaaaactcaaaactccgctttaacttcgtcacatattgctttgggcttctagtcatatttgtgatgttctgtgaacttatatgagaaactgaaaagtttattaatactttttaaactgcatagatttgtaaagttaaagaataattcaatttactctacagttacataggggtggttttgtcactttcataggttattctttatattccttgctttttaaactctttttggttttggctttgatttaaactacatgatcattcagtttcctctttttatcagggcaaaatgaagggttttctgaatcttaaaagcatataatttaccttggatgtgaactataatgcttattctgaataaatttcatgtaaaactgaagaaattgtgtagaaagtctttatgaattggaacttaacatgtcattgacacattttgaagggcgttctgttgactttagtgatggatgagcctattctgccaagttcagctggaaggggtattttagaaagccaaacatcagctctggaatctagaaacttcctggaatcatgattttggatcagcagggaggacacagcctgcatctgtgcaagggatggcatttcaccagcttgctccacggaagtctttggaacggaaccataaacaccagccttctttgttgtgtgttggcttttaagagtccccaaagctttggggaggataaggctttgcctcagggctcctgggtctcattttttgggacctggctgaaaaccgtggatatttgatagtctggcttatttctatggtgtattagcaccctataaaagttacatgtcatttatttcaagtttagaaccctctcaaacttcaggggcaaaccaaacttgaaccttttgtggctggaattctgtttacctttggccaaaccttgcttcctgaatgtaaagctgggaggtgaggtgagagggactcctgaggctccctggacattgaatagcttttaccaaacacggctttgataggttaaaacgtgactgaatctgaaacacatagattaactttctttcaaagtactctggggcctacacacaaaagtatattgtgctgggcaaaatgcatttgagtgttgccttccttcaatggtgagaaagtatctgagacttttgccaaacagaggttgaaattgggtcaagccactcacccccaattctagtgaacacattaagtagttttataaaggttattgggcaatccaattgaacaaggaccttggagaaatttggacatttcttgtgtttgaaacattttttaagggtttttgttctgttttgttttaattttttctttccataggttttgggggaacaggtgatatttggttacatgagtaagctctttagtggtgatttgtgagattttggtgcaaccatcacccgagtagtatacactcaacccaatgtgtagtcttttatccctcaaccccctcccagcctttccccacaactccccagagtccattatatcattcttaggcatttgcattttcatagtttcaatgacaaagaaagaaagggctccaagacacagcggcccagttcaaggatccctgtgattcctttgtgtttgttgttggaacacaggctaacaagggatgtcttgtgcttgaatgaaggagaaataacacacagagctccatgtgcctttcagatagaggaactgatgaatgcactggagaagaccagacaggaactggatgccaccaaagcacgcctcgcctccacacaacagtccctggccgaaaaagaagcgcacttggccaacctccggattgagaggaggaaacagctggaggagatcctggagatgaagtgagtacccattgctgctttggtagcctctctcttctagcctctcttgagagtgggaaaggggaagggctagagaagatgaagaaagagctcagaaaaagaataatttagctcacacttgcctggtcatttctgaaagtatgtttcttattttttaattgtaactttggtgtctcaatttgcacatttctcacatctgttattgaaaaaaatatagatccagcactagattttgggtgtctgtgttgtgtggatggtgctgggattcatagatctgttggaaaggtctgagccagccaagagatggaggccccgttaagcacaatggtaatttgagcgctgctcagagttaagtggaaacttttctgaggagttatttcctaattgtgactgtaactttgctaattatattcttctcacttgtgcacaatgcctggtttgtgttgactctcacagagtctcaaggttggcacctctttgttcagaaagtgaaactttgatttgctgggcttataaaaataggttagaaatcccacaccccgccacaccccacctaggtgggggcttgggaagctaaatcagggagattggattggaaccaattgcttcctttgatttaatcaatgacatggggctgagtgctgggaaatggttgttcctgtggtcctgtgacacacccacctacacctcactcttgtttcattctcacaatgaaagagcatcatcatggaataacataggaaagaaaattactgagaaattttaataaatatcaattgcaataggtctgtttgtgaagaactagtcaagaaggagcgtctctatgtttttaaatgaaatcatcactaaattataatttaaatctaacttccctccacagtaaggggaaacatacataattacggcatcttaagcctataacacagactttgaaattggtggctaggtatggaagtgaccttatcgtgacccagcaagccttacacatggttagcattaaactcagaaagcttagatcatggaaaatattggaatgaaatattttgaaggatttaataatgaggacaaaacatttattcctcatcaactacctcagtttctccaagaccaaagaataaatagggtttttttcacatataaactagcattttttctaataaaagataatataataaaaccaggtattattatactcagttcagaggtgagggagctgagactcagagagattcataatttgcttaaggccatctggccatgacaaaaccagttttctacctcaacctccgtttctgctatctaattttctccaggagtttatgtgaactcattaagactagaacttttgtctgtttgagtcactgtagtcattatgcagacaagagcagtgctgggcacatgggaggtgctcaatgattgtttgttgcccacaacagtgtcttgaatgtgataggtgctcaatggtttgttgagtgagtgactagattgaatactggagactgaattttatgtagctaagaagaaaagtattttaagtatctgcgatattatcaccttcatcaataatttattaacactgttaaaaggatacatgtttataagcacagcatatataaaatcttgatgtttgccaatatttactgttgtttaaaagattaacttatgtaattagttgtggaatatgtgtatgaatttaaatgacacccagaaaaattataaatgtcaatatatgtgtaaacacttagctgagaaacaccaaaaatatagtgtagtattaaataattgaagaaacagcaatattcaaagtggaaagtccatttatgaatgtattcatgttagaatctaaagttatgtatttttataatgtctatatacaaagttcataaaatggtttatttgagaaagtttccatcttgctgatattgaccaataaaattcatttcctagaaaacaatatggaatgttatgatttatataagaatagagaaagattttggaattgcatatgcttccaccttcattttggatttgatttttgaatggagattaaaaatactgaaattcaacttataagtttgttttacccttgaaaaatttatcatatgatgttttttgcattttactttccataataaatgtagtatagaataaaaataatttatcaacaatagccaatactagtattagtgcattagcaatatgggtccattgattcaatcagcctgtattctttcctgttcacctgtctctcgtcttcctccctgtgtgttatgtgtcaagtccagcctagtttttctccttgttttccagctgttctcaagttaactctccatctcctgaagtgatttattatgctattataaagaaattttaattacttcctgtttataaaaggagcgtatactttcaacattttgagagaacaagtaatggtgaaatatgctggtttgtgagtcatcagacccagggtggaatcctgttgcttccacctggtggctgtgacttgggagaaatgcccttaacctcactaaccttccagtttcctcctgtaatgacttgaatgggggtggttgtgaggaggggttctcagcagagagtttggcacacagaaaatgatatatgtatgcaaatggcactatcagccaatgaaaatatgtcctctgtttagcatactttgtgaagagtatcatttatctaaaatttggatttatttttctaaaacatataaactttttccatgtgtatgttttcccacttaacttcatggtttcagatagcacctaactaagacctcttttggtgaattgccacattattgctgaagtgcttaatctgctgccactgcaaaataaatacaaaattcctgtgttaattcctttggtgaaagtaacaaagccctgcttcattaagcctgatatgggccctattcactatttaactggcctagaagcccaacctgtgggcttctgccctgggactatgggaggacttaggtacagggcaagtatattgactgagatcctcaactagaggcaccagcctcttgggctgttcaagtttgccactggtttgttcagtcacagtgtttaagctgaattgacacactggttacttgactttgattgagtccacataagttcgtgggaacagtcagatgggtattatcattgttggtgagttgatatcatctgtgccaagcattgttggtttttcattcaaccagcacccattatctttagacaggcatctttaggtcaggtctacccagtttccaaaccctggtgggaagggagaggctgtgtgatgttagagggaagaggggtgaggccgtgagtcaagagaaagaaactgtgatttcataactaatttctgtctcaccccataacattaaacatcactctctggttgcctcagttttctcttcagtaaaatggaggtgataatacctgccctgcttactctacagaactcttgtagggataagatttttttttttaagcagcaaactaaaattaatataaaccagcacatgtgaaagtgctttgaaacctaaagggggcttttgaaaggagaggtggtatctgttaaattccttgcaaaccaaatggcacagagttttagaattggaaagcaactgggtccaacctctcagcctgcagaagcctgtctcccattcacaggattactcataaggaattcaccaggccctggtgaataccattcccatggcaggccatgggctcataaggtggtggttcatgttccatggctcttacaggtagctcatttgtcattatattgaactgaaatgtctttccatttgtcttggtttttgttccagagctatacagaatttacctgaaccccatccaaagatagatatttgtttagatgtttgttaggtgatattgttcattttaagggaaaaaaaagaggcagtataaagaaacaatatgaaaaaaattattcatgatcctaacatggagagagagacactgatggcattttggtgtatatctttgcaaatgctccttattttgtaaagaaaattggactgtacttgcctattttgcaagtgcctcttcttctgtgaacgtgaacaaccttctatgttgcaaacataggattgcattatttttaattactcaatatactgtcatataggtttacatcattattgggcatctgtgtcagttccagtgttctgataagcattctgctgtttaattttattttattaacatatttgtaaatacctgtggattgtcaggctgctgcaagaaatattataaagagggttctcatatccttcaaccatttccctaattggtaacatctttcataactaaagtacaacatcacatgaggaaattgatattggtacaatctaccagccttcttcaaatttctccagttttacatatctattaacattattccaatttctccagttttgtggtgttgttgttgttgttgttgttgttgttgttgttgttgttttgagacggagcctcactctgttgcccaggctggagtgcagtggtgcaatcttggctcactgcaagctctgcctcctgggttcacaccattctcctgcctccacctcccgagctgctgggactacaggcacccaccaccacacccagctaatttttgtatttttagtagagacagggtttcaccttgttagccaggatggtctcgatctcctgacctcgtgatccacccgcctcagcctcccaaagtgctgggcttacaggtgtgagccactgcacccggccttaacattattccaatttatccagttttacatgcacttgtgtgtgtgtgtgtgtgtgtgtgtgtgtgtatgtttaattatatccacttttattacatgtgctgatttgtgtcaccaccaccacagtcaagatgcagaactgtttaatcatcacaatgacctctggtactatccttttatacttacatccactcttaggctgtttaatttttacccaaagttctgttttgtgttatatcattttgggacatgtgccacactgacctacattttctcctaccattcttctttggcttctcttattttaaatgccaactggatttagagtgagtaaatattgcctgattcttccaatgtaaagatttctcacgatgtgattttatttacagtggaattttcttttaatattggatattgtgaatctgtcacatggtaggcactcaaaaagtatttgaaaaatgaaaggatgaattagttaaaaaatgtataaatattcactgatgatctactatgtgctaggtactcttttagatgaacaaacttgaccttgttgagcttgcattttagtaaaatgagtgaaggaaatgaataaacaaataagcaaataaatgaatagataaatagataaagtagtttcttatgtaaccaaagaggtttggaatcccacttagaaagtcatttccaaaggtaaggaccctcttgtttatttggggcatggagggacatggaaagtgtggtgtattttcctgtaatgtgggaacacttttaggaactgaggccaacttgattcaaaaggagagccttgattctatagtcatcccttggtatctgtgggtgattggttctagggcctcctttagataccaaaatccacagatgctgaagtccctgatataaaatggcatagtatttgcatataacccacgcacatcctcctgtatgctttaaatcatctcctgccttcttatacctaatacaatgtagatgctatgaaaatagttgttacatttgtattgtttaggaaataatagcaagaaaaaaagtctgtacatgttcagtgcaaatgcattttttccaaaaatatttctgatccgtggttgattgaatccacaaatgtggaacctatgtatacagaagtccaattgtatacatgtgtatgattatttccctcaacattcctggcttagtccatttagtgttgctataaaggaatactgaagctaggtaatttataaagaaaaatggttcatttggctcatggttctgcaggctgtacaaggagcttggtgccagcatctgcttctggtgagggcctcaggctgcttccacttacggcagaagggaaaggaaagctgtatgtgcagagatcacatggggagagaggaagcaaggtggagatgagggaaagagccatgctctttttaacaatcagctctttcagggaaactagcagagtgagaactcactcacccccaagggagagggcattaatctattcaagggattcaccccacaacccaaacaccgttttcccattaggccccacctgggatcaaatttcaataggagttttggaggggacaaatattcaaaccacagcaatacccttcttcagtctggtctttattggttgatattctaactgccagttattattcctctgctggaagaaactaacagttaccaaccatatattttcatagtacataatattcacctttccttgtgtataagattattcttgtacttaaaatatatccaaaacttcttgctaaaacatttcataattgttcaattttgttacatttactcctattttaaaggaattttattaaaagcatattaagaacatcattttatgtttgattttattaatgccagctaataagcttacattccagtaacaaaagcccagttatttaatttatggcaggtggagttgaaatctgtggctaaaagaaattgagggccatgagatacagtacttaaaaatctgtgtgcatttgctttgacgatttaaactactatagtagtttaataggtagacaggcatcctaattgatatttttcatttagtataaaatgctaagttgaataagggttttgatacctgcttaatagtcacatattttgaaatgtttattttagactttctgtggtgatttcctatgcttatacaaacattttcagcaggcccctttgtttttaactcatctgacgatatggtgcaattcatcttaatttactgggtattgttgggttttagacgtcttctccagatagcctcacaagtctttgtatacactggattattttaggacatttacagtgaggtaagacagcagcttattcgagggcattatcctgttggcctctttgatctaagatcctttctgagagagccactcattaggtaagtacccttcaaaggagagcaagggtgcagaaatgataaaatcaatttattttttacttcatgccaacatgagaaaagacaaatcacatttctttaggaaggaatcctaagtgcctagcaatttggacaggataaatggagtttgggagaagagttttgaagccaattgttacttaaaattgataaactcaataaacaagagggttgtgctagcccacagagatcttatggggattgactgagattataaattcatgagaaagtgatttttaacccacaaaaggctatacatatattagtatgttaggtacattcattacagttagcatacactaatcctgtctttaatttacaacttggccttctccattcaagaatttcttttttttcttttttttttttgctataatactattctttctttaaccagtagtttattgagaaaaactttaacatgtccaattttaaaaatattaaatactatggtaatgtgtcctagaatgtcctgtttgtcatctgtttctgtttactacctgctcagttccaacaggtatttaaatcagctagaacactgataaagcctattgcagctttctgagttacctgtagtgagtcaggacaggtagcagagagggaaggaataaatgtcacaaaaaatgactcattcaaaaccaattttggttttagctgcaggcagtgacataaatgcacagttgcttactactccagatttctgtttccttcttttaactctgaagttgatggcttatagtctatagcaaaaacaaaacaaaacaacaaaaaaactatgctgaacataaaacttatagtgggtaagtaaaacttaactataaagaaaataactttagaatagaggaatgttctagttagcttcaaatgcaagaatcagaaaaccccacattccagaagctcatacaagtagctttgtaatcactagggactcacgttccttctgtcttgacattttgccatttttagcatttgcttgcacctcttagtgtgagacttttgcttcagttccagctatccaatccctattccaaccagcagaaaggaggcacgagaaagaaacctccctgtcctttaagttacacatcccatccattgacatctgagtcatttcacagtttattcaatatttgctgagcatctgctatgtgcaagcactgttctaagccctaggcagttatctaagccctgttcttagtgaacagaaaggactctatgaacaaaaatcctcctgttggtggagcttatattttactagatgtgagaacaagtgtgggggaaggggcccactggccagggttttaagccacatggtcatacttagcttcaagaccaagcagggaaatatagcctttagctgcattctgggaatccagttctaaggaaggaaaggaaagaatggatattgggggcaattggcagtctctgacaacatgaataaagtgtgaagaaaaataggtcaactggtatgttatgtcacttagcagtaaaaaacaactttgcaattacacctctagtctattcctaacagacatgtatgtgtatgcatgtatgtttagtgcatatctgagttcatttctgggtaccatggttggtagactgtgaggaggcatgtagtgagtgaacaagttgaggtattcctgaaaatctctttgtgctggggatagctgacctataaggggtattaggtccagagaagtccaagaagacagatgcttcttttaactgttaaggaagtgactgtaagaagaaaactgggcttgattcatgctgcctcagatgactgtgctagagttggtaggcaaaatttgagaggaggaagatttttcttttagtgcaaaagaactctgtagcagcaggaacactctcacctgttttgcatgctgcagaggaaattttcatcccaagtgaaaggcaaaggcaatctccaagaccctcctgtatgtaattccactaaataaatgccctgtcacgtagatgaaacttaggaaatgctgggctctttttcgttccttcccttgagggacttaatttgaatgcagaaactctgccaaaaaaaaaaattaagaaaaagaaaaaaaaagaaaagaaaaagaaagaaaaaagaaagttactgcatggtttaggacactgctctaatacatccacaatagaattttccctgaatttttaggcatttatttttcataaaactcttaggttattaaatatatgagccaagcagggatgtgtttcatagctcattatagagaaataattaaagtgagttaaattgcatgtcaggtagaatcaagagtccttcactatccctgccttgaggaatgtactatcttggattaaaatgtcttcagagaattaaattagcccaggcatatatgctatccagtgcatgcagactttgggggatgggattaatattaccagtgaacacttattaagtactgattccatggactaagtacttcacccagatagtgctgtcacctcctgtgaggcggggagtattattgcccccattctgtggatggagacactgaggctcatatatgtggaactcaaatacaagtctgtttgacactatagttcacagtcttagccattgagtgcagtcttccaatgaagaacttgagatatcagtgtaagaatttcaagtgtgggaatggtggcaccagttttaattaaatagtagaaagcagtgggcagataggtgcttcttcccttttttggggcaggaggacagcaggatggggagatggtgggaggaagggggcctgaggagaactagttggagaaggcctttgaagttggcttccttatcttaaaacaaaataagggacacactgtcttccggccaaaaacatgcactgtatgtatagttttaatagagaaaaatgtcagtcaaaagggacttcagcctggtggtttttaatggaaatacaaacattttctgagctagagaagtatagtctttcagcctaaataatcataatcagcagttaaataatctaaatgcttgtgaatcatagagtttaaataattccaagcaccatacttcatgttatctctatcttcacagcagccgcatgggggctagggaaggtcacccattaagaaaagggaaaagaaatattcaggccttccaacctcctaaaacatggtaagtcagaggaggcagtcttggccctttcttccaatccaagagcagcaacatattgaaagaattctgaccagtacctgatctaatactgtagggggcgttgccagatttaaccccttgatgcaagggacagggcagccacatcacacaaagaaacactaaggagccgagagtacagaggaatcacacatcaaatcctgaaggaagaattatttatgtaatctcagcactttgggaggctgaggccagtggatcacttgggctcaggagttcgagaccagcatgggcaatatggcaaaaccctgtctctacaaaaaatacaaaaagttagccaggcatggtgttgtgtacctgtggtcccagctactcgggaggctgagatgggaggatctcttgagcctgggaggttgaggctgcagtgaactgtgattgcatcactgcactcctgcctgagtgacagagtgagaccctgtctcaaaaaaaaaaaaaagaaaaaataaaaattaaaaaaagagaaaagaaagaaaagaaaaagaattatcggtgcagtgaggagaaccctgagcactctagttcatagcctgactctgccagttgtagttggttaagcccaggcacgcctgacctggtctttccatctgtgaacaggcctgtggactcagatgatttcattaatattcagtgattctctgaggccttaattgggggtggttttacctatcaggggaacctttggcaaggtctggagacatttttggtcatcccaactggaggggaggtgccactgccatccagtaggtagaggccaggaggctgctaaatatcctatgacacataaggcagccccaacaacaaagaattttctggcccaaaataccagtggtactgaggttgaggaacctgtaactagcctcattttttatactggtgtttcttaaactagggaagagagaagagctttgtagggtctcatctctgatttaacttgacttattttcacatggaactcacacaggatatattttcctgttcagcacaatgatcaggcatagaggttgtagtggcctggggacttcccattctgtatagatgactttgacctcttgattctagcttgctttcttggcattaaagaccagctcactatgtagctccccagtggaattgacacagttctcagattcaaatcctcaggggatggaactccctgtgagatgtaaaccctggctggaatccaaaagacctgttccatcaatgcctgctgcttggcagacaacataatcctgtctagctccagaattccatcattctttaacctgtggttctttctggtccacagtgtgcccagctataaattgagagtgtgaaattggacagtcctcaagggttgggctggtcctgtaaattgatgcacaattataacagccccttttactctctttccacttttgtttctccttaccatttgttccttcttcacaacatccctctgggtagccagatctttttctagggaagcacttcttacaatgttcatttagaccagaaaggatagaagagaaatgagaacactggtgaagtgagaacacagcgcagggcctgtgggcatccaagggaaacaaactgctgcctggatgccagatgcctgcctcaaccatgaagggcaggtcttgggcaaatcccaattcatagggtttctctgccttcctgtaacattttctttgccttggtaaaatccagtccaaatattatcaagtgaagtctcaaccctaaggatgaaaaggtaaacctcaagatctatgtcctcactggaacgagctatttcaaaaggatccatgtcaatgaagactcagaggattttaagggaggaatagcatggaggtgggctttgaatgttcttggtccctcctaaacattcaataaatgtttgtcaaatgaatgaatgaatgttgatgaaaattatactttgcttcttgctggctgcctcttttttctttccccctttcttacccactctctcttctcttccactccatgtcctgtttcttcttttccttcctctcttccttcttctcttaacttttccccatccttctctctcctctttgtcttttttccccctttcctatccctgttctggtgccttgaaaagcacaggggttcaaaatgctttctgcattgtctcagcatggttatcttgctagattgtaattttgacttttgggcaggaggcagaccaaagtagaccaaacatgtgggaagaggggtgagagagagagagtgtgtgtgtgtgtgtgtgtgtgtgtgtgtgtgtgaatgagtttaggggcagaaaaagagggtctggctctggcaattttgcctggggaatgaggtgtgttaagggggaccactcagttcccaggagcaaagcgatcgagaactatagctcaaagccaagctgccagtcaagtgggacaagtcttttgtgttccagtcacggaatttgggaaccaacagattgtgaaaattgaaatgcagtgtttgacttgatcttttggttaagccagttccctgggatcttaattcgaacctgcaggaagctgaggccaactctgagagtctgctattacctcacccctgatgcttcacttacttgaagacatttgcagagtgcactgcagccagtgccagcatgcagttatgataacagttcaattgctgtcattccactctattttgaaattggtgtttttgtgttcagttcactgagccctgagcttggagcttctttctcttcctggctctgcctctggaagttttcttggaaaatgttcccttcaatgtattttcaaggctcctgtcaactaatgctttattataaggcagtgtgggattgggtaggcccagtggttattctctgcttcccctctcctggtcatttttcctggaagctgactgctgtgagcagcatcactggggatcccttgctggctgactctggggagggtctggggccagtaagaggcacttcaggtgatgggagaggtggaagagaaaaaaatctagaggattttctccctcttcccttcttgctttggggccacatctctggccatagcagcttctctccatgactgtagctccctctcagcagtgcccattcatggctcccagtgtcgctgggattgattcatttctccctttgctccttcagcctgatacgtggtaacggctgtccagtgttgctagcgtctggatgcctcaaggtctcatttctttcattaaccctgcccacccctacttctgtagcttctccatggaagtctcctcattggaatcatctgtggcgaattctgttctcttcaggactcagaccagtacagtggggaaggccatggtgccgcggtcagatacataagatttgttagaatgacttaacaaatcattgttaaatcattctaacaagtgttagaatatgttgctagaaaatgtttacatttctcatattaagtaattccaggaaaataagctgattgatactaaagtcaaagcaccaaaacaaaaccaccattctgtggttttgtaaagaagaatggctttcaaatgacccttcaacatgaatgactgctgctgctcctaccttagaaagatgtggggctggagttgccagagccagtctcagttttgggtcaagtgaaaacacccccatactccttccatgtacaaagaaaagcctccccgccttattcttcagcctagagaaagttggtttgactgagtttcttgagacagaagcaaagagaacattctaggagtccctggccaagtacaagtcaactgcctccaaggtatgggtagcattctttgaggcaagctcagagcatttttggtttccaggaagctgaaggcaattgcagctttttgttgcaactgctctaatgcaacacactagactgaggtcaggcaagctaagcgctccttctcatggattcagtcatttgtttagtcactgactcattcataaaacaaatcatgctgggaagtcagttatttcttgagagaataaacaaatatttatttattgactacctagttaacagtctaatgtccagtcaaaggatgagacatcagaatgcagaatgacagctgggtaagtgtatgaaagaggagaggtccctggacccatgcttcctgaaggcaccctgagatgtgtctgggagctacattaggtgaaggggtggggatggtgggtggggtcaaggggagtttgtccataagagaggatctgcctatgcaaaggccctgtggcagaaggactgacttgccttctgtttgctcagtggaggcctgtgtgactggagcatagagatcaaaggggaaaactagattggttgaggctggagaggtgggcagaggccagaccacccagggccttggggccatcatcagattattcatgtttatcctaaagcagaaactcattgaatggaaatgacatgactggattgtgttttgaaaatcataacaaataactacagtgtaaagatctttatatatatcaattcatttaatcttcacaacaaccttccaagataagtactgttatcatctctattttacatttcgggcaacagaggctcagagaggttaagtaactagtcccaggtcatacagcaaaggtgggatttgaacctctcaggattgtcctgtggtttggccatgtgtttaacaatggcaccaccctgcctctggcttttgtgaggagaatacatttggatgtgggcacactagaagcatgaccctctttttcctttcttcctgcccactctgcattggctcccatcaacacttccatcattccatgcaggagagctgtgggggaattattttggcaaatgttgctctagtccagggtttctcagggcagccctgttgagattgagctggataattctttcttgtggggcctatcctgtgtttagtagcattcctggcctctgctcattagatgacagtgtcaatttccctcccccagttgtgacaatcagaaatgactccagacattaccaccagaagttttctagagggcaaaatcacccctgtttgagaacagctggtctagtcctagcctgtatctgtctgttgtttctcaccttggacctgtggcccagctctttcctgaaatatggaccttgagccggtgtattagtggcactagtagagttttaacactggctcatgcccagcacctctggaggcagaggggcccagaccaggtagattcagaaagcttagagaggagcgttttccactattcagcctttggtggtatatcctggacacttggccatcaatcagagccgttttcttttctctggggacataaaccttttcagttctatgcaactgattccaatatgaaccttttataatctactgtcatgtctgggcattgcctctcaaatttctggagaactatttcctaaatagctacgaagctttcctttgcaggctttcatttgttgagaaggcttttctattgaagttaagtaaactgcatttgcaaagctgagtttctcaaatgcctatatttggagaacagacttttaagtaattttggttaattaagaatcccctagtaaatcctatttttttagaaattgccatgagaagcctgcatggaagcctggcatccatgcggatatgtggagagaaacacacaagccctcaaatgaggtatgaccatgagtctggtgttgatgagtagtggtttctcttcctccaaaggcaggagatgcctctgtagaatggagtggagtattcctaggaacaccatctcttccctgttgggccaatgggcttgggtaaattactgttaatttttaaaatgtcaattatatactaaagtaaagtgaacccccacatgacctccatccaatttcagcgattatcagctcattgccagtctgtttcctttctattccccacttccttgcctcatccctagattattttgaagcaaaactaagatattatgtcatttcatctgtaaatatttcagtataaacattattttttcagataaacatcttgacaccaaattacaaactctttaaagtagaggtgaattctaatgaagacctttccccctagagttgaaaccctctggcacccaaatatgaaaggcttagattttaattttttaaaaaatattgctgtaaaacagcaaaatggaccatttggtggtattatatggggaaatcagaaggattacaccactgacacattccttaattgattttggctctattctttgaggattttgcttaagtcttgatgtcccagggttgacataattacatcttcgttagagttttgttatctctttatgattattgacatttctgcatataaattcctgtctcttttcaacttcttggccgaatggtgcctcttccggattttgaagaaacaactttcagagtgtgaacttgaactgatcattggtcacattatctacacctaagggttcttggatgctgattaatggtagcttttctgcagagaatgaaactgagattaagccttctttgtagggaaattaaacacctgaatctctggtgaggtctgaacataagccactcagcttcttgcactgtttttcttaagcatcacattggcttacccccaaaaccacctgttttattgggaaaaaattcacttcttcatggttgcttgctctggagcattaattaattcaactctcatttattgagcaataactgaggacctcccactgtactagatgttgatccagtcatggcttagtcccagctttctgggagcttactccagtattgattatttgaatgtctattgtacatccaactttgacaccactttggtgatttgtggggtcagtggggtggtttccatatccaaatatccctcaattaggtaaccagggatatcactgggttgagctagatttttgtgttgggcttgaattgactttcaaatctgtttgctctagagaggattgattcaaaatgccgtaacagctgggtcaggaacttgagcagcattctagccctggctgcaatggaagctagggagagaaggtatctgaaatggggtgagaaatgtgaaggccacagtcccacaccaaaacagactttgcgtccatcacagttctgttgagagttggctttgagccaaggaagactgagtggtgacaattaaatgtcgtcatggaaacagtgtttctgctctgtaatctcatccgttggtgttccttaactccttgggctccttagccccctgggaatgggtctcttagtatctgcttgacccctgggtgatgagggttgcattagcacgagggtaagtgtccaggcttcaggggatcaaatgacttggatttgaatcttggccctacacctgctctgctggctctgtgaccttggccaagtgtgtaaatcacattccctcccctgtgggattcttctgagcattaaatgagttggtacatgtaaaacacttagcatggattgctaagacttgctaagtagcaagtcttaataaatctacttaacattgagggaactcattccttcttcagagaactctgtctcttgaaaagtctaccctgccgggtatggtggctcatgcctgtaatcccagcactttgggaggctgaggcgggaggatcacttgaagtcaggagtttgagaccaacctggccaacatgatgaaaccccatctctactaaaaatctaaaaattagccaggcgtggtgacgggcgtctgtggtcccagctactcaggaggctgaggcaggagaattgcttgaacccaggaggcagaggttgcagtgagctgagatcataccactgcactccagcctgggtgacagagtgagaccctgtctcaaaaaaaaaaaaattgtactcttttttatactataacaactttatcatttcacctcctggttctttggttcttttacatttgctttttgaggccactgatgtattcggtttttcacaacccttgagtgtttaggacagttctgtcctctcctcttgtcaatacactctatgctgcagaatcttctcgcctctctgtgaaagtgtcggttcccccttctcttcttgtgacgggttttgaagattcatctcctttggatattgtgcattctttctctgtgcattccacaaatagttactgggcatcttctctgggagggtgctgcatctggccctagtgacatggtccctgcctagtcgagctcacactctaataaggaagttggtgggataagctggtaattataatacagggtggtaagtgctctgggaaggaaagaccaaagacctgggtatcatggggctttccagatgggaaggagtcatgtggttgaggaatgctttcaggagggagggtcatttcaactgagactacgacctgtgtggtggaagaatttggggaggtaaagaaggggggacagaagaatggtttcatatggaacccataatcaaaaaaatattcaaatggtgaataaaaagaatttgatgattaaacagatggagtcttgctaaaagttcagaacagttctggaaggttctgctgaaagctgtcatttgtatgaggggaggagaggaggttccaaaatgtcatctccgtaagtaggcaataatagataatcttctaccacaacatccttgactcctaaccttatctttgccttaagacaaataggttccccaccaagcagggctagagaccccctttttcctccattttcacattcttcttaacatgttaccactgaaagctggctactaacccaagtcatttatcccaagctgccattagagaggctatctccaaaatgcgtagcaacattgtttacattcacattggtcaactgtaactggatataaaatttttggcattacctttccctcatgaaggtattaggaataatttatatgtttataataaggaaggatttagaaaaaaataagatatacaatgaaagaggctcccagaactggcttggaatttttcagggagatcttgagcctggaaaatattatttaaaactccagcttggagttaagctttttaatacaactaaaagtatatacatgaaaatctgtggcagcaaccatgagccactttccattgcataatctaatgttttcttatttcaatacttgaaataatacgattttaaaaaagaatataaaaccttaggaaaagaagagttgactcctgccaaggctgacctcagccaaaacgggcctctgccccttagcatctctgaaaacatgctttaagtttcattaactgaggaagtaataatgatcaaaattatggaatggtatggtgtttttactgagcagcagccagcagagggctaggacggcttcagcctctgatgtggaagtccacagaacaggggcttcaccaaatcagccgggagggagggagagccagcttctgctaccagagatgtctttgttctttttcttgtgagctgtctgaattatgcccttgtctcctgaaactctcttggcaccattcacttcggcctcaatggcaccagaacagaaatgataactaactacaggctccagggttcctaaatccagtcaacaaacagtttacaggaatccagtggattttcccactttttagatgtggattatatcatggcccactcactccacatctggagaaaagcctgcctgttgtagatgcaggacttgactgtgcacttgtgtttgtgcacagttccatggtccacacaccacactcgtcccacttaggtgctttctaataagtcctgaaagtgtagagcttacttcacttaaagattaagggaccaggaaattcttctttaatatgtagaaacgtacacatcgtcaggaaagcaggagagaggaggaggaggaggtaagctatcgtcatggtagggccaaatgaatatgcaaaattatctatgctagatgatcggaaattctagtagtgctaggtattttaacagtataatgggctgaataaggttgaatcattgttttatgattatccaagataagaataatattatatcattcaagataagaataattcttatacaaaataaaaatttgtataaaactttatagctataaaagtgctttctcttatttgacattttaaagtgaccaatagcagtgacattacatctcttttaatatctgaaaatcaagagtaaatgatatttactttgaaatagttttatctttttaaaaaaatagaaattatgcatacatattatgagaaatattgactagcaaaaagaagaacgagtttactcaagaaaaagacttgacattttatttctgttttcctttagtctcttttctcatgcatacatttcacatagatgcgattgcattttgttacaattttttctcttgtttttttcatctacatgaagcaatgcttattattctctagtcattgtaaaataaatgcttcccctccctccaccacccaaactgaatacagatggcattgtgtatgtatggtcactacggatgactagaacccttacagcttagattcagaactcatggaaagggcttaactatttgagttaaaccctaaaacacttattgaacacctaccacatgccaggccctgtgctaggcactgtgtgtgggaggtgggtgtggtgggtgggaaagtcctgccaagatgatcaagacatagaggaggttttcaggcagcttacacttgatttgagaggggaattaggaaaggaaatttggaagtaaataagggaaaaaggcaggtgggaaggaaggaaaggaagggacttaggaaggaaggaagagagtgtgttgagaaagaaaacaggaaggaagggaagggagggaggaaggaaggataaataacaccaaaaagcaacaaaacaaaacaaaacaaaacataaattcctaatgaattttcaattttcagaatatataaatcattcaagacaattatatcattgtataaccatttttatattatataaaattatataaccatcttttatatcataaaagatatccaagacgatgtaaaatcaattttgggggaattttaccaacattaacagtgacttgatgatgaacaagctttgaagctttcccaggttcttcctgtattaatttctctggacatcttgaatgctaaatctctctctaaaatactcaagagaaagcatactcaaatattgttgccattaaggaagacattattggtaatgtggctgtgaaatacacaaaaaacttaatggatgatttcttaaaactctaagctatgtacagggctctttcacatcatgcacaaaggtgaactcaaatggatcatagacctaaatgtaagagttaaaactgtaacactcctacaataaagcatcagcataaatcttggtgaacttgggttatataaagctgctttagatatggcaccaaaagcacaaataactaaagaaaaatgtgataaattggacttcatcaaaattaaaaacttttgtgctacaaacgatactatcaagaagagacaaactacaatgtgggagaaaatatttgcaagtcatatttcaaaatgtggcttgtaagggatatgtatcctctataagagttataagaactcttataactaaacaataaaaactcaaataaccttattttataatgggcaagggatttgaatagacatttctgtagagaagatatacaaatgaccagtaagcatatgaaaagatgcttaaagttattagtctttagggaaatataaatcaaaatcacaatgagataccactttacatccactaggatggttatcagaaaaaagacaggcaattacaagtgttggtgaggatgtggagaaactgtaaacctcatacatttgccagtaggactgtaaaatggtgcggccactttggaaaacagtttggcagttcctcaaaatgttaaacaaagttaccatatgacacagcaattcaacttctagatatatacccaaaagaaatgaaaacatgttgtcacacagaaacttgtacatgaagggtcatagcagcattatgtataatagccaaaaagtgaaaacaagtcaaatggatgaattgatgttgaatggatagacaaaagatggtacatccatacaatgcactattacttgataataaaaagaaatgaagtattgatagatgctgcaatatgagagaaccttgaaaacatcatgctaagtgaaagaagccagtcaaaaaggccacattgtatgatctaatttatatgacaaataggcaaatctatagagacagaaaatggattagtggttgcctagggctggtggaaggagagtgagagaggtgactggtaatgggtatagggttctgtttggggtgaaaaaaaattcctaaaatttgattgtgggtgatgttttcacaattctgtgaatgtacaaaaactcattgaactgtagttcaatggtgaattgtaggtgaattgtatggtatgtgaatatttattaaagggggtctctgcagagtgctccgaaatctgcaaagacatacgagttatagtccatgcctatgtttatatacagcctgtttgaaaggagaatatatataaaatgattggaaatatcagatcacagcctcaaaatcattttttagctcagcatcgaaggaatgtattaccaagtgaaaggcactggtgcttgaagtgaaactcactcatttgaattcaatcaacttatatttattttgagtcttgtagtaagtaccaggcctagttgtaggagctgaaagtaggtagagaagattatataattgggtcattatgttataacctagatatatacaaagggctttttcagtagttcccaagaaatgagagagaaattcatttggcctgtgacgtggttgcaggggtggcttaaagtcgatatttaactgggtcttaaagattgaatagttcaacaggtgaagaagtgggtaaaagagactaagtaaggacttactaaacaggagatatggtaatgatggtgataatggtgttggtagtggtgatggacaacaatgattatggcggtgatggtgataatgatgatgatggttgtgatgatggttataatgacagtaataatgatgtgatgacaatggtgatgatgacccaatgatgatggctgtggtggtggtactgctgatgatgatgactgtgattgtgatgatggtgacagtttggcaaagactgagtttgaagggcttctgaggcatttaagttatatcttttcaggcatttgcagccataaaccttaagctgcacatggtggccaggagcacctatcattggccagtgccttgctttttgataaaatattatcttttggtcagacttatagaaactgcatgttggcttaaaaagaaggaaccaagtgtgttaatagttaatgaattgctgcacatggatgtaaaatacacagtggttgttatctttgcaattagcagccactcatgtcagtaactttttggaagatccactatatgcctagttctgaatctcacagtaactcctctcttgaaatctttgggttaaaatatttatttgtaccatatgaaactgctattttagagtcagaaatggtgaataacaaaaactttatctggattaagctattatatatatataatatacatataaacacacacatacacacacacatatatatacatatatacacacacacacatatatatgtgtatatatgtgtgtatatatatgtgtatatatatatgtgtatatatatatgtgtatatatatgtgtatatatatatatatgtatatatatatgtgtgtgtgtatatatatatatatatatatacctgctgctgatttatgtcttctgcagtctactgagtatatgggatgggtagaaggggtgaaaaagagctacatatcatcctgctataatgacaacctttatgctgttaactctgagtgtgtgtgtgtgtgtgttacagagaggataggtactatagactagtgctatccagtactgtagccatgagccatatgtggctattgagattttgagatacggctagtacaattgagatgtgctatgagtataaaacacacacagtttcaaaaacttagtgtgaaaaaagaatagaaagcatctcagtaataatttatatattaattacatgtttaatactttgggttgaataaaaatattaatattaatttcacctgtttctttttacttttatgatgtggctattagaaaatctggtttgtgctgtatttctatttgacagtgctgctacagacagagaaggttttcaaagttctttttggtgtacttttttggcacattctggagcaaaaccattcaaagtggcttttagaaattggcccttgaatttgaattttctgagcccaactctgcttcagtttccttgaaaaaggaaggaaaaccaatctggcctctaaaatctacattttgaaaattgcattagggaactatattccttctctaacacacaaaataaattccagcagttcatagtttttccatgtacttatagtattttctttgcctttgctttttgttctctgtgtttttcctgtcatcgctttatcaaaatattgaggccctggcgtcgagcaagcagagatattcaagatacataagtgcctcacttatccagtactgagtctatctgaatcacttgaggattggctaagtgtatgagcattcagatttctccaaaattgagaccatgccatacagtgcaggattagcaaggagaaaaatgtcagtctcctggcgctgacagtttgaactgtcagggtcagggctctgtggtctccttttgctcccctaatcccagctaagaaggtaatttaagtgaatcctggggtgccaaattaaggaggctctaatgggaaaatgggaagtggagggtttaaaggacacccattaatgtgctcacttcaagatgtcctcttgtcagtgcttcttaggaaggcacaggctctccagtaatgtcttttctttttggaacccaaccaacggcaagtatggagattttaaaacataatattttggaacccaagggaagtcaaaatattgcagacaatgataaaaccataattcagtcattgtgttgtgtgatcctgctgcatgtggtgggtctgctggaaagggaagtgtgacaggtttgaacagcagaattcgacatctcaatttggcctctaattatttcttaaataggtccaagtaaatctgcaaagtgtccagagatcctcttttctctgtagcttcttctaggccaaagagaaatcagggtagatatcagctaagaatgtacttgcctgctctaacagaaaacctgacaaatagaataatatgttttctcacgtaacagtcaagtctggagacaggcagtccaggataaactaggccatcctagtttatcctgttatagccagcttttgtcttcatgttgcaaaatttctgccacagctctagccatcacatctgtgtcccaacgggaggaagtataagtgccaaatgaccttacctgtaggaaaggacatctttccatatttaggaagggacacccccttccaaggacctttgctatgtcgttggcctgaagtgggtcatatggcttctctcagatgccagagactctgcatagatgaagaagcaactagaatttggagcccatagagcttgccactctgaccaaaaaaaatgtgtgaatatatatgtatatatatacacacacacacatacataaaatacatatatgtgtatgtgtgtgtgtttgtgtgtgttttgcttaaatagcttctagctcagttcttggcacatagtatgtaatcaaaaattggagcttaaaacaacctcacttttgtagttaaaaggccatagcagagaacactgcaactctatcctctagaagtagaagtggttacttcgattagagtgatgtttaacactggctgagcatggcctatgggcatattcggcctataaaacacagtacagggctcagtgttttacatcttactaattctttggaacaacctgatgaaagagagaatattctccccaagttacagggaaggaaactgaggcccagagaggctagataaatttgcccaaggcacacagctaatgtgggggagggctgagatgccaaccttggccttctaccaacaaggcctggggcttttataacctctaagctctcctaactagaaggctttgggtacatagtcgatttgcctagtaatttgctaatccagttcaaagttttgaacaaaagaccttagaatgaatagcaaaaaggataaaagagagagagagaaatgaaaaaaaaattaggataactttagagtaattaaaacaggtccctatatcatgggctgttaaaggcttaaatgatgctaagttctggactttctccatcttagaatatttttcacaggttctctgttttggaggatttgccatgtttccacatgttatgtttgctttggggttgtctaggggcattctaaggagcatttctgctacttggcaccaggagctcttcaggaggagtgacaatgagctatgtgcatatcttggggtgcaaccagctgcgctggcttccatgagatccgtagtaaggaaggcaaggtagatctgaatctcatccgaggagtggaggttcctcaagaatgatggatctgcctttgatgtctagcagtttccaaatagcacagaaatgatacagatacatgccaaaagggggaaaagcaacttttgatctagttagaactaattaaactttcaaaatgcatgaaagaaacttgagtgctggccagttgtttgctatggatgggttttgtcaacgagcacagttgaaaatagcgtagctacagcaaacccctacctttctatttgggggaaattagttttttggtttttgcttctaaaatgtcagggatttcccccgttgcagactgaaataacccgtgtagtctcttttacccccgtttatccagggatattaagagtgatatttttctttaatgtcttctcagaaggctctctcttcagtcccttccttgctgtcatactgtgtttagtctcatgtatgctttttgttagtgtgtggactaaaaaaggtaatctaattaacagaaggtaagaagccctcaggattttggcaacagagaaaaacttgggctctggtatttgatcagcaattcctactcaaagctcacaactcttacctcattagcaggggagtttttcgagctttttaagcaggcttcagcagaaaataaagtgcgtcgttgacaggacaacagtcagatctgagagtggctttctgaaaattcagctgcctttattcagagtgactggcttggtaaatgtttagagggccctaattatgctttggggcgatcaaaacattgtggatttatgctgtttcaccaaggagaatggcctactctacataccaaaaaagaaaagagaaaaaaacactaaaagggaggacagaaaagaaaaaaaggaggcggatgaggcggggggtgcacatcgccccagcttggagagatggcctcttggtagagcatatgaatccacttacatgtaaattgcttgtcgctatgaattaagggaaggctatgaaagaactgctttgccgtgtttactataggatttttgacagactctttcctctttcaagtaaatttggcttaaatccatagtcagtccagttttaagtaaactcctcttttgttacattaacaaggttataacatcactggggcagatttccagctgcaggaaccgaggcctaagtatggggctgagggtataattaaaaccttcgggtgggagagttaaactctcaagtaaaattggataaaaggctaattgtccatagcaacataatacgtgctttaaatatctgtgaaatgaagatgaatagtaggaggcttgggataaaaaaccttttctactctctgaattgagatctgagtttttaatttaggacagagggcattttcctcctcaaaatcaattttgaaagcacagtgtcatccccctggtttgtcttctgtctgtactaaagatcttccatcttacaaaacggggagtgtttatagctgactagcaaggccacaagcagagacctagatgttctggctccataggtccaaacaagggtgtcaaacacttcgttcctttaaagaaggggtggtggtggggatgtgggtgggtgggaggagagtcttgggcaaaggcacacatacctttggtgaccttcttgaagatgacatccagccaagcaagatgatacattaccacatgctaaaaaaacaaaatggtttgtaatgacagcttttcctgagccaatgcatcatgaaggcccatttgttattcattaggagcagcctggccaggctggctggtagggagcctggagacttaaggtcatcctacacccctgccccagtggcacagacaaacacgaagacagctttagcagcccctccactgacttggccacactgctgttgaagccctgcaggaatgaaggtgttcaaaaacagtaaacagtttagagttactgcgagggggtgagggaaggggtgggtggaagcgaagaagaaaggggaaaaaaataagaaacgattttgtgggcaaagtttccccatggagctaagcactgtgagcccccatccaggaagtccagtagcctcccccagcagcccaggaagtgaccccaaaagagctgtatgtctctccatctggactagggacagtcagaagagatggagtatgagagctggacgctattggagaggggtgagtatttgagggcttgctgggagaagtacatggccatgtccaactaatagaattgctggatgcaaaatgggaaggtgctgagggtgcactggggctgtaaaggagccaggtcagttctttgcaaaattagggatagagtgcaggggtcaggaggacatctggtgctgggcagagggagcagaacggctaagggaaggctggcagggtgcaacctcagcaagtgagtagattgagaacataggcctagcatgccaggaaaacagaatccagctgcccagctctaaagcagagagtggtgttgaggctggcccggaccctgcctactctgtcagctatgtgatgcgcctgctgtaaaggagatcacctaggaattacatttgtggtattttcagcctaggtgtgttgcagagtatttttgtcttgctctacaatatagagacttgtattttgaatcaaaatgtttcttctgactttgtaaatcagagcactttaagataggacacacctactgcttgcacttggatgcttctcagagggctgtgatacctatcttctgtttcattgtgagcagcagtgtgcttttgtgataggcatcagagcctcctttaaatatttttgctcagagtcatgtagatcacacattgcctcgtggcagcttactatcagtagtgttttaagtacttttaagtatgttgaataagagcttttattttagagttaatatatccatttctcctgccagcattgtaaatttaaattccttcttacatgtaacaaagacatgtaatatataaacagggttatagctcagagtaagaatgacattatgagaaaataaagctgagaatgctgtgtttaataggaaccaactcatattagttcaaactaataaaatgttagccatctttacttgtttttatctttaagtagcgtatgtctcctttttaaaatagaggtttagttatggcatatgtgtctatgtgtgtatgcatgtatatgtatatacatatatttatatgtcacaagtttcaggagaaaaaaattactgctctttctataaattattaaggcttaatgccaagttatagcaaaatagttctgttgtattttttgaggttatgtaccatttggggagcaggtgaaggagaggctgggagtttgtagacctagatttggttggatggctgtccattccgtagaatagatgggatgtgaagaggtacccaaccatttcagagatgagggtccacacttgatgagtcagcaaatcattgaaaatcgagtgtttcatgatgagggaaggaccttctcactacaaggctgatcttgccagacatctctttttccaccatacccagctttctctctctccaaggagcctgagtagcctatgtaaaacaattgtaatcatcatcatttaccctttactgaacagcaatgaaagtatgctcccagctcaccttttttcttgctagttattagtcatggtttttgttttgttttgttttctgtattagtggcctgacagtagcattaaaagaagaatagcaattttcttggaggtgataaaaagttttagataatagtggtggttgtacaacactatgaatgtgattgatgccactgaattgtatatttaaaaatggttaaagtgacaacttttgtgttacatctatttgccacaattaaaaaaaatgatacagggagagggagagggagagacaaagacagaaatggcagagaacaaagatgcgggtatctttctggctcataaccttattacattctggtctttgcttcactgtcagcttatccaagacactttctgaccacattagctaaatagtgtcttccctgtcaccctctgtcctcgtaccctctctgttttatttttcttttttaacatttataaaattgaaataaaattcacccttgtaaccaatataaagtatacaattcagtgatttttggtacatttattttgcagtacaacccatcaccactatctaattctagaaccacccccacccccaaaaaaatactcatactcattaagcaattactgtctattaccccttttccttagtctctggcaactactaatctactttctgtctgtatggttttcctatactggacattccatataaatggaatcatacaatatgtggccttttgtgtttgtcttgtttcatagagcataatgttttcaaggtttctgcatgttgtagcatgtattaatgcttcatttctttttattgccaaataatattctattgaacagatatatcacattttgtttattcactagctgatgggcatttggattttttccgctctttagctattatgaataatactactatgaacattcatgtgcaagtttttatgtggatatgtgttttcatttctcttgggtatagatatttttctttttaacatttaccatcaccgtatgtgtgtgtatcatattgtgtatatatgcattatattgtatgtgtatgtatatatacacgcagagacatatacatgtgtgtctttatacatatatgtgtatatgtgtgtgtatatatatgttttgtttattttttcattgtctgtagtcttctttatgtaatcaaagctctgggagagcctgggctatatctccggtgctcagaacagcgccgattgaatgaattagttgatgaagaatgaatggtgttctgttctgcattggacgagtcacaaaattcttcctgatctatagtttatcgtttggtctttctctctttcaaacccttctctgggtggaatatgccctagcagatcgatcactcaagcaagagagctgttccttagtatcactggagcattggtgggccctaccaagcctgctgcctggctaatgtctaaagacacaaaactggggtgacttaaccaaccacaggcctgagtttagttttaatgctgattattgttatcaagagaatccgttctgtctgtgacaggaatcctcttgcatttgtagtcaaggcaaagatgaagttctttttagtggtgccaagaagagcctgagctccatctttctcagaggctcagtgttcatctctactttgacagacaggggcaagagaggaaagaatggactgctgcagcctggaggtcgatggccaaatatattattattcaccagttacatttaagaggccagggacacctttttatgtaaagccaaagtaaaatttaaattactgcagaatttttgtatatttcaacaaagaaagtatgagtcccatgggaagggaaataaggcattctagcatttgcttttatatctctgacaaatccttgcaggtattgtttaaatctgctagctccacatttgttctaataagctatatagtttcctttaatgttttaatgggttctacagtacttttattctgtttgattctgtttttctttatagttaatctgcctttaagcatttagaggaaattgttcaatttttcaaaaacttccacaggatgtgatatgtatggtttaaatggtaaatcatccccccctaccaaagaaatgtcatggcaagaaagcagacgtagttatcacactgtttattatttgacttggccaaaggcctggatttggggtctaattttaatatattagaatgtacttttcttggaagtttgcatataaatactgtatgtttggtaagtgaacagcgttgtaaatcaaattacacttgactgaatgtgattttctccatgtttattatttattcctttcatcagtgaatgaggaatttctcatcttgtgtgttataggtgtgtacatttccatctgagacactcttgtgatggggtggctcaggatcgcagatttcagtcatattggtatggtttacacctctgagatgccttttagtcattgcaggtggatcatctgctgtggcaatctaggtggaaatggggcagttcacctccttttgagtgtttccttagtggaattgttttccttctcaaaattaaaataaacattggtaagagagaatcttaaaggaattcaagttactgggctgccatggataatggggggcttatcatactttgagcatcgtgcttttggccataggaaaactttaagacccacatcaaacaaggatgtgagggtctctatttacagctgagcttccggggaggagctctctgttaaaacaagagcagaggcaccatcccaccctccccaccagcctccttccccatccccagtttacagtatgcaggcccataggaatgcgaatcccactccagagcccattgtgaatgtgtttctgaattgtttaacatgtttctcacaaacaggacatgacatgtatggtttaaatgaaaataatggccctgctgctccgtgccagactgtcttttgtcaagagcatcctggcaataggaagggctctgggctgacatgacccacaggccaggtccttaggggatctgggctggatgcatttcacacgagaagactcttaaatcagggggcctccctgagggcccatgtcctggtgtgtgcctgtgctgctctgcagcaggccccagagccgcggttgtctctgctgctcctgtgctctcagccacaaatgaagaggaagattttcttagcttttggattccttagctaaggaatttattgtcaaaccaaaccaaaccaaaccaaaccaaaaccaaaacaaaacaaaacaaaacaactacaaaagcaaaaactcaagtttatgggagaatgtggggattttaaatcttatctaggtgctttgtgctttattttgttttcccctgggatggagtctcactctgacacctgggctggagtgcagtggcgcaatctcagctcactgcaacctccgcctcccggattcaagcgattctcgtgcctcagcttcccaagtagctgggactacaggcgcctgccaccatgcccagctaatttttgtatttttagtagcgacgggtttttaccatattggccagactggtttcaaactccttacctcaggtgatcggccctcctcggtctcccaaagtgctgggattacaggtgtgagccgccgcgctgggcctgcttcgtgctttgtggaattaggccttgtgataatttggtctaatttaggccttgtggtcaaagcatgtaacataaaatttatcattttcactgttttcaagtgtccagcttagtagtgttaagtacattcacattgttgtgcagccatcaccaccacccacttctgtaattcttttcatgttcccaaactgaaactctgcactcattctataataactgcacgttcctcctctccctggcccctggcagccgacattatactttgtctgtgaatttgactcctctaagtatttcaagtaagtggaatcatacaatatttgaccttttgtgaccagcttatttcacttagcataatgtcttcaaaagtgatgatgtttgaaataagcagattagagtatatctaattcaattcatacttatatttcctgagtgctagtgctttctttttttttctttgtttatttgagacagggtctcactctgtctcccaggctggagtgcagtggcacaatcatgacactcatggcagcctcaacctcctgggctcaagtcatcctcccctctcagcctcccaagtagctgggattgtagatgctaccactatgcctggttaatttttaatgttttgtagagacagggtctcactatattacccaggtgggtcttgaagtcctgagctcaagtgttcttcccacctcagcctctcaaagtgttgggattacaggcatgagccaccacacccagcctcctgagtgctttctatgtgtatcttttaattttcagttggttgattcatcaagcttccatgtcccatgaatcacatggttggacggtcgagggtgggtggatatgctgtcaccttagatcaggagttctcaaccaggggcgattgtgctccacaacccaccccaaccctgacccaggaatatttgacaactggagacatttttcgttgttaaaactggacagtgggatggggaggaaccagaaggtatgctactggcatgtatagggcagaggccagcgatgctactaaacattctgtagtgcacaggacagcctcctgcaacagagtattagcccatccaaatgtcaaggtgccaaattcaaaaactcctataaagggctaatgactatgccaataatttaggggggaatatctggagaaaaatgcagtatgtatttttattgagtaattttgaaacaaatttctatgctgccatcaatttattactaatttagtgaaatgtcttaaatgttgagagttcagttatgagtaaatgcagactgagttcctcctctcatggagtaacttcaggtataaaaatggaaggagtcaaaagaaaagaatccatgtacctttaccctcattaattctgctgcaagatttttttaaaggaatttttaacccgatcactagattatctacaagggaatttttttttaatttaaaaaattcccttgtagataacccggtggtcaggttggatggctccatggaggtcatgaggtgtagagctgtaactaggagaacttgctgttgtgcctcttctgttactaagtggctatgtgacatttggtagttctgattatccctctgggccatatttatcttacctataaaataagggatttgtattacatataaaaatctatgtctttggcattagtgaaatacaacaaataattctaagctagtagtttattcttgtggtgtaattactgtaaagcacattttactacatcagtttttttgttttgttttgttttcgagacagagactcaccctgtcacccaggctggagtgtagtggtgcgatctcagttcactgccacctccgcctcccgggtacaagcaattctcctgcctcagcctcctgagtagctgggattagaagaatgcgccaccacgccagctaattttgtatttttagtagagatgaggtttcaccatgttggtcaggctggtctcaaactcctgacctcaagtgatccacccgcctggcctcccaaagtgctggggtaacaggcgtgagccgctgtacccggcctgttttagcaataaattaatatgttaagcctaaaacaaactgccagtaaggacaccatgttctgtgcaaagggcccaagaccctgggctctctctgttgtcatatcttctccttattaggctgagctcccatggccaacaatggtgtgacacccatgtgatccaaaggattctttttttttttttctcatgcagttttgttgtggtcaactctaatgagagtagatgggatttttggattttttaaaagttaggtgggcaggaaaagcaaaaaatatgtatttataataaaaactattttttaaaactctagatgagagaggtgaggaacaagtatctaaaaccaaagctctggagtccagttattaacatgcctcacataatgataatgggaaccaaactaaataaagccctggtgatcttcaagtttgtgggttgggcacgcaagccagaaaaaattttgttatttccttggaatgcgttgtgtgtcattctccagtgcattccctctagttgtgtgtgtgtgtacatgtttaaataaagacaatgacaaaataattgattgtaaagagttgtagcaaacaccattatctgaagtgtagtttaagtggagagaggctggaccatagagaatgctgagaataaagcctggactctggggaggccacgtaggagcctgctccaggccagtacccactgttgtcctgttaccatgtgcattctcatcctgccaccaactcccagcatgggcttaaaaaaatcattatctagtattttttcttagagatggaagtaagttttcttcccaaggtcagagcttttccaagaatgtgccagcagtctctgcagtctctgaatttcaaacaacatctgatggggtctggattttgagcatggacttctgtctggctctccaggctatttgatgggatccagtcttgctctgtcaatcagacttggaaggcaaatacaagtcccaggggaagtcaggctagaaggcaggacaggaacttgacaggaagagaccaaatgttgccctttggttctctcgtgtgtgtgtgtgtgtgtgtgtgtgtgtgtgtgtgtgtgtgtgtgtttgaaaaagagtatctagaaacaggatggtcaggaggtttcattcagagtgctaccttgaactgatggataatgaatgttgtaaacatttaaggtgccatagggaacaactctgtgatcaattagtgatgtctgacatcattgggtagaagctgcaatggcccatatgttatatattttccaacattctctagttcagggattttagattaacagtgtgactctctaggagtggtcttggctgttatttagacactttgattctggtaaatgcatctaaaacagttgaccctggtatgaagaagatgaacacctaagtactagctctgtcttttaccacccatgaggtcttaggaagattgggaggccttcctatgtctttatcttcttcctctataaatagttacttacttcttccagttattgtaaagataaaatgacttaatacacattatttagaatggtgcctgttacacagtgaactttcaaccagtgttggtttgtgagttgaatgaaagcctttaaaagatatgtccacctggaacctcagaatggactttattcagaataagggtcttttcagatgtaattaatgtaagtatctcaagatgagaacatcctatatttggatgggccctaaatccaatgacagatgttcttatgagacagaaaagaagaagatacacagagacacagaccagaagttcgcatgaagttggaggcagagattgtggaggcagagaagtaatgcatctgtaagtcaaacaatgtcaaggattgctggccatcaccagaaattaggaaaaagcatggaatggtttctccatcagggcctccagaaggaaccaactctgctgacatcttgattttggacttctggcctccagaactgtaagatgataaacttttgttgttttaagttaccatagcggtaatttattatggcaatcctaggaaactaatacagttgggtattggcattattattgttgttgtttttaaggtgaagatcaattccttggctgtctcctaatttgggcagtcctggaatttgtggactttgatgaagtcaaacagaatctcaggctacccagaagcactgttacctctgatggtggcaagtggcttgttctttggactatttttccctcaacttagtccttggaagatttaaatttgaaatcattagaatgtaaaaattgaagaggggcatgggcatttgttgatatggaaatagaatggctgacagtagaatggacaaggcatcctcctgcgtcggtgccagctattacatccaaatttgagagaaggcagggagttgaattctagaaaaagtgagctctgggaaaaaatcttaaaatgtgcaaagaggatgttaacctggagacagacccccaagcactgacgttcttggggtgatagaagcttagagaaaccacaggtccagggtatagatgatgcttcagctggcctaaagcaaatagacattttaaaacctgggaatacattgaacacttcttagttagaaaaatggattttaggagtcagcacttcctacatgtccagatcagtccagctccatatacatatgtgcagaagaagcacagatcagtcaaaagaatctggattcatatggtggtccgggactcttatctcagatctgccattactgtgtggtctgtggcaagttactgaatctcttggcctcagttttgtccacatagaaaatgagagtgactgtgcccagaatgcagaccatgttttgagaacagttgactgtggactcacctaccatagagcctggcagatggcaggcactgtctctgttttttgaaaaaaaatatttaagtgcctaagatgtgaaaaactggtactaggcatgttagggtatcaaaaagttgaacaacaacaacaaaaaaactgcctccactcacaaaagctccacactgtagtgaagaagatgtgggcacacttagaagaatgaaatagtgactaagaaaggtgattgttttttgttttgttttgtttccccaaacaaaaacaaaaagattgagcaagggctattagaggagattcagtttgatctgaatcttggaaaataatcagtttccacaatcaggaaacttcccttccataatcagggaaatcaggcattagcttcttagaggacaagatgaccaactatatagaaatataaaaacatatgtggtgagcttagagaatggtgagtcatcctcggagcaagcaattattgggagttgagaatggataggagtgaatgcaggggagatgacggcggaggtgccagtatgggccagcaagttggaatgccaccataaggaatttggagccacagggaaacatggaaggcttttaaaagtgtaatgcgaggatgcctctgcggtgtgaaggatgaatgggagcagaagtcagtagaaaacacaggcataagttaagaggcttaggcgatggcccaagtgggcagtggtggagatagatcctggtggagaagaataattaggaaaaagagggaggagagagaacacaggagcttcataaaatacctattgagtgagtaaaattaataggatatggaaacagattgactttggaagaaaaggcagaaggaggacaagacggcttcagatgatgcataaatatgagctcctagggagtctgaagttttttcagttacttagttttgttatttttggttacgttttgttttttttcaaagtgataatatcctagctggggcttggtggctcatgcctgtaatcccagcactttgggaggccgaggtggcaaaaatgcttgagcccagaggttggagaccagcctgggcaacatagcgagaccctatctctacaaaaaataaaataattagccaggcgtggtggcacatctgtggttacagctgattgggaggctgaggcaggaggatcatttgagcccaggaggtcaaggctgcagtgagctgtgatcgcaccaccgcactccagcctgtgctacagtgagactctgtctcaaaaataataataatagtagtaattcagaaatgtataagcaatgaagtgagaatcacccaaattgccaccatgcagagataatcattgttaacattttaataattgaaacttcctttctttttctctttcctttcttccttctttttttcatctgtcctcccggcaccatatgtatataattttatatgaaagtggtaaaatagtacttgctactacagtcagcttggttcccagcatagcattagtttcaatgctggtgatgatgcacagctttacctcattgtttttaatagctgtggagcactctacttttatctgtggcatcgtgatttattcaactactccctgtgaatggatgtcaagtgtatctcccggtcttgctgttagagatcacacatttcaagccctcgcatatgactatgaattcatatgaggtagtccattcctaaacattttgccaatagtgactttggcaattttcaaaatcattttaatgtggaaggctcccctccctctcaataaaaaggagggtgaaaatcctcatttaattaatttatgtccaatgggaaaagctttataggtttataacttataagcctgtaaagttctcccatttatactttttcctttgtgaattgcctcattttcccctttgatctttgatccaatggcacatctgataaatctatttgtatattaaagatatatatcctttgttagaaacattgaaaatattttcccagcgtgtttgtgttgtgggtgttatgtacatttgcctttttgacatttatgttttcccatctgccaatcatttcttcatggtttctggtttccaggtcaggcctaagaagaccttctattacctccacaaataacaggcagatgtatgaagcagtgggtctggaacttgctcacttgtgctttgccatttaccctacaaactgtgcaagctttctgctgagtttcccagtggcagggcaggcaaatatctcattaagggctttgaatatcttgaaatggaaacctgacatctctctgaaatcccttctcctgacaaaacacataatgcagacgtaacctgaaatcagaaccaatgcagagagagagagagagagagagagagaaagagagagagagagagagagagaatgaataaggatgaaataacacttatatcagagaaaggggaacacttatacgctgttggtgggagtataaattagttcaatcattgtggaaagcagtatggcaactcctcaaagagctaaaaacagaactaccatttgacccagcaatctcattactgggtatatatccaaaagaatatgaatctttctaccatagaggcatgtgcacacaaatgttcattccagcactgtacacaatagcaaagacatggaatcaacctagatgcccatcagtggtagactggataaagagaatgtagtaaatattcaccatagaatactatgtagccataaaaaagaatgagatcatatcctttgcaggaacatggatagagctagaggccattattcttagcaaactaaggcaggaagagaaaaccaaataccatatgttctcatttataagagggagccaaatgatgagaacacattgatacaaagaaggaaacaacagactctggaacctacttgaaggtaaagtgtaggatgagggagaggagcagaaaaaataactattgggtattaggcttagcacttgggtgatgaaataatctgtacaataaatccctgtgacatgaggttacctatataacgaaactgcacatgtaccgcccaacttaaaagttaaaaaaagaatgatataatatcaatccttgtaagaagtcatttccaactcagaggctgcccttctttctgggatattccttataactttctgtccccagtggtgtttgctaatatatttgtgtttagtctgaacttcatcagttgcttgctctatttgcacaacctttggtgtacatggctgccttattgaaaaatttagttggtctcctgtgagctgagttattgtcttgcctttacaggcaagtagcttcttgaatctggtgttccaggcattcattatacgccaatggactctggcttatagattcagactcattgcaaaaaatggattctaagtaattcaaatggcaaggtttaagagtgaaaattgctacttgtaagtaaaacagttggggttgaattatgtttttagaattagacccaaatgttgttggcagattttcctaaaaaaagaagtcctacttttccatttttgcctttttttttttttttttttttttgagacggagtctcgctctgtcgcccaggctggagtgcagtggcgggatctcggctcactgcaagctccgcctcccgggttcacggcattctcctgcctcagcctcccaagcagctgggactacaggcgcccgccactacgcccggctaattttttgtattattagcagagacggggtttcaccgttttagccgggatggtctcgatctcctgacctcgtgatccgcccgcctcggcctcccaaagtgctgggattacaggcgtgagccaccgcgcctggcccatttttgcctatttttaataacaggagtccccaagccctgggctggatcaatactgatccatgtcctgttaggaaccaggttgcacagcaggagatgagtggcaggtgagcgagcattactgcctgagctccgcctcctatcagatcagtggtggcattagattctcataggagtgtgagccctattgtgtctcatgaggaacctgggttgagtgctccttatgagaatctaatgcctgatgatctgaggtagaacactttcattctgaaactaccccctcactggtctgtggaaaacttgtcttccttgaaaccagtccctggtgccaaaaaaagctggggactgctgccctatagggtctctttttatcctctgatgtagcttattcattttcatagatatgtccatagtattttttagtgtaaatgtcttagatgaagggtagtagcaatcttttcacacttttattttggtgttataacaattgtgacattttgaattcatgtatccctttaatttttttaaattgagatatagcatgcatgcatgaaagtgtacaaatcatatgacttcacctttgtacattttcacaaagtgaacacacccatgtaactaatgtctagattaaaaaacagaacatcttgagcactgtagaagtcttgccttcctagtcattttttctctcaaagataataattattatgatttctcacaccatagattaattttgcctggctttgaactggatgttaatgaaatcatacagcaaacattctttcccttctggattattttacacattatgtttgtgagattcatccatctggttgtgtgtacttctagtcaattcattctcattgttgtattccattcttcaattatataatgtttcttttaaaccattctgtttttcatgtatgtttccatttggggactattatgaatagtgttgctgtgacattctactaactgtgttttgatgaacatttgcctacatttctattgcagatataccaaggagtagaaaggcatatgtagaatgcatatgttcaacctttcaacagtagtggtagacagcatatgccacatattgcatgaaagtggacctcacagctatgcatttttgtatttctggaggaaaatatcagtatttaatatttgaaaggaattcaaaaatgttcgtttactttggcatggtttccattatttgcttttatctgagaactcacaagttattctataggtaatacagtctgaagtaaattgggtgtaaatgcccaatccttgtctcattccaatttacgaagcccagcagaaaacatttgttaccctatatttttacaatacattcattgtgatgaggctccaagctttatgaacaggaaattgggaggagagagctaatatgatccagtgtgattttagtgtaacaactggagcctttgcaaaggaaggagccaacaggtctgacatgaaacattggggccacacatttttgcagtgggattaaggaatgggagaacttgtgcttttcagcattggaaagtcctccctgcaaacattccacatttaaagtaaaatatttcaagccttcagaaagaagctgcaaaggaaaattgaaatagctcaacaacttgactatattttctagattttaagtccatgacaataaatcacacttttgatctcttcttgaacttgcaccattgggtggttggggaagagtgttccagaagagtttgtggcaatgaaataaaattctcctttctatcaatatcattcaatatttttatcctcattatcagtctcatatgatctgatgtattagtttcttcctacatcaaagtctgtgtaggccatctaggacagactaaatggtttgacaggaaaccaggttccttctatcttatccctctgccaccctaaaaacatgacagtttccatctcttggtccaaaatggctcttccagctccctctatccagtctgtgctccaaccatgagaagagaaagaagtaatggagaccatattcctctccttcaaaggcacaggctggatgctttgtatatcactgctgtgctcataccttggcccaaacttagtcacatggctacatcctgtgttgtggggaaatggaaaatttagtgttttgttgtataccacaggccagctaaatgtccgtaattatagaagggaagattggacaataaccagcagtcctatgtgggtttggagccttgataaatacattgcatatttttattcatggactctgatctctccttctctctctctctctcacacactccttgtccttcttacctgctttccttctgcatagaactaatctcttaaagctcctcaactcacttttgatcgttagaggttagaacctctaacgtttgatcgtttcttggttaaaaccaagaaataggaggacagaaagccaagcagtcctttccatatctttcttgagatctgggaaaacaaaaattgttctttttttttaactgagtctatgtgttaatttcactgaggtaatgggatggttctggaattctgagtctacagacccttgataaagttgagctaaaaaaaaaaaatttccaccccaattcctagcaacctatatttaaccagagcacttgtcagtatgtgttagacagggaaataatagttatcagtctacagtgaattataaaggaaaataactagttaaacttgagatagcaggggtgccggacagctgaatagcagaacccctccactcttaaatagggctgggagcctggaatgcattgtcttcagagacaaggagagctgaacgttcattgtgtgtccctggaacgggacacccacattcctttgtaagcttgtctcagctcatctgcagcccttcaacacttctgagccactcatggttgtctaaaagggtgcaattttttggcaggcagattttgatcatcttttttttggagagacagagtcatctagctctggaattagccaacctgagtttgacttccactttcaccactactaactcactgtttggctttaggcagattcttaatatttttctgagcttcaaattcctccagttttatttaattttttttaatgtgaggacattttgctagttaacttaagttacttcacttcattcattcacgcaacagttgttggttacatgaaaactgagaaaggctgagtgtgagtcccctttttcctgaatatgggaaccaggaaatacacatttaattagcacaggtgtgttcaggctaggctgactattaggtttttggcaggatgttttcaagacgagatgtagtacaatgaagcaattaagaggttgggctctgaagttggacaaatctaggatggatccccaacactatgcggccttccttgagtttcagtttcctcatggtgtttttgttaagattgttgactctagaatcaaattccagctttacccctttctaatgttgtgaccttaggcaaattatttaacctttctctaccttagtctttctctttaaatgtagaaaccataatagcacttgccttatgttttttgaaagaattagatgatatgaaaagcatttagtatggcacctagaacatagcaaatgcctagtaaaaggtaccttctgtattgttttggttgttgccagtgtattactctattgtcactctgctaataaagacatacccgagactgggtaatttataaaggaaagacatttaatggactcacagttctacatggctggggaggcctcacaatcatggcagaaggcaaacgagaagcaaaggcatgtcatacatggcagcaggcaagagagtgtgtgcaggggaagtcccatttataaaaccatcagatctcgtgagacttattcactgtcatgagaacagcataggaaagatccacccccatgattcaattacctcccaccaggtccctcacatggaacgcatgggaattatgggagctacaattcaagatgacatttgggttggaacacagccaaaccgtgtcagccagatttgttttatttaagtttattatttgaagttttaacaaatttatttaggtatgattgacatacaataaattatacatatttcatgcatacaacttgatatattttgacatatggatgcaggtgtaaagcagtcaggttaatgaacatatccattactaccccaaatttcctaatgcctctttgtaatccattcctcctacctctccatgacccctctatctctatctttaggcaagcactgatctgctttatgtcactctgctatatagtagtttgcaattcctagaattttacgtaaatggaatcgtcaatgtactcttttttgacttgcttattttcactcatccatgttacatgaatcaatagttatacctttttattgcctactagtatgccagtaggtttggcatatcatttgtctgttcatttgttgccgcacatttggattgtttccggttcagggctattttaaataaaataactatgaccattcctctataagcctttttatgcacaaatgttttctttacttttgtgtaaatacctgagagaggaataactgagtcatatggtagggtatgctggacttttcaagaaatcgttgactgttttccaaagtagttgtaccattttactttcccaccattagtgtatgagagttccagtttcttcaaatcttaaccaacacttggtatggtcaatccttttaatttagccataccaagtgttggtgaagatttgaagtatctaattgtggttttattttgcctttccctaaagactaatgaacttgaacattttttcatgtgcctaattgtcacctgtgttagattctttggtgaaatgtttgttcatatattttgcccattttgtattgtttgtttacttgttttggagttttgagaggtctttatatagtcaatatttgattcctttattacacatgtgatttataaatcttttcacctagtgtggggactgctttacttattttgaagctcttttaataggagcataaacatttaggattgttatgtcctcttggttaaatgattcctttatcaatataaaatgatcctccctatccctgctaatattctttatttggaaatcaactttgatactaatagagccactccagttttcttttgattaattagtgttagtatatttatttttccagctttttactttttttcctatttctgtctttatatttacaatagataacttgtagactgcatatatttgagtcttgcttttttatccagtatgaaaatctttgcattttaattgaggtacttagaccaaatacatttaatgtgattccttgttatggccagatttaaatctgtcatcttgctatttgtttttatttgccccatcttttcgttaattcctctttttactgtcttgatttggattaattgaggatttttaattgattcacctttatcttggcaatttattcaccatagctctttgttttgttattttggtggttgctttaggatttataatatgtatctttaacttattaaactctatcttcaaataatattataccatttcatgtagagcataagaatcttattatatttccatttttttctttctgtcttttgtgcttttgctgtaatatattgtattttaatttttgttattaaccccacaatacatttttattaggtttgttttaaatggctaattagaagtttaaatgatgagataaaatatctttatgtttactcatgtagttaatatttttggtgctctttattcctttttgtggatcaaaatatccgtttggtattacattccttgtgcttaaagactttaacatttttttgtggtgcagatctactagtgaagaattctataagcttttttttagctgaagaagtctttatttcatcttcagtttgaaggtaattttttgtagtaagagtatcctagtttggctgattcttttttcttttggtatattaaaaatgttgctccactgtgttgtaacttttattgtgtctggtgggaaatcttctgttatccttatctttgtttctttataagtttttttctgactccttttaaaatttctctttatcattagttttaagtaatttggttatgatgttccttgccttaatttttcacatgtttcttgagcttggtgtttattgtagttcttggatctgtgggtttataatttctgttgctgccattttatggtaccttcatgagtagcagggtattatttaatacattattctggttatctatttctttttgagtgagcttttgtagtttgtttcttttaagaaactggtttatttcatcaatgtcagatttatgaacatagaattgtaggtaatattccctatttatgtctgagggtttctaatgatgatggtgtcttttcctttctgatacaagtaatttctgtcttccttcctttttttcttggtcagtatgcctagagatttatcaacttaagtgatcttttcaaagaacaaactttttgtttccttgattttagtatttttctaatttcaatttgattgatagacctttcttgtttcctaataaaacatttagtgctattaatttctctctaattgctgttttatctacattctgtatgctttaatatgttgtgttttcattcagttcaaaatattttctaatttcccttgtgacttcctttttagcctgtggattatataaaagtgtgttatttaattttcaaatatttggggattttccttgatatattcttggtatagatgtttagttttattctattatggtcagaaaacatactttttataatctttattcttttaaatttcttgaggtttgctctatgacacagaatttgtctgttttgtcagtgttccatgtgcactagaaaagaatgtgtattctgctgttgttgagtggagtgttctaaaatgtcaattaagtcaaagtggttaataatgcacagatcttctatcccgttgttgattttctttctacttattctgttgcttattgagagagaagtgttaaagtccaaagtaaaataatgtttttttttcaattctgtttctgcttgatgtttcctgaagctctattattaagtacataaatgtgtaatattgttgtaacctcataattatgtaatgattatcttttattactagggactctttttttttaattcctggtaatactgtttgttctgaaattgactttgtctgatattaatgtagccactgcagctttttttccctttagtttttgtatggtatatgtttcccatttttattacatttaatctgtgtatatctttatatttgaagtgggtttctcatagacagcacacagtagggttttgtttttttaatttactctggcgggttctgtctttttttttattacactttaagttatagggtacatgtgcacaacgtgcaggctttttacataggtatgcatgtgccatgctggtgtgctgtacccattaactcgtcatttagaattaggtatatctcctaatgctatccctacccctccccccaccccacaacagtccccagagtgtgatgttccccttcctgtgtccatgtgatctcattgttcatttcccacctatgagtgagaacatgtggtatttggttttttgtccttgcgacagtttgctgagaatgatgatttccagtttcatccatgtccctgcaaaggacatgaactcatcattttttatggctgcatagtattccatggtgtatatgtgccacattttcttaatccagtctatcattgttggacatttgggttggttccaagtctttgctattgtgaatagtgctgcaataaacatacatgtgcacgtgtctttatagtggcatgatttataatcctttgggtatatacccagtaatgggatggctggatcaaatggtatttctatttctagatccctgaggaacaccacactgacttccacaatggttgaactagtttacagtcccaccaacagtgtaaaagtgttcctatttctccacatcctctccagcacctgttgtttcctggctttttaatgattgccattctaactggtgtgagatggtatctcattgtggttttgatttgcatttctctgatggccagtgatggtgagcattttttcatgtgtgttttggctgcataaatctcttcttttgagaaatgtctgttcatatccttcgcccactttttgatggggttgttagtttttttcttgtaaatttgtttgagttcattgtagattctggatatcagccctttgtcagatgagtaggttgggaaaattttctcccattttataggttgcctgttcactctcatcgtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtctaacgtttaagtctttaatccatcttgaattaattttggtataaggtgtaaggaagggatccagtttcagctttctacatatggctagccagttttcccagcaccatttattaaatagagaatcctttccccattgcttgtttttctcaggtttgtcaaagatcatataattgtagataagcggcattatttctgagggttctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctgttttttggttccatgtgaactttaaagtagttttttccaattctgtgaagaaagtcattgttaacttgatggggatggcattgaatctataaattaccttgggcagtatggccattttcacgatattgattctttctacccaggagcatggaatgttcttccatttgtttgtatcctcttttatttcattgagcagtggtttgtagttctccttgaagaggtccttcacatcccttgtaagttggagtcctaggtattttattctctttgaaacaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatctgacttcctcttttcctaattgaataccctttatttccttctcctgcctaatcgccctggccagaacttccaacactatactgaataggagtggtgagagagggcatccctgtcttgtgccagttttcaaagggaatgcttccagtttttgccccttcagtatgatattggctgtgtgtttttcatagatagctcttattattttgagatacatcccaccaatacctaatttattgagagtttttagcatgaagcattgttgaattttgtcaaaggccttttctgcatctattgagataatcatgtggtttttgtctttggttctgtttatatgctggattacatttattgatttgagtatattgaaccagccttgcatcccaggaatgaagcccacttgatcatggtggataagctttttgatgtgttgctggattcagtttgccagtatttcattgaggatttttgcatcaatgttcatcaaggatattggtctaaaattcccttttttggttgtgtctctgcccaggtttggtatcaggatgatgctggcctcataaaatgagttagggaggattccctctttttctgttcgttggaatagtttcagaaggaatggtaccagttcctccttgtacctctggtagaattcggctgtgaatccatctggtcctggactcttttttttgttggtaagctattgattatggtcacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatccccttgatcattttttattgcgtctatttgattcttctctcttttcttctttattagtcttgctagtggtctatcagttttgttgatcctttcaaaaaaccagctcctggttttgaagggttttttgtgtctctatttccttcagttctgctgtgagtttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattcttgtatgttgtgtctttgttctcgttggtttcaaagaacatctttatttctgccttcatttcattatgtacccagtagtcattcaggagcaggtttttgagtttccatgtagttgagtggttttgagtgagtttcttaatcctgagttctagtttgattgcactgtggtctgagagaccatttgttataacttctgttcttttacatttgctgaggagagctttacttccaactgtgtggtcaattttggaataggtgtggtgtggtgctgaaaaaaatgtatattctgttgatttggggtggagagttctgtagatgtctattaggtccacttggtgcagagctgagttcaattcctgggtatccttgttaactttctgtcttgttcatctgtctaacgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatggatttcctgaatacagcagacagatgggtcttgactctttatccagtttgccagtctgtgtcttttaattggagcattttgtccatttacatttaaagttaatattgttatgtgtgaatttgatcctgtcattatgatgttagctggtgattttgctcgttagttgatgcagtttcttcctagcctcgatggtctttacaatttggcatgattttgcagtggttggtaccagttgttcctttccatgtttagtgcttccttcaggagctcttttagggcaggcctggtgatgacaaaatctctcagcatttgcttgtctgtaaaggagtttatttctccttcacttctgaagcttagtttggctggatatgaaattctgggttgaaaattcttttctttaagaatgttgaatattggcccccactctcttctggcttgtagagtttctgccgagagatccgctgttagtctgatgggattccctttgtgggtaacccgacctttctctctggctgcccttaatattttttccttcatttccactttgttgaatctgacaattatgtgtcttggagttgctcttctcgaggagtatctttgtggtgttctctgtatttcctgaatctgaatgttggtctgccttgctagattagggaagttctcctggataatatcctgcagagtgttttccaacttggttccattctccccgtcactttcaggtacaccaatcagacgtagatttggtcttttcacatagtcccatatttcttggaggctttgttcatttctttttattctttttttctctaaacttcccttcttgcttcatttcattcatttcatcttccatcactgataccctttcttccagttgatcgcattggctcctgaggcctttacattcttcatgtagttctcgagccttggctttcagctccatcagctcctttaagcacttctctgtattggttattctagttatacattcgtctaaattgttttcaaagtttttaacttctttgcctttggtttgaatttcctcctgtagctcagagtagtttgatcgtctgaggccttcttctctcaactcgtcaaagttattctccgtccagctttgttccgttgctggtgaggaactgcgttcctttgaaggaggagaggcgctctgctttttagagtttccagtttttctgctctgttttctccccatctttgtggttttatctatttttggtctttgatgatggtgatgtacagataggtttttggtgtggatattctttctgtttgttagttttccttctaacacacaggaccctcagctgcaggtctgttggagtttgctagaggtccactccagaccctgtttgcctgggtatccgcagcagtggctgcagaacagcggattttcgtgaaccgtgaatgctgctgtctgatcgttcctctggaagttttgtctcagaggagtacccggccgtgtgaagtgtcagtctgcccctactgggggatgccttccagttaggctgctcaggggtcaggggtcagggacccacttgaggaggcagtctgcctgttctcagatctccagctgtgtgctgggagaaccactgctttcttcaaagctgtcagacagggacatttaagtctgcagaggttactgctgtctttttgtttgtccgtgccctgcccccagagttggagcctatagaggcaggcaggcctccttgagttgtggtgggctccacccagttcgagcctccaggctgctttgtttacctaagtaagcctgggcaatggcgggcgcccctcccccagcctcgctgctgacgtgcagtttgatctcagactgctgtgccagcaatcagtgaaactccgtggacgtaggaccctctgagccatgtgcgggatgtaatctcctggtgtgccgttttttaagcccgttggaaaagcacagtattcgggtgggagtgacccgattttccaggtgccgtctgtcacccctttctttgactaggaaagtgaactccttggccccttgcacttcccgagtgaggcaatgcctcgccctgcttcgactcacacacggtgcgttgtacccactgtcctgcacccactctctggccctagtgggatgaacgcggtacctcagatggaaatgcagaaatcacccatcttctgtgtcactcatgctgggagctgtagaccggagttgttcctattcggccatcttggctgcccgaccaggttctgtcttttaattgatatgtttagactattataatccttgatatgattttatttaggtttaccattttattatgtgttttcccctgcctcctttaattttgttcctctttctcccctttgagacttattttagattatttggatttcctgcccttccctcctctcccctccccttccctcccttcccttcccttcccctccccttccctcccctcccctccccttccttcccttcccttcccttcccctccccttctctcccctcccctccccttccttcccctcccctcttctttccttcgaagttcagatcttgctctgtcacccagtctgaagtacagtggcaccatcacaactcactgtagtcttacacttctgggcttgaccagttctcccaccttagcctcctaagtagctaggactccagcattgtgccaccctgcctggctaattaaatttttttttttttttgtagagaggggtcttgtcatgttgcctaggctggtcttgaactcctggcttcaaacaaccttcctgtcttggcctcccaaagtactgggattacaagtgtgaaccactgcagctaccttattttaatatttttaatattctattttaatttatctattgacttttgactatatctatttgttttattttagtttttaaagaaatggggtgtcactctgccactcagactggagttcagtggtgcaatcctagctcactgcagcctcaaattcctggggtcaagggatcctactgcctcagcctctcaggtagctgaggctacaggcacatagcatcatacctggttagttttttataattttttagaaatggggtcttgctatgttgcccaagctgatctcagactcctgggttcaagtcatcctcccacctcagacttccaaagttctgggattataggtgtgagtcactgtacccagcctctttgcatttttagtgattattttagagattactatacaggtacctaacctttcatagtctacttagagttaatattttactacttcaagtaaattgagaaacctcacaaccttataattatcctcactttcctatttgtcaaatgtattatatatgtacattgaaaccccctcccaagacaatattatcatttttacatttagcaatcatacgtagtttgaaggccctaaaaggagaaaaatagtccattatatttccaagatatttgcagttgctgttgaatgtccttcgtttctgaatttctgcatttctctttagtctgagcaactttttaacatcatttttttagagtaggtctgccattgataaattctctgaatttgcctttatcatgtttcatcttcagtcctgaagcatatttttgctggctgtagaattctcagttgacagtttctttatgtcaggatttaaaaaaattgttccattgttttctgtcttcagtgatttctgagagaggtacacagtcatttcagtcattgttttcttctgtgtaacgtcatttttctgtaactgctttgaagcctatttttgtttgttatttgtttgtttgaccttttgtttttagcagtttgatttggatgtagctgcaggtgggtttttttgtttgtttgtttgtttctcctgtttgaagttggctctactttttgagttgtatatttatgtctattaccaaatttcagaagtttcagttattattttttcttcaaatattttttcagcactgcactctttttcttcttctgtgattccaatgacacaaatgttcgatattttggggcaggtgtggtgtattatacctgtaatctcagtactttgggaggctgaggcaggaggatcacttgagcccaggagtttgagatgagaccagcctgggcaatatagtgagacaccatctttacaaaaaattttaaaaagcaattaactggatgtggtggtgcacacctgtggtcccagccactttgatagctgaaatgggaggatagcttgagtccaggaggttgaaacttcagtaagacgtaattatgcactgcactctaggtgacagagggagaccccatctcattaaagaaaaaatatattttgatattgttctacaggtttctgaggctctatttatgttttgttaatttttttctccacttttattttttggattggatgatttctgttgatctgtcttcaagtttcatgacttcatgaccgtttccattctgctattgagatatccaacaatttttaaaaatttgtatattttctttttatttctcttctgagatcgatctttccatttatttgaaatgtatcaatctttatcttaggagcatagttataatagttgctttaaagtctttgtctgatattgtcaatatctgagtaatcttggggttggcatctgttgatcatcttttcctttcaaaattggttacactttcctattttttatatgtcaaggattctaaattttttttgagagagggtcttgctctgttgcccaggctggagtacagtgacacaatcatgcctcagtgcagcctcaacttcctgggctcaatcgatcctcccacattagcctcctgagtagctgggactgcaggcatgtcccatcacactcagctaatttttttatagagacaggatctcactatgttgaccaagctggtctggaattcttggctcaagtcatttgcctacgtcagcctcccaaagtgctgggattataggcatgagccacctcaccaggcctgaatattttgaacattgtgtagtttagactcttggtcctgctaaaatcctgtagagaatattgaattttttttttttcttagcagtcaacctggttaggttcctaccacaagtctgtcttacctttggtggtagttgtctcagtgtccattaagttttcaagtctttagatctattgtacacatgcacagcttagggatgagactgatcattttgcaagctcatacatgaacttatgaaattttcatcttcagctcttttccctccaggattcacttcacagtctgcagcccacagggccctcttttgcagtcctctaatagaaggacgggatttttcttgggggtttaactgcctgctgcccctgctgcccctgctgcccctgctgcccctgctgccagctacactccgcctttaggcaaagctggaggagaaaaaaggaagaacaaaatagggattttctcccctactctttggacctcaggggtctctttccccaggtctatggccagaaagacaggtttccccaggaatttttattttgtggttgctcctggcacatcacttttggagccttcaggaatttgcgtttgtattttgtccggaatgtttagctgtaatgagtaagagagctggtctgtggtgggccactccaccatggccagcaatggaagtctcagggcctaaagagttaaatgctgcctgccattgtgcagctttccctgtgttctttaaaagtggagttcagaatttattctttcgtgcctctttgtacttacgtgatttttccagacggtcacagttggtagcacgacagtgactctagctgagtgtttaaaatggctgacaactttccagctggtttccatcggcttggccgcagtggcgatggacgtgctgaacacaggcgatgttgtctggcttctcaacgttgctgctgagtggaacagttttgtgaatatcccaaatgacagtctctcatgaggggctttgtatttatcatgggttgtagtacttttctatgtctggtttactagtcatacagttactggcatttttgaaggcttaagtccaagcgtttgtcagtgtggaggatgaagagatgtagaattcacagggacccaggtaccatgggaaaggtaggatcatggtttcagggaagatttctgctcattatatgggaaatagacatattaaaacaacaaacaacaacttgatttacattgtgcccaagttttccccatgaaaaacagactgattaaatttgtgtagtgattattcaatcaacatctttacccacatgtgcagtggcatttatgaattatcagatatagcatttgtagaagcaaggtaggggttgattatgaccatgtgactatcatttcctctttttcccccttctcttcctttcttcctccctccctccctctcttttcttccctctttctctctttttctctctttatctttttctttctttctgtctctttcttcttactttcatctcctcctccgtccctctttctttttctctttcttctttctttctttctttctcttccttttttctttttctcctctctttctttctttctctctgtttctttctctttctccctctttctttcttttcttttcttcttcctttattttctttccttacaatgagggaatgactaaatatactggaaaaaggccaggaatcacatgcagcaggaataccgaaagaatgctccttactcaagagggagttgttacagataaatccagaacaattagaccgtgttacttccttttgttaaggcagccatctgaggttatagctaatgtaaaggagggcattgtcagtaagaagtaaagtgaggctgctattaaaatgaaacaggctgtgctctgcttggtggcctctcacttcagccggctcttcagtgataaccactgccctccaggagaattgggcaggagagttggaacccctcccagagcacaatgtgcctcgccagtcttccatttgaaagctattttaaatctttttggaattatccaaatagttatgacaaagtaagacaacaaatacacttctaaatagataaataagtgtaaaacagactttctaccgaatgaatatggaggagaaaaaactgaagtggaaatcaggaatttagacttcattagtttggcatggtttaagacactctctgggtctgttttagccttttgtaaaatggggagggtggtatatctgatacagtaaacaatgaatggaaattgttaaacaatgattattgtcaggctttgcattatgtgcattacaagaactagttcacgttttaacctcacaacaacctataatatatacgctgttaacattcctttttgttagatgggcaattcaggcttagggaagttacttcatttgccagtgtcaaataggcttcaacttaaggtattctgagtccagattctggtagactcctggaaattacaactactcagtaatagaggtcagctggagccctaattctgactgttctgtagtggcttcctggagcactgcattcacagtcattttgaggccaagtacactagagctgtcctggattgattgttctttcctgctatggcacaagaggacagaatgaagacaagtgtgctggtgtttgccatccacccaactttgtaatttgccagtattgcttcagttaaagtagcttttattgctgttcacaaccacctttatactcatgagataccaaggactctgtgaagctctgcggtttttgtagcaatatgtcctccctccctcccttcctcccttccttcctctcttcctccttccttccctccctccctccttccctccctctgtctttccttccttcctttctccttccttcttttgttttgttttgtttttaattttttttaacttcaacttccccagaaagaaaaatgttcagaatccaacatgtaaaagaggtgtagagataggaataatgatgttataaataataataattaaaacaaaaacaacaaacacaataatgatactaatactagcaaatatagtagtttttcagttttcataactttatattaactttagtgtaatatcaccacagatgaaatattaatttctcagcagagggtaaaatacttttgagagatggctgaaattatcacaggacttaaaggatgattatacattaataatggttctaatgttagaaaaaattcagaagtaactatgtccattgaaaaaaacagccatgatattatctcaaataaaaattattagtgacttttagatggatatttgtgtactgaagaatagtgatattttaaatagttatgcagacatccagatatacaaacatatgcacacacaaactctttgtggcaagtctggaaaatttggacattgtgttgtacccttggaggttcagatcataatcattagataaagaaatctgttaaactgtatattgtatttttcaattactttgaccatataaccgttttatttgttagtaattaaaaccctaaggagttactgtcacatgttggaaaatgccagcccaagactcaggtataaaatggaggaggagtatttttcagggtaattgactgctcttcctcagcctggatctgaaattgttaacactgagaactaagcaaccctgctcacagtttgaaatgaagacacaaggaagaattccaggttcttgccctgtggtactccctgggtgaacttctgtgtcaattgtaaatctagttttaattgaaagttactaaaatacatcatgataaaaaaaatggtgactctacctgagacctcaatttggtggtaaatcatcataaaatagtgatgattaaggggaaaaatgagttatttggcttatctaaaatagagaggaaacaaaaatgaatgaacatgttctgtaatttgtggagaaaatctaaacacttatctcaacggctaaccacgtttgggcaggagaagctttgctatacccattcaatgttcatttaaatttagaacgggatccacagtgtaagccaatgcttcttaaagtttaatgtgcatctgagtgacatataggcttattaaaaatgcagggcccccaaaaggcactgaaattttgattagcagatgtgggttgaggctcaggaatccatacttttacaacactttgagaaacactgatgtaaaccatgtgataacactagaagtgataaagtgttgtgggaactctcagaatcctcaacataaataatcattccacccaggctgacttttggcaaaatgtcaaaaaatgctttgccctgtatattagttggagtcaactaactgctttaacacatagacccaaaaatgtataaatgctaaaacatacaggagtttttttcttactcatatgggagtttatttttgctcatataaacagtccaaggaaggtccaggttaacaggagtctctgttctgacatgggtgttatgggggcctggatgatggaaggttggccatcttcaactcacagcttccagttccacttgtgtgttgatatccagatggtagaaatggagagagcctggagaatcacgaatagtattagaggcaaaattttggccaccccctcaattctatgttgtaggcccaaatcctggtctctcagactatgactgtgtttagaggttaggtctttaaagagaaaattaagttaaaattagcttgttcaggagggccctaatccaatatgactgacatccttagaagaagaagaaaatgggacatgcatagaggtagcagggttacatgtgcacagagaaaagaccatgtgaggacacagcaagaaggtggccatctgcaagccaaaggagagaggcctcaggagaaactgaatctgccgacaccttgatcttggatgtctagcctccagactgtgaagaaataagtttctgttgttcaagtcccctagtctgtggtatcttgttatggcagcccaagtaaactaatacaattgggaatttgagggctgtactggaagtggggcacgtcattttcactcactcttcattaaacagaagtcagtcatatggctccctatgggagcgatgggatctggaaaatgaaaccaggaagaagaaaaaatgagtttagtaagtagtatgttatagtatctgccataccctgtgtcccctcttttgcatttgggctactcatctatggatttagagaaagcttctcaattccagtaggccaggtcattgacttccttctccgtccctctcaaagcccatgtctaaaccaatcatttgttgtgggggtgaggaggaggaggggcatgcactatgaatgactcaggctgggtaaaatgcccaccctgagacagggaggagggggacccatgcctaagatgtttaccaggacagcagggtatggtaggaaggccatttgccaaagtatgaagggtactgggataacaaagacaagaggtgaacactatgaaggcagaaaatgtactccctctgggaggatattgggattttaaaagaacattgcatgtggtccagcttgaatgatgggaatttaaagccttggagcaagtgaactctctgaggtcacttcaaatcactcagatgggtgagtgcccatggccagctttctcatgaggccagctctctcatgaagccagctcaattacaatggacttaaaatgtaattgagtggacccagttttgctctactaactcagcacaaagaggccaaatgactccttcatgtcttttaaaatagaaatgaaaggcactgcacaattcctgacctcattagtttagcccagatgatattggcaaagccatgtgtgattggcgaatgaagaaaaagaagaaggggtttgccatgacgagtctaggcagcatgatggctattaaaaattcttggggctcggtgcggcggctcacgcctgtaatcacagcactttgggaggccgaggcgggtggatcacgaggtcaggagatcgcgaccatcctggctaacgcggtgaaaccccgtctctaccaaaaatacaaaaaattagccgggcatagtggcgggtgcctgtagtcccagctactcgggaggctgaggtaggagagtggcgggtgcctgtagtcccagctactcggggaggctgaggtaggagaatggcgtgaacccaggaggcggagcttgcagtgagccaagattgcgccactgcactccagcctgggcgacagagcgagactccgtctcaaaaaaaaaaaaaagaaaaaaaagaaaaaaaaattcttgtaagtcagaacagtccagctggtgataagaaccatgatgaggatgaaaaaaccaattaagcatgctcactgagtgggtcaccgagtccctactttcattgctgtacataataaaacaagataatttaattaaggggtgtaacaggtcttagccctaaaggactaacttgaagattatattgtagcaacataaatttcagaaacaggccccatgtgttagttgattttaagtctttttagaataagtgaggatcttaaaaggaaatattttggaagactatcaccatgccaaagtcaaaacttctttgatgactaacgctatgccaagttcacaatctcttgaacaactgcaccatgtcaatttcaaatctcagaacatttaaaaatgtacacttgcaaggctttaataagccaatagaataaatgcccagctacttaatgaaaccagtaaagcaaaggggacttttacagtgaaaatatcctttacaccctctcagaaaaagaaaaaaaaatctgaagttttaaatgaagtcttaggaaacatcaaaggaaagatcattttttaaccaactccatgtgaatgctgggagcatagcatgaacacacctgaatgtacacattctctctctgtcctgacacctgccagctgtgtgaccttaggcaaggtgtgggacttctctgagccccagcctatggtaatctactgattattgagagatattctccatcatcagatagtctccataaagggccttgcacagtgtgggacacacagaagctctcaatatgtatgtattaggtgttattaggttaatggagtcatagctgttcataagttcatcatgaggactgaatggtggtccctgtgagacatttgcatgcatgctacatcagctcttgttagaatgaccatcagctttgtcagaaaacaagttaggtttcttttggtcctggtgttctctcaagttttgcacatcctttagggtgcatcactgtgaatcttctgtttcaatctcaacacaggttaatatgtaatgacgctggtaaagtgtgcttcaataaaaatgataaaatataggtggttggtcagtaagggaatggggcagtggaatttgtcttagtagcactcagccccttcacatctagcgattctcatcaagctcatttccacgtgtttgatgggtttcccagaactcaagtgctcagaattagcccctctacagaccacagtggccggcgagccagagatggggtcattttggttttcagattttaacatggggaataacttttggcagtcctattgcacacctattcttgttaaagcaagcaatcatctggaggaacagtagggtttctcctccacattcatcagtctaatctcactgttcagttgatgtggtttctcctctccccctcataaaaggattcattttcagaagaaaaactcattttgaaggtttcttttttttaccccttcttcacacgctctagcacccttcatacctgtctcttttcctcattctgtttccttccttcttctcttgctctctcccatttttcttcccaacactgaacaagcagccaaggaaaccttcaagttataaaacattagcctgacactggggctaagaaggctgtctccctctccgttacacttatgccagcgcagtagcttggcccagggctcactaaatgttccttgagtgatcagatggttgaacaaatgaatgaagcaattaatgattttgtatagatgcatcctgcagagcaagcctcaactccctgattccatcttcttgtttgaacattttctcacccagagtagtgacctatctggtgccctgcccggcttggagatctggctccactacttactcgctgtgtaaccttgggtatgctacctgatctccctgtgcctcaatttatcttctttaaaatgggtagagcgagtctttaaagcagtctgttaagagcatcggttgaatacacacacgctttcagaataaggtcagacaccataagtgctcagtaagtgttgttattaaaattttgaatattataactaagtttatgagctcacgtgagttgatttctgtgacaacactttaagtgtaaggcttatggcaaagttaataataatttattttcactgagttgctttgctttttttgttctacaaaatgttaattctgtagttctggtccactcccgttctgagctagtttttcttgcattactcaatgtcatcaggccaaagtatttactcccttatgcctcagagagtctgcctgaggtccttgtttctcaatgctgttttgtggctccactctcttttatggatgtgaagaaccagaaggaactcctaaccccaccctccatgtggggctccacttctagaccccacgtggacacctgacacttactcctgaatgctcagcatcccatttcatggagcttattctccagacagcagtctgcaatgggcattctgctagacccctttaggaacaacctcatgggcacaattatccacttgccccctcaaagtgaggtgaaattgctaattacacctgcaagaggctaattgggaacccccctccattgcacgcagccaaaatgcacctgcaagtaattaacttcagatgcccaaattgtacccacaagaaaggagaggaagcccaggctgagaccccagcctctctgaaaaggttcatgtttcccaggtttgagttggaccctttggacatcaaacggggcagagaaggcttctgtgcatggccatggagtctggtgcagcattccaaagcggcacttgtctctgccgtcctaatatcatcattgtctaatagatgctatcccacaagtgggagaacaaaaatgggctccagagcctttcctttcttttctctctgtgtgtggtagagaatttccactcaccacatgtccctctattatatctttatggaatctgccaaaataaatagtgtagttcctttatttttagttggtattgcacaggttcttctcagattaagcagtcaaaggtcaggaaagttgagatgaaccatagttttaaaaccattgtactgcataaagttatttatagaggagttttcatgtatagacttgattaaaagctgaggatatttgctcaacagaaaggcgaaaaaccatcattatctgattttacatggaattcagtggctgctaatcaaaccctggcctgcatctggttaagacatacttggcactggcttgtcacaagtcgaggttttgccatgtcaagggatctttcactcaaagcggtgacccatattggactgaacaaacacacgagtttttaatcgagaacaatagtttaacaaaccacttcccaggaccattgaaagaaaagtatgtgcccatggcatttctggcaccaaaagatgtttatttgaatgcatttactttaaaccatagccgaaaatgcccagcagagaaggaccattaagagctagtgcagaaaaatgaatttctatggagtgacccacactagcttgcaccagtgccagccaatcttgcaaggtactctggtatctgtaaaagcttgttccttcctatgtgcccaagtagacataaagatacttgtggacttgcggaaacaagttatatacattaactctgaaatgctttccattagaaaatattaaacgtattccttctctgaatccattagaagtttctttgctgaattgttgccagtgaatctatgtagtgagtttggaggcactttaaaaataagaagcatttctaacaattggtgaatgctaggcattgtgctaagtgcttcagctgccttgtcacattgcacacacgtagcacccctctgtggttggtggtgtcaatgcctccatcttgcagaagtggagaacaaagtcaagatagttaggtcacttgctaagtatcccagcttgcaagtagccagtgagagttcacacctagattcatctgagcagaaggtcagcttctgtgtttctgtttttcttttgaaagaagaaacattcttatactgttgtactgtgtgtttcatagaaatcttatcagtgtaatagcatttgataattgctgaatatttgatctggagtgagatatacattgatatcattcatcgaggtataaaagttagtagtactgtactgttttttaattctgacttttaggatttattgactatttcagactcctactctattctgatgaaatgagaggcacttcactatgcttttacccagggcagggactaggctgatttggctgtgaggccccagctctgagtgtggagcttggcacacagaatccgtgttgcataaatgtcaccataatgtattgaaacattcagggtatggtctccttccaggacagctctggaaggtcttggctgttttgccaaaagaaaggaggaatttcacttgacagtcccatcgttcagaccttaaatcttacttatgatcccccagaagtgaggtgcctcgtgaaagaggtgctgacaagcagtcaaatggctggctcgaaaggtcaataaggagaggccaagtttgagacttcatccagtcagagaactggaaggctgttcctttaactcacctggagctgctctgtcctcatcagctggaggtttgccactacagaaaataataagatgataatggtgataatgagactaacatttactgaaggctgtttgtgttccagatattgttcagagctctttacgtgcgttatttcatttgatcctcaccatgaacggatactataaaatggtctacctgacagatgaagaaactgagactcagataacttaactgctttgccttgcaagtgacttgtgaataaagcaggtgaattcagaagttcttttggcccctgagcccaaggagataacccctacacattagtgcctcaaccgaggtttgggagtagttgactttctaataaatatatgagtcaattcagggttattcttatgacaatataaatatcgcttatttgcaacctgaaatgctttctagaatgaaagaggagaggttagacgtgatgagctgaaggccgcccatcccttgggtgaactctcaggagtgtccaattggggatgctgtggcacaagtcaaggctgagaggcagcagagggctgcccacctcactgctggaaaggctcagccatttgtttcctgaacctgtgcacgttagatgtgaaacactaaaagcttggaaatgattgcaacagggaccagagtagcaagtcagagctgggttcagatctcagttgttttgaccttgggaaagtgacctgatcaagagcctcacttgggagcaaaatggggataagaataatagtagaaggtggttgtgagttattgcgtgaatggtgcttaaaccagggtctagcaagtagtgaataacccacattattggagacgggtagaaaccccctcctgtcctacaagccttacctttgaaagtggttatttgaagcatcgtgtgctcagtggagcctgagactagcctctgatgtgaatattctgaggaatcttgacacatttgacagtcaggtagctcactcgtcactttctctgcactgctgcacatgccagacagcagaaaatcttttcaagtctctttcaggatttatgtaaggaatttctacctggccaggtctgattgtccatagcaacctacaggagtctcctttaggcctgctttgcctgcttggggtgtttttcgtttttttttgtttttgtttttgttttccccagataaaatagttctgtagaataacccaatttatccctgctgtaaaaaactcctgttttgcaatcacagcctttcctctgaggaaagatgggatttgaattgtcttaaaacaatgggaattatgtgcggaaatgagattgcatctggcataagtgcagttatgcttgtgctaagaaatgagttccttcaaggagtctgctacatactcagaatgtccccaagcatcaggttttgttcttgttctttggatttattaccatcattactagtaaatgggaataatgctttgtatctatgtggctttcattcaagatgcccaaagtggttaaagatgtgcacattggtatggagtggggccacatgggtcacagttttgataaggctcacactcatattcactaagtgatgtcactagtaaatgctaactttcagcagctttcaggacagacaagccttgccagcagatgcagcagcaagtagggatggaggcttgggagtagggagatgtagtagggagactaggaaagcctctcccatccgatacacgcttaaaattcccccatttgggattcactgttgagaaggttaaccattgcacattttctctaagtcatattaatactttctgaggaattatgttatcagattgctttcctctgaaagtctgaaagactgcaagggagaagaaaatataaaaaggctagagtgctgcagagttaaagtccctgggagcagtcctccaccaatgccaggtgagaactggtggagcagaatcccagctgcctaccctctaagaagatacctgaggcagtctggtaggttttccagaggctcccagtgggactgagctccgtttcttagagtggtaacctgcttactcacgaaggcattttgcattggcttcctttccttttctggctcacttctttacccccttaccagttttgacaaggctgtcaactttccaattgaagtcttacagtcaaatcctgggttagagtccgctacatctggggaatcccccgcgttagttttctattgccgccataacgaattacacagaggtggcagcttaaaatatcacatgtttattatctcagtttctgtaggttagaattctagctagattctctgctcagggtctcacaggttgaaattcggttaagcagctgaggctgcagtccttatccaggactcaggctccccttccaagctcctggttgttggcagaattgattgccttcttgtgttttccacgtggccgctccattttcaactcagcaatggcagactgcattcttatgcttcacatcgctctcacttccttttctgcttttaagaactcagatgattatgttagtcccgccagaataatccaggataatttgcctgttttaaaggcaaagctcgtcagtgaccttaattatgtttgcaaagtcccttttgccaggtaacataatatattaatgggtgtaacagtagggaacaaaatgacaggggccaagattctgcctatgacaccccactaagagtagatgtctcagtgcatttctaaatgggcatctttggtatatttgaaccctaattgaagttattgaagtaattgttcaataagcattactggtggctgctctatgttaggccccattccagtatttaaagagtttgccttttggagctgagagtctgttggtggagacagactaaacaggggattacaacaagtggactgccccagtaagatgggatgggcagctgctacaataggggtcagagtgctaaggaatcaagggaggattctggatggggtatcttgtctagaccatagacttaaaggatgagaaagatttaaccagacagaggggtaaagagcagacttcttgccaaacaccatgcctattttagatgactttgtcattgcatggtatccattgagttccagcatgtgccacacgattgtgagtttgacaaggagtagagggtcaggaaaaatgctttcatgtggaacatggagaagagtgactagagccatatattaatccaggtttcatgcaggcttgtaaataaatagcccacatttaccaccccacatatatcttacaacttgtcatctgtcatgtaactacttctatagaaagattgaccacctcagccaacatttctgtttccctagttatttcatgcctgagctatggttttcaaaggctttctttacataagccctatttgaacagaaagggaagagtagagaatgtgattcatacttcaaaatgtaaaaataaagttaaaatgcagtacagcagagcaaaaactcttccgagttggcagcaggaaatcttggtttgatcctagatcatatgtggattctccagcaatttataaacttgactcgtcttggttttcttacctgcaaaatgagtatattaccactggctttgtgtatcgtataggattgtcatgaaaatcaaaaggagaaaatgtacatgaaataaccctgaaggttggattatgcatgtctaggaaccaaaatcttctaatttaaatcttcctgaattttgggacccttgaataatcaggttcctggaaagagtttttgattggaatgccagagatacacttagatttttgtttttcattctgtttcatcttcaatttgctggtactaatgcatttgcaaaaatgtttataaatgctttcatcttcctctccaaacttcatatcttacttcatccctggaatcttttccttttggccatgtagatcctgttcccgcctttcacatgctttgaagtgggttttgtagcattcccagtagccaagagggttacatgagaagaagttgaaaagtgtgtgctgcctaaggctaggagagtggttgactaaatgagccaatgtggctttaatggagggacttgcatttaataggagaaataattttgaaggaatgataaaaatttggcattcatattaaggctggctctttgaaggtgttgtggcaagccttttattttctcttgtgtaactatttacacatgctgaacatttttgtgttacataatttttatttcttcatttgttagggaaaaaatagccagtactgagaagaaggctagcatagaaagctggctacctggtcagacagttcccagtcaccttgtacctttccagctcagtgcagggcagattttcaaaggaccttcctgagcacagattctgtaaggactgtgaagatcactgagaagcagtgtggagtaagggaacgagcacagaaccaaggaatgagctgacctgagctatgttcttgattctgcaatcatgtaggccagggctgtccagtagaactttctgtggtgatgagttctccatctgcactcaccaggagggtaaccacttgctccacgtggcctctgagtgcttgcaatatggctggtgcaactgaattttaaattttattcaattttaattaattcaaatttaaatagcccagtgtggctaggaggaacctagctatactgtattggacgcataggtaaccgaactagtatagcctgagaaggtttgtatagcagtggtttagaagactgtggctctggagtcaagctgccttggtacaactcctaacatttgctttccataggacattagcaaggtacttggtttttctgtgcttcggtttcttaataggcaaaatagggataatgacagtattttctcattggacttttatgagaattgaaataagaaagtgtacagtgcttaacacagtgcctggcactcattcgtctttcaaatggaccttaggttatggagttaatttcaccatgatacttgattcatgccatactgtcatcattggtccaggcagcatgcaagacacgtgcacatgcacacacatgcatgcacacacgtacacacaaacacaaactgaccatcacaccaagagtcagcagattaattataacattatgtctgtgtggggtttccccctctcctattgtgtgccttgccctgagatacacccatgaccctgggttttgtgtttattattaccaagcttttaataaaatagtcaaactctctgtgcttggaatgctcccttcccccgcttttaagtagatcctccctcctgttctctttgattgccctctcaagctcattcatcatacctcctcccacttgtagttgggtgccctgtggattgcctgtttcatcagattatagcagtaattgtgactctcttattctctattgtatctttggaatctggaatccaatgtctggaacatcatggatacacaacaagtatttgcgtgatggattagtttatatttataattgattatgtattcttttgagtatcacattaatggattatttgaagttatttttccaacctcagaatacttgctctttgataacaaacatgctgtgggggtcccttcttctattatacttttatttactgcttcagcaagtggttgtcgaggtcccctctatgggagaaggtaccttgctagctgctgaaggtcttgaagtaaacaagaatggcatggcccctgctttagcacagcttccgatttcagataaagaaataggcaattattatcctcagcaaactaactcagaaacagaaaaccaaacaccacatgttctcacttataagtgggtgctgaacaatgagaacacatggacacagggaagggagcaacatacactggggcctgtggggtgggcaggggaaggagagcatcaggatgagcagctgatgcatgtggagctgaatacctaggtgatgggctgatagttgcagcaaaccaccatggcctatgtaacgtttacctatgtaacaaagcttcacatcctgtgtatgtatcctggaacttaaaataaaataacattaaatttaaaaaagacaaataggcaattgtgaggaaggaagaaatgtattatgcctagggtgagaatagaatgctacagaattttgagaatgggatacgtaacacaggccttgggggtgcatagtcagagaaaggttgctggaggaagcaaggtgatatctaagctgatttctggaagataaagagcaggtaggtaggcaaaggagtaggaacaagaccagtatccctggcagtgggaaccacataggcaaaggctaggtggcaagaaattgagctcagttttggcagaactccatctgtgtaaggctcaggtaatgtagactaattttataagcaaagaacattggacaaagagctgaaaacatggactgtgtgccatttgcctcttttaacttactctgaattactttgcctctgtgatctccagttttcatcatgtatgaaatggaaaaaaataacgcctgcccttgttttctcagaaggtactgtgaagaccacttgagagagagagtacctaaaagctctttgataggaaagatgatgttctttaatgtcaaggttgcgtttgggattaattaagaaaaggcatgcttgatatggcacatttactcttaaaagttcaagtaatactgacttgatctagaatctgtgatgttaatatggtggcccctagccatgtattgctatttaaattaaaattaaagcaaattaaaagttaatcctaatggcattttaaatgcatgttagccacatgtggatagtggctcctgtatcagatagtgcagatatagaacctttccgtatcaccaagttctttctgacagctctgaacagcactcctcctaacatgggaattgtaggtttctgaaacgttaaaatatttatattctttggtgtgactattcttttatgaatttagcctgtggaaactactagacagatacataaagatctaggtacatggatatccacatctattaaagaatcatttatgatactagagggaaggagagacatctcttatttgttcaacaacaatatacccattaaggtatcatatagatatgcatttattttcattaagagatattctaggccaagtgtggtggctcacgcctgtaatctcaccacttagggaggccaaggcaggtggatcacctaaggtcaggagtttgagaccagcctggccaacatggtgaaaccctgtctctactgaaagttcaaaactttcagtgtggtggaacatgcctgtgatcccagctacttgggaggctgaagcaggaaaatcgcttgaacctgggaggcggaggttgcagtgagctgagatcatgccattgcatttcggctgggcaacaagaccaaaactccgtctcaaacaaaaaaaaaaagagggagagagagaccttctacatatatcactgagtgaaaaaaactcaggttactatgtagagtgtgcattcattttaggatgtgtatgtctgtgtgttatatacttggaggagagaagaggggaataagacatgagagaaaaagatagaaatatttggagggatatttaccagtgtctgaaaattatttattttgggttgatgacattatagtttgttgtttttatttttccttatctttatattttggattttcttctatgatatgatttctgtgtgtaaccaaaaaagaaaaaaaaggagcagggatatttgcacatgtcagaatatgaaaatgttttcatgaatggaggactaagatggatttttaaaatgtacagtagttgcctgatgatttgtagacatgccagtgagttaaacatatcttgtgaagaaaaggacttatctccttaaaatcttgtcatcgtggattatttaatgtgaagtacatctttgcttttcatgtgtaagccttccctgcccctttgacactagactcaagaactaacaaaactgttttcctctacctgagatgctctttattgtaacatatttggtgtatctgaaaatgtgttgaaaacacttgatacatgcattttccctgcagtttgggggatcaaaaatgtggccagcagttgttccagctaatttcttaccacaaacctctgtgatttgaggcacggatgccaaccagcttgtagggaagcccagtggggactttgatactttggttgtgttgatagacaaatggccctgcaaaagtgctggggaatatccttttatgttctttgtccactttttaatggggttattattttattttatttcttattgttttacggaggtaatcaagttaaaatttttatgctattgagttgtttgagttccttatatgctctggatatcagtcccttgtcagatgaatagtttgcaaatactactgagatagtattattattgagataatcattcaacaggttgtctcttcgctctgttgattgtttcctttgctatgcataagctttttagtttaatgtagtcccatttgtctacttttgtttttgttgcctgtgtttttcagatactagccatataatccttgcctagactgatgtcctcaaatgataaattcccaggtgatagataccctaaatgctgtgactggatcgttacacattctatgcatgccacaaaacaccacatgtattccaaaacactgtacatatattatatatcaattttaaaaggtacagggatatttgaaacagaaaagtgaattttgtttatgatgcatctttacatctgactctaaatgtaactagtacttcctttcttttccatcttatttctgaaagccatagaattctgtaggatttttttaaaaagactgcactgggggacatagctgctatttgaccagaccaggtataaatatcttacttgttcataccatttttcttagtagacaactaagtgaagttaataaataaatcaatattctggaggttttattaactccaagttttataagagtttgtgatttggtcacaaaaattgattaaaaagttgagatccacatttacctctggatcttttcaatatagaaaacaaaaggggaaaaggactagtagagtcatattctctcacaattatatatatatatatatatgtttagttatacgttatatatatatatatatatatatatatatatatatatatataaaattatggtataataatatattattttgttttttgaccttgaacatttaccctctctgagtcaaaattttttcatctgtgaaatgggagaatcaaactaaactggatgctttttaagttccctctaatggaaacatcttggcactgccaaccctccctcctctcccagtgcctctgactggtttagctctcttttgtcatagtctagagatttagaattggcaatgattactttctgttgaaggtggggttacctaaaatagttacagatgtaaatggtttgtgactgtaaaaagaattgtgatcactttgtttcaaactcttttggaaaaagatctgcctgggatacttttgcattcctactttcccaacaaaaacagccataggcaaaccagaaataattaacgccgtcattgagtttggtccagaggcccacaagaaattctactttcatcttattttaggtcactaggccccattgagccagcatgacctgccggcaagcacccagagtttgtctgctctttcatctcatttggtgcactcaccatccacttacttagaggggagtttccaggaggacaccagtaggtgtcaggaagccagacttagatgatttattaggttttctataaaccttgaattttgaaatgatgacgatgtctccaatttacttcactcagctggatggggaatgagtgctgagaatttaaccctcaacccttgatgctaaagcatgagctccctccagcctgaaggcagccttacttccaaaagcctcatgctcagaggtcattttagcggaagactctattatatgtacataattattgggttccaaggacagtctaaataagcccaaagaagcctgaaaagcccatgtgttagttaaggcaaggctaagttataaggcttaaagcatatatttacttctttctctcctaacaattccaaaggaaggagtctaggttgataaggaagttctagaccacgttatccatcataaatccaggttccttccatcttattgctcctccatctcgagcagatggattagaaaactgcggctggccaaatccagtcctttaattttatttttacaaataaagttttattggaactcagccacacccacttgtatactgtagatacttttgtgctacagtagcagagctgagtaattgcaacagtgttcatatgacccacaaagctgaaaatatttactatataaccccttacagaagaactctgcttacccctgccctagcatggttgaagttgggtctgggccacttccctattttgcattcaggaaggaacaaaaagaagtcattgggaaatcaatgacttaaaatcccaggcccagaaatcaacacatcacttctcaattatattggcacgaacatagtctcacagccatatcaactgtaatgaagtttagaaaatgtctaaacaaggagccaagtacctaggaagaagagaaacttttactctagtgcctggtgcaatgtatacatctcatgatgagtatcgtttgttatctcatttaatccactcttctttatctgagtcatccttcaccgtccttcacatgttgaattaaatgctacttcttccaggaagtctttgatctctcttgtgtagggtagatgatccttcttggagcttctttagccatcatgtatctcttcagtagcacctctacctctttagtatcattgattgcttttatgcccaaattccacgtttagctccacacttaggagaccccttaggcatacctgctgaatgaaggagtgatcattgtggagtagttaccactagcatttgccatttaacagataaacacactgaagctgagtgaggataagtcatttgcccaacgtcagttggctacttaggggtagagctgggaccccaactcaggtgtgttggccttcaaagcttatgattttcgagtcaagctttctcagccttgccactattggcattttgggctggacaattctttgttgtagggtctgtcctttgtcttgtaggatgcttagtagcatccctggcctctgcccattggatgccagtagcacccctccctagttgtgaaaaatgtctccagacattgccaaatgtcacctgtgtagcaaaatcacccctgggtgagaatcccggggctcaattctattgcttctgagttttgcttagacctctggaatctatgattcctctgcttcagcttggtggtgaccttgtgattcttccttcctttggacagtgactctcttcctagcccagatcacaagctccctcctctctcatttcttcttcttctttcttcttcttccttcttttttcttctttgctttttttttttttgagaaggagttttgctcccagactggagtgcagtggcatgatctcagctcactgcaacctctgcctcctgggttcaagcaattcttctgcttcagcctcctgagtagctgggattacaggcacatgccaccatgcccagctaatttttgtgtttttagtagagacagggtttcaccatgttggtcaggctggtgtcgaactcctgacctcaattgatctgcgcaccttggcatcccaaagtgctgggattattgaaccactatacccagcccctcatatcttctttaagcttttagataacaggctttccttcctcagcactctattgtatgctctatcatttttgtaatgcttcatatgaactttagtgtctcattgcctttctcctcatagtagacaatatttcagaacattttccccagttcccacctgtgggtgacaaaaagtggccgtgagtaggcccttggtcagtttctgttgagtttaattacaggcatctgaaccagacaggggccaaagactaggaggaaagtatcaaggaagaattgtgagctgggtttctgggtgtgtaatccgatcaggaccatttattttagggttttccaaatctagaatctgtctgctatctctgggctaaacttctatctttgttgttgttgtgaataagcaataatttcagagcacatctggtagcacccctccctacctgtgacaaatgtcacaattttttcctgtgaaatgcaatgccaagtgatatccaaatgtggctgtactgtcctcagtcttctgcttgctggtgggactcgtcaatcattcgagcaaccccaggttcagagctgggagtgttcacatggtgattggatacagatgacacagggctcagttccaagtgtgtgacctcagggaaggtactgaatctctctgagcctccatttagttactcaactaatatttattgaacatctgctctatgtcaggcactattagagatagagcagtaaatgaaacagaccaaaatctgaatcacttaaggaagagtctaatgggatggggagggcacagatgataagtaaattaaataaggaaaacatatagtaggtgacaaggtaataaaaattaaacagaaggaattaaaaacatacacttggtgcctgttgtgagaattaaatgatctcatgtatgtcgtgtctagaggagcattggcagtaagtactcaataaaggttagtagggtccctgtcttccttcctccattgcttcacctataaagtgagaataaaaatatagctcctgtttgaaggtggagggctaaatttaagtaattctgacactaattcatattgtgtggcactgtggcttttaatgtttacaaagccctctcatctgctttatctcctatgagttgccacacttcaagtggaagaccagtgattcagaaagacttcctgaagcaagcagaagaacagttgctttcaggtacctggtccaagcaggaagtggattccctgccctcaataaaaccaactcggactgaagcagtgaaaagaatgatggtggctatttcattttggggtatggctgttggtttttaagatccattcctgctatggaaggtccctggattctgttagtcaccggagggcggagttacagacaggcttagcacactggctttgaagtcagccatatctcctgattagagtcctggctctgtcagttcttcttagggtcacaaggcaaggaactcacttcgctgaacctcagttctctcacagcagtgctgagaggattaaaggaaataatgcaaataaaacagggatacctagttgtttttcacagcaaacaaccagtagactcctaatcatcctgtctctggggttaggctaacactcattggccaaaatgttctttctaaggcaaaccgacgcatctcaccccattctcttaacagtagagtttactctcctaagcagaccaccaggaggacccaaaggaatgtgtttaatgggtacatgggagctttactctgtgagtaaatgcaggcctgtagccaagctgtaaagttaccctttgagggtaacttggatacaaaatgaaccagataattgtggccactttactagaccaagaggatgtgagagggattcgattattattgttggtgaaatttatttataattgttttcaatctcttaatccctttgagaatgctacagactttctaatatttgaaaatatactacacataaaaaaattttgagaaccactgcaagatacgagaattaaatacagagaaaatagcttgaatcttgtataacttccagtcaatagacagtgactgccggagcacatgttgaaaattataccaagggtaatctgagctctgaggaagttctaggataaattagtgatgtctgtcactatggcaggcatggaaagtggggactgaagtgtcaggttttgctctccctagatttacctgttgttttgaaagttgctaaaaagcaagagactaaatcatgacttgtttctcctgcaatcagtcccatgatggagatagcataacatctgttctcaaaatgaaccaatattccatgactgtgtttacagtttgacacaccactacagttcacagttgttaactttatacataaatatttataaattgagctctgtgcaatttcattctgaattaagaaatattggcagttaaactgatataaatcaacaggggaccagatacaaaatattctttgatctttgcttgaaaaaaaaatgatgcctttacaaaaaaaaaaaattaccagaaactcatagtaaatattcatcagttgaaatgcccttgatttgagcatttttattggaaattggagttcctgtgtttatttttatgttttagaagtctagcataaagttttcttggtattcttcattaatgttcttcccagtaaacccttgtaatatggtacataaattttcatcgttatgtttaagtgtgaggtagggaggccatgggagaaaaatatcacttatttaattttttgaatatcatataataagttttaaaattttaattatgtaattttactaaaattgcaattgaaaaagcaataaattcagtttagaatagtaggaagttaattatcaacactcaaggcttagagagaagaatatactggaaattgcaggctattgtgcacttggttactggtcttcctttgaagccaagcatgaccttatcagatttgtttagtatcaccaccatactcatatttttccccagcttcagaacaatggagttcagaggtcaagaatacctacattccacatgagcgaacttttcattctttgaaatcgtaatgatatacggtcaatagctaactacaccgtatattcaggaagagaaaccagaacactgaagctggcatggactcttgcaggctgtgatgctggagatgtttgtgaaaacagtcagtgtctttgtaagaccttgtaagtgacagtggggtagtgtcatcttcatagaaggatatctaactttctgttaatccttcagaaaaaaaaaattccccctaaacttgctgatttccttaacaactaacttgggttattccaagtggagtatttgaaaccttctgaagattttgtctgtgtgtttatatactgagtatttcaatataggacaggagtttaaaattctcaataaacttttgtaggtaaccatgaaaaccaaatatttcttccttacttgaaatgagttgtctaccatttaaaaagcactgagatatgatgcttgttctattttatgtatcaattttatcaaaatcaaaatatttgtcaaggtatattttcttaataggcttctaataggtttgtgcttataaaaaatgacatagcattcccacattttaatttccctatctgggtgttctccctatctgaacttcatacctccccgtcccctatactcaagataactattctaaataatatcctcatttatttatgacctattcaatacataatgcgtgagcaagcacagtaccctggcataaagtagacaaaaagcatttgttgggaaaaggaataattaaatgtgatacaggcagttaataacgttcaggatattaaatttgtatctataaatttgtaattgagtacatttacctttttatgaattgtagatatacactgtgatattcagtacaaaatccatatagattggtcagcttaagctctaaatacattggtcatgtgttcattttattctgaggttttctttttccctgtattctatattatctagggtggtagttctcagagtgtggtccctgaaacagcagcatcagtagcacccaggaaattgttaggaatgtaaatttttgggccttgccccagacccactggatcggaagttctgggagcagggctcccagtctgtgttgtaacaaaccctccaggcagggcaggcttcatgggtgggctacttgtgtggtcacacagggccctgcacttagaagagccttgtacttggtttaatggttctgctatcaccgtcttggaattcttaataatttcttaacaagggtcccacattttcattttgccctgggccctgccaaattatagccagtcctacttccaggtgatgctcctgtgctcacttcgagaacctctttcttccagaaatattaggattccctctgggtatctggtcagttggtcatttgattataaattcatacccattcaaatgattcaaattgttttaaggaaattggtcctgcaagaaggtaacactaagctggattaatatttctcttaactcagtaacctggtttttagacaaacctttggctctctcttggttttccatagaaattgttcaagagttacaaccagaagaagcatgcacctgacttttcacatccctcttggacctctttctccctggttaccagaaaatattcttataaacagtttttctgagcccttcaggtgcttccaaacagttaaccggttttgagtccacagggaatttcctgggactttacccaggtccgggaattacccaggtctctcagtttatgggcgtcttaagaaaatctctttgtatgggtgttggttcatagacattgtattaagtaatatgtaatcacagtgaatgggtcagtcaggtcccaatagaaacagatatttcaacttgagataattcaagaagcaattttgtacaaagggattaattccaaaggtgtgggcacaatataggggaatgttatgggttgttcaagaacctagtgctacagcagcagaaatgtcactgcttctaggcccaaaaggacaaaagaaggagaggttttcagacccttgaagaagagagagtcccctagagctgcattaggaaggatagtaaccctcttttgagggacacagccagtctgaggtgaacttactgggagggaaccagggaaataaatgtgctgaccccactttccttcctacatctatctcctgctattagctcaactctgctggaagcctgagggtgcagagctctctgctgccatttgtatatgtcaccctgtggggaagaaagcaaggagagaaaagtggagatggatctagaagggcaaatggacaatatctagtgccgttcactcatttgcctcttggcctctactcttgtttttcatcaagatgaaaagttggtgcttccaacacgagggaggtgtggagtcaccttaggtcttgtgtcattgtgagataatgtcagtttggccatacatctaaaacacgagctatcatgagcattgtctttttttatatggtagaagttgggcagaaggggagaaaaaagtcacttagtggtgacttaaaacataacttccggctaggcgcggtggctcacacctgtaatcccagcactttggtaggccgaggcaggtggatcatgaggtcaggagttcgagaccagcctgaccaacaaggtgaaaccccatttctactaaaaatacaaaaattagccgggcgtggtagcacgtgcctgtaatcccagctactcggtaggaggctgaggcaggagaattgcttgaacccaggaggcggaggttgcagtgagccgacatcacgccattgcactccagcctgggcaacagagcaagactccacgaaacaaagaaagaaagagagaaagagaaaaaagagtaagaaagagaaagaaagaaagctgctatagcccctgtctctataactgactacaagctctcactagtaatcacatttccatcttccatcttgtttcaataatggaagtcatctcggtccttgatggctttaacttgattggattaccactgttttcactgaccaggacttttgtttaagggcaccccagtgaatccctgggttatgcatattgccttccttatccctattatatagcagtaatggtgacccctactctgactgttgggtcaatggaacgaagagcccaaaatggccaaaggacagtctcggtttctaattcatcacatcatgataatgttctctggtggaagcaaacattattccaacaagatattaggtgttttcgtgagaggggccactcccacatcctcctcagtttttccagtcatgcatccttactatgggagagatggcaccatacagtggcctctgatttaaggcacatcctccattcctataggaaagtatcctaacctctttgtgtgttgtcactcagctgttactaaaccagaacttctgtggagtggatcctttgatgcactgcatgtggtaaaatgtgtcccatgattggaggtgatgttgtgtaggatgccgtgtgatagataaggcatatatatatatatatatatatatgcatatatatataaggcatatatatatgcatatatataaggcatatatatatatgcatatatatatataaggcatatatatatatataagaattgtggtcctggaagaataccgaaggaaaagaaggaaaatctacacacacaatgtttctatcctatgtaaatcaaggtactgccctcttcaaagtcagagaagtcaagtgtcatcaatgtgtcactaggtagccagttagtccacacaggaactcagcattggcctttgcagtagcactttatacattgagccatggtggttgctggatcagctttggtgagtaaaaagctgtgtgactgagctgtacatggcccctactagccctgctactgtgaccgatgaatcccccttccatattatatagagatgagaacacacattaactctgtgtaccaccctcttacgtacatgcgcttcttgtctagtactttattatttatttttttagcaataaattggacattatttttaaaaatgtatagttaattctaaagcatttataaaattattttttaaaaataatgttcttggtttaccataccttctttcttcttggcttataattctttatgcgtttacaaattcttttagtgtaggtctattggtgataaaccatttcaattttcgtttctctgaaaatgtccttcttttaccctcatccttgattcacccaatttggggctgatagttattttctctcagtaacatgttattccactaatgtctggcttccactgttgctgtggaaaacttggctgttgggctaattttaagtggctatctttcctctgtgattctttctttctttttttttttttttgaaacgaagtcttgctctgtcacccatactatagtgcagtggcatggtcttggctcactgcaacctccgcctcccaagttcaagtgattatcctgcctcagctgcccgagtagctgggactacaggcacgtgccaccacgcctggctaattttttgtatttttagtagagacggggtttcaccatgttagccaggatggtctcgatctcctgacctcgtgatctgcccgcctcggcctccgaaagtgctgggtgctgggattacaggcatgagccactgcacccagcccctctgtgattatttctaagatcttttttctttaatgctctgtggtcttactgcaatgtattggtattaattttattttatcctgcttcacacatgtataaatttatatctttcaccagttctgtttaattattagccattatctttgcaaatatctattaccttctttctgtgtcttcagtctctctttatgggctctaattatgaatgtgctagactttccttttctgtcctccatattgcttgatgtcctattcacattttccctcccctgatctctgtgagctgcattctggctagtttctctagttttatcttctagttcactcattctctcttcacctgtgtctactatgtggctaaacccatttattattttaggttaacaattatattttttcattccccaaagtttaatttggattcttcaaatctttctagtaacttttgatagtctgttgttgcgtgctcatttttcatttaattattttatttctaatcctttttgtagaaagagcacctaaaatctactctcttagcaaaatttcaatatgcaatacacacttattatgtatatgtatgtaatatatatatgcataatatgcatgtttgaacatagccattttatattctgtagttaattaataattctaatatccaaagccattggggatgtatatctaaatttgcacttattctcgtctgttccactatctttccctcactggtgactggtttccttatatgcttggtgatctgggggaatttatatttgacaaatcttagtgggaaccgcaagtgactgaaatggagatatttttctgcagagaaaatttacttttgcttcttctgggagcagggagctgctatcaatctaggatcacctagctcctttaagaatcctggtttatcagggctttcatgttaagccctttcaacttgccactggctgagtctctcggttgtacaaatgaccatggtgtttgtgctcagagcaacctctgctatttatgtgggctttcagcataccattcttgtttcagctcagttttggaattttgtttatttgtttgttttagttcatttgagggttttcctatttcctatgagcccagcaatgcaataaaaaatgttttgagagggcctttcctagcatctagtcagacacaatgctggaagtgtcttatttcatatgcttaatgtgtacacactatgaatagaaataatttctgaaaagtcttaaaatattttaagtttgttcatcttaattttccaatagtcttacattctagatgttttcaggattttcatttacaccatttctcaaaggtgtttgaattaaagcctgttacttgctctcacatatgtgggaaaaaaaatggcctttttgtttccccttttggttgttgttttatttaaacagttattgaagtttactgtttcggagttgacaagctttttcttaaaaggccagatagtaaatatattaggcttgcgagtagtgtgaactcagccagagacaatttataaacaaatgggtgtggctgtgttccagtacaatttttatcatagaaacaggcagtggggctgggcccagtggctcatgcctgtaatcccagcacttcgggaggccgaggcaggaagatcacttgaggtcaggagtcaagaccagcctggccaacatggtgaaaccccatctctactaaaaatacaaaagttagctgggcgtagtgacacaagcctataatcctagctacttgggaggctgaggcaggagaatcgcttgaacccagggggcagaggttgcagtgagccaagatcacactgctgcactccagcctgggcgaaagagtgagactccatctaaaaaaagaaagaaaaagaaacaggcaatgggcccatggactgcagttctgtaattcctcgacttctgatctgttctaaactctggatcaagtctttttgtgtcttggatcgctgatgagcttcaccaacctcacttttgagatttctgcttctcatgcagtccaccgaaggcccaatagttcacttttcttctcaaacaaagccaggccttgcctgcttcgaaccttttgcacgtgctgttccgccttcctgaaattcccttccatgtgtcctgtgtctggcttcctctgctatagccttgccggtataatttaaatgcttcttgcctaagaggcctgccttgatttctttctaccctcccccctcaaccaccacaacttctcactgttgctcaccaaagaattctgtctcacttggagcccttctcaaaatatgtaactatgcatttttcatttgtttgcttagtttgtgactcctcaactataatgagagctccatgaggtagaaccctgtgtgctctgactgtattctggtccctggcacagttcctggccaatagtaggtactctgggtaattatttgctgaatgatgaagcaaccctataaggcaggtactgttattggtgtccacattttacagatgaggagactcaggtttcacagaatgaagtcacttatccaaggtcatgcagctaggaagtggcagtccccagattcaatctgagggggctttgtctgattctaggccctgagctgatatccagtccctctatggttttggtttcttggttacgtacagagttgaagaacaaagccacccagctattcttggagacctgtcgggagtgaaaggcagcgggtggagaggtggagttacagaagcactatgttagtatcaaatgagctgactcaagttaaacggggaaaaggatcagttacctaattgcaaacaatcccactgttaatgtacagctttatgattcaggggtcaaaacggttttatgacagcaggatcccagtgttcttatgacggtgaagggaaagtaagtaggaaggttccattctcaatggagatctggggcaaagcaaggtgccccagcttatccaggaggtctggcaaccattaaagagaaatgacttcctaaattccaactgacaggggcactgaaggcattgtaccatccaggatgcagagcccctgtgctcagggaaatgaatatggtttaaaaactcaggggatctttccggtttgtcccaagcttgggaatttaatgtggaacattattttaaaacaataatttgaaagaacgttaatgtacttttttttaggatttaaaaaaagctgtgttttgcttattagtcagtggaaaatctatatgactaaaatatgtttaaatgtaagctggctaatgtaacaggctcagggaaggaaaatagaccatttgaagcaaatcaaccatttatttcctatgtattacctaagaaaaaagaaaacattgaagcaaagtgaaaatgacatgatggtccatttcaaacatttggtaaatgtaatgtaaatgaatcctgtacagtgattctgtgaattcagccaaaccatcagaaccaactttaaggacctcatgataactgtgagtttaacaaagttttgcaaaattatggtgttaattttctggaaggtatcaactataaataaggatgtattattttgtcaaagaaatgatccataagcagaagaaagcttgtctgggtataatgttgactaacatataacttgtttagaagtagttatccccaaagagaaagacaaaatgcgtatgctttcacacaggtatgaaagctatttgtaccaagaaaaagcatattttgacatacatctcttgtattttttacttttatgagataaacataattcattgttttccaaaaaggacttgaagtaagttacaattaaaaccaagtcttcacatgtgtgcacacatggacacataaaacatgattaatacaactaaaaatggaaaataaaagccatgaaaacctgaggaaataattcctctagccacaaagtccattataattactatgactgatcatcaagtttggccctgaactccctggcagccagagcaaaaagggaaacaggataaaagttgtatcattcttgttattagaaaggaggaaacagattagtttctagagataaagattttcctggcaccagatagcaaaaggagtttcttatgtgtgattttctatagataatggataattcctttgacagccctttccagcaaatgcagatgtggttttcatatcactgtctcctacaatgactcccaataaaagagggtgccataacattaaagtgcaactcagagaagggacattttgtgagagtactagtttttatttccatattgtgaaaggtacatggttttgcttttaatgcttattttaaaggtccagaaagaaattctaatctgtgtgcctatgttgcagagatctggcactatttctatatctaggcaattacacagggattttacttgaacacatccaaatttttaaaatttccactcaccatcatcttttaaatttcatgaaagcctcgagctaccattcaagtttttctattgctctctgtctctctttgttcattagtgatgtactgaggttttaagtaacttgattaggtgtagacgggggccctaaataatacgatttttcataggaagtgaagtgttatcccttttaacagattcagtgtaaattatttctgctttatctaggctcttttgtttttaattttaattttcttattaacaatgcaatctgctattatatttatatcatcaatatgtcaaaataacatgagttgtgaaataatcataacaactcttttttaagtctcccactgcccctctaaactttaaacagtgaaagaaaccttccctatagcactgaataaaaactttgcagaaccagtatcttttctgcttactcttaggcaaaaacagtcctgcagtgactataagtcacagacattctgtaattagaatgttcacctggcttttttgatcagcaaataaccatcaacctcaacacattcaaaaggggatgttaatgactggttaaatctatttgcttagaaggctaaaccaggagttctcacctttttgtgtttatagcattctttcaatttgtattattaaaaatatttgcagagtaccttgaacgaattaaattgcatctacatcaggaagctaaggcaggagaatcccttaaacctgggaggcggagtttgcagtgagcagagattgcgctgcactccagcctagatgacagaggaagaccctgtctcaaaataaaataaaataaaataagtaaataaattgcatccacagttatcttagcacaaatattgctatttggaccaatctatatactccccagggctcagggttatagcatcaccaggcatggttcacccgttgtcaggaaacacaataatttctgctggtgctgacttgacatttgtcttccctctctcatttcttagttgctaaaaatgacactgtactctacacccagaatccaccagctctctattccctggaagacatggtggtccttaatggaatagagcctcatttgtggctattgaagtgctgccaaggacttggtttcaacttcttagctttgggaaattcatgcacattcatttgttctacattttgggaaataataaatggaaaagttgtccgggatccagattgcattgaggtgcttaattttattcacctttccattactattgttggtcattgcatattcaccttcacatttcattgctacattccatagacaacaaatggaaatcaaaaggaagttctttaaacaaatgtttattgaaggcctattgtgaactgagcacaggggctggtgattaggtgtaagaagggaagtgatctgctctcttaattttagcagaaaaataaacatttgtcaacaataaaattatatattaataagataatggcttttaaatgcctagctttgagagctaggcacacagtgacttttaaatgcctagcttcgagagctaaacaatacctttctccaccctctgccttcttgcctgttcccattattggaaaggttaggggtttcttttctaatttttcagttttgctgagttagcagtcagtgcaatttacccagtcttaacctcaaagattgcaaaggggagctggtgaaatattgcacaagcctagccttggtttagccatgaattatgcattgtgtacttagactattatagtctgttatagtctgtttatctgttgacttccaccaagatttaggggtttgttgtacttaataacttgctttattttgtttgacatgtattttatgtcctccatgtgcatgaatacataagatacacagtcgtgggtgagggtctggagagaaagcccagccttgaaagattaactttgagaactctggagtaaaaatgttcacatactccttactcttgcagagtgctaatcaataggaaggtggatcagatttttccatgttttttccccactagaatacaaaacagttaaataaagggcagaaaaatgaatctggattccttgtatctctgaatttttgttcttaaagctggtccttaaattaaaaagatgtcaaaagacatttaattcattcagtattgaccacaaataagaatttcactgtttttgactacactctaatttttcattcgagtcctatattcaaaattgtgcctgatgggttaatatggatttttgcatgtcttgaaaataaaagcagttttatgaagattataagattatgagatgacatttgattttagcttgacctaaaaacatctcagacatttctcagcatacatgtgtttgagttttagaattctgaagctgttaaaggacaaaaacaaagtggaaaaacatagtaagattttcatatttaatatagttcattacatgtctgctgttttatatatatatacttatatatacacacatacatatctccacatacatagagatatgtacctatcttttatgtctgtttatagttagcaattatttctggacttttaaaaacttactttctcatttccattctgttttcttttttggaatttaaatgatctttatcaaaacagagatctctgcctctaaaggctctccaagtggaattaactgtttacccagccccaattttcatttacttcctcttcccaccacaagtgcttgtgttatctagaacaaaatctctttccccatatttagtcacaaagaattacatgaatgcctaaaataaacactatttaatttgtgtaactccctgcaattttaaacagttctccttgagtctcatgatgaccctggttgacaagaagaggaagctgaggcccaggtgggttacccacccctgcccaaactcacacccatcaggaatggaggattccaccttttgaagtgaacttggtcttttgactccagagccgaagctctttgctgagctctgtattgcctttgagtcgaaaaccaggaatgaaacaagggttccttgaatgtttaccattcattcagtaaacatttatgtactatgtgccagacatacggtaggcatggctgctgtccactgataaatgaaaagacattagtcccaagcttcactgaattcacagtctggctaggggatgggccattgtctgggttgggtttccccagaagttggccttcagacaaggatttgaatacaagtagcttatctggaggtgggggatagtagggttgttattcaccctccattttccttccgctgttatctgagggatgctcttaggagcattaacttctggtgctcctggcctgtatgtgcagggcatgccaagaagaagcccacaagtagaattgctggtgtcaacggtaggactctgttgacaagttctgtgctattgagtgctgacgggatgagggtgaggcactggccagggctgctaaagcagggaatgagatcttaactatgattactgtattgtggggggctacaggagaatagaggggccctcggggaagcgcttccagagaaactggcagctccctaacacctgcaaggaagcagaagtagcccaatgaaggccatgagggaggtgctctaggcagaaggaactataagaagttccatatggctggagcgtgttgagagatgagcaaggtaaagcaatcagaggtcagctccccaaagccccaaaagctacaaagaagttggactttatcctgcagggaataaagaatcatgaaaagatttcaagtgagagtgtatcaggatcaggttcatgtttgggggagagcctttagacttcagttcaaagaatggagggaaggactgacagttggagacaggaagcccagttaagagtatgctgcagtaatccaggcctgtgaggctaagtcgtggccttacatctgtccaatagaacagcctcttttcaggctgacatttcccaacggtgtcaatgctggctgccaaatcacatcacattgatgccaaaaagtcccctggccttgtcaagggatgtagatgatggctctggaactcttctgcctttttgtatcaccagtaggcttattaccctctatgtttgcttaaataggaaagttcatttaaagtttctgtttctttctgtagtgcctttctcttccagcataccatgtgacttcttctcagaccaattgtttgggggaaatgatagcaattgtacctgacataaccccacaaaatgccattattcttccttttgcacatgaagtattttctttcatttgcacttaatggtttctttaaattagattatgtattgggtttcttgtctgcatcggtaatctctctatgcatcagtgttgtctttttagcttgaaatttgctaagagacttgggatcttatcttgaaaattgctaagagacttgggatcttatctgtgtaaatctcatggagtagtagcaagcacagaaaggtgctgcttaaacaaggctgatggtgttgatactttgctttcagcatctctggccacttagaagactctcagcttccctatggacttggaaaaaacacggcatccatggccctaggaagcagtaaagaaagtctctcttttagggggttctgcttttctgcctttttgcaggacagtcacagtggatcatgcattataggataaaattggcgggggacatctgcaaatattaagccttaggctggtatattcaggcagtgaaatgctctagaacaatgagcatgaactattgtaacacgacgacaaagatgaatctcactaacatgctgagagagaaagaaacaataaaggagaggacatttgatcccataaagtctgaattggaaaaactagtctgtggtgttagagaactcgtgactggttaccccttttgggaggtgactgggaagctacacaagaaggctttgggtgctggttatgttctagttttggagaagggcactggttacacatgtatgagcactttgtgaaaattcatggagctatccgtttatgatgtgtgaaatgttctgtatgcatgttatccctcaataaataagcttattttaaaaaataaataaaaatagaactgtaggccaccagaactgaacagagctgaccttcgatggccatcacctccagcctgtttatgttgacatctgggaaaccaagaccttggggagaggtagggtgtgttcaaagaccgtcagctgaccaaccagctgcagaattgttgcagtacccaaagggaccctctcctaggccattgctgcctctatatcatccgaattatatgcttgactcagtgtatccaggtgagaattgaggaatggggctgaattctcaagggaagattcacaggacaaaaagatcaaggtctttttatgctgtggttttggttttgaattgcctgttgtcctcccattgtagctgatgatcattctcttggggagagacaggggagagttcataggccctttcctagcacatggccaggactcgagataccctttgcagagtggctcctgctgtggtcaaggaatgcaaccagctgtccagtgtttaaagaactctgagattatcaggggagattctgggccatgttttaagtcagacatgtagatctacatcccaattggaactggcccaagccctgccacatattccttagctttcagatgagagaagagaggtgataacaacacttggcctaaacagtaattaaggtgaatgagtttaactggttctgtgagggattagttaaaaatctcctctcccttttagtatgtctaatttggaagattctggaaccactgggtcattttatgtggattacttaagaaaagattgtgaggataaatttgctactggctacttagtcaataatactatggcctgggtacacatcaaaaatctctaaccatccaagaggtggcttccaggacatggatttcttcttattagggactaataggtcccaggaattagaaagcccatgtgtttcaggaggatgccacttctttgggcttgagatatgatatcttctggagaatttgactttgaagctgttttcagcctgtgggagtagtattatcagatatggagtggtaaattttctctggtgagttctgatggatcaatagggatctgttttgggtctttgtagatttactggagagaagaatgcttcttatatcccttgttcctatttcccatttaaaataaaataaaatggagtgttagtaactaaaagctctaaagaggtaaaatatatgaaaagttactagtgaaaaatcctgccatataagaaataattgagatgccatgtctagccctgtatctgaatggagatcacatactgggcttaaccaacatatttttcataacaaccctactaggtattaataaataaataccattcttttttatttttgaggcagggtctcactctgttacccaggctggagtgcagtggcaggatcacaactttccacatcttccaactccctgggctcaagctatcctcctgcctcagcttccctagtagctgggactacaggcgcgcaccaccacacccagctaatttttgtatttttggtagagacagggtttcaccatatttcctgggctggtctcaaattcccgggcttaagccatccacccaccttggctcccaaagtgctaggattacaggtgtgagccatcgccccccagccgacacatactatttttattcttttcttacagatgagtaagttgatgctcagggacaccaattaccttgcctaagattgtgcagatagtaattaggaaagctggtattaaaactaggtcctatctgtcccacagttcataatgcagccatatatatttcagggcaaggacttgtagtagtatagttcttcctgtgaagtactgggagtgacctttctaagggctggggcactagctgagtagacctttccttttgaacacaggccaggggacattttttcattactcaccaccttgagggagatgctatcattgtccttgggtagagctcactcaactcatcctccattccagccatggccaaaacctggagccaatactccaggggcctctgacttagatgtatacatttagaatggcaatgcagtcaagaacctgaactttggagttgacggagttgagtttatgtgagttttacctttccaagcctcagtttattcatctgttaaatggggataataatagtacgtacccagtacaataggcttattgggaaggtgaaatgaaccatttatgtaaagtacttggcacagtgcttggttcatagtaagtgtcacaacactgtagatacaattatatataattagcagtggtaacaagggagcctcatgtacacacctgcacacacagttacacacatggaattaattgtgaggcttgactctagtatggagacccagagatcagacttttttgttcctctgtaatgagctcaatgggcatggcccttggcatcaagtcagcatttgaataatttccatggcattagattcagtgggtagaaagctctataatattttctaaaatatatagttaagccatgctttggttttctcaaaagaactccttacccctctgccccattacatgtacacattccacagaaggacaggacttggctcatttttaatcagatttgcaaaggaaaagataattgttctactgtatgctggcatattgcaagctatgtgtgacatactatgtagagtttaattcaaatgacgaattgaaaaaaaatcccacatctaaaacagatgtacaggcatgatccataagtggtagtcaattcacaaattaagaaaataagtgaaaggataaatgcacatttcaagatctaagtctttgttcaatatgttaaacacatggccaatttcaaagtccctgtaaccaccgagttggaacacaacccactcagaagtagctggcatcttacaggaaaggattagaattccttatgaccttgatgtgttaaagaagttatcagtaacaattatttgaactcagcggggcaggagaaaagacaaactgtgagctgaagatggtgcagagctggctttgtatagatctagtcaagagaatcgaccccaagtagaggcattgctgaaaagtcaaaggcacttccgggcagcatgaatgagaagatgtggacagcacaagcctcaagaggcagcccttgctggcttttcattggcatgagcagagcaccctgcattgccatgtgaggtcctcagtgtgggggagagttgaggttgaggaatgcagggcattggagagttggacaaagagggaagatagtggcatagtaaggaccatgataaccacctattgcccatggatgcagaaagaagaaacaggctcaaaattacagcaagggatggaggttagctaaaagaaggaactgagagaagtgatggcagaaaccttgaaaccttatgagttcaacagcatctgttttctgaaataatttgaaatgggacttagtgagaaatcaaaggatggtgctggttaatttgtcaaacccatatttgccgtctcaacactcaaaggctaagcaggaagattaagacaaagacttctgatctggacctatttttaggttttccttgtgtaccctgaattatcttgccttcgggtaattctttcagtcattccctttgggtcaaatgtccttcaaggcctatatctaatgatgtcttttgcaagaagtctttcctgaagctggaagtatcctttgccctttccgagccctccacagtattgaaccatgatgtccttccttccttcgtgaggctttctatcatgcatcttcggttatgcctttaaatgtctttcttatctcctctgctctccttaaggccagaattaccacacatattagggggtaagtaatataatggatgcataaatgagcaaccgtttgttttgttggcatttgtggaaactctagctttggcagcaacttccatccagcacatgcaaagaactaactcctgacaaactccaagagacaaaggcatgtctcccagttggcttcatgtagatggtaattgaagcacaatttgaaaattaagatttcagctacattatagtgatttgtgcagacttattaagaagaatacacaaaacctagaaaaatggggtgggtgtgggattagtagatgacaaaacataaaggaagaagaaagatctctaaactgttcacgttaagagacgtactcaaaacactggccaaaccatgttgaggctgttttacctacaggcataatttatgagctcctataaagaatttcaacgtcacaaggtcatgttgttgatatgactggtttgggtcctatgacctcactaggcagccttttttacacagtcccctaaattggtaaccaaaatcaagaaacttgataagtcctatagaaactctcttgaagctctctcttttttagaaaagatggaaaatgatgaacttctggcatttctgtaaatattaaatctcctataaaatgaattacctttgtttctctcacagtcttcattccatcattgtgtggaggtataggggaaaaaaaaatcacaaagatagagaatacaaattgaggttttgtaaagcaaaacaaacaaacaaacaaacaaaaacaaaacaaaagacaaagaattttgcctctttttacataagtaaactgtgagaaattattcctaaaaagccttagcccatttctgtctgttcaaacataatttcatctactataacaagtaccccttccccttctagaatgaaaatgtcctagtttaaggtaatatcttagtcatctgaaattactttttagaaattttatatttaaaaacattaatctggtaacctgtagagtagttaggggtgaaagatagagagatgtcatggaagccaataccattttagatattcgacagctaaccctggtttcttggttattgtcccgtccttttaaagccacctttggctttcagtgttgggaccttgccttggggatgggtgtttggtgatcctcacgttatcacctgttggggcaagtgatgagactttgtcacccaaggcagttgactatttttttttctatattctcaaggatgggcattctccagcctcagtaagcccaaatgataggcacatcaagaccataccatcaatctctctgaatttaccttatggataataatatttttaaatggcagcagcaggaaagttttttattttagggctgtcattctagagtaaagagtgaaatattttaaaagtaaatccacatttttcatttcttgagattgaatcaattcagtgctagtaaatgtaacaatgacaggtggactgttggattcagagaaataacatttgttcagagactagtttaaaaaataacaatctaggcacattgctgagtgcttaccttagaccttaccttagccctgtgatcttggtactacaagtatttgcttctttttattaatggagaaactgaggcccaggctggttactgggccagggagtggctaagctggcatttgagtccaggcagtcagcctgccgagcccatgcaccttagtactgtgcacacttcctccaggtgaagggcaggcatttgtaaaaacctaaattattcatttcaggcttcggtaagtattccttgcatccttccagggagcatttggtgagaattattagatgatgtgggtgaaatgcacacctccggggacaactgtaaggaaagtgccccattctgtggcacttcctgctgtggctggccacaccagctgtttccggctctggagtcagaggtgtgaattctggctttgctatttaccatctgttgaatgtcactgtattcttttgtaaaatgggagtcattgcaaatattcactgtgataataaaacctacacatttatttgtcaaatactaatttgatgcctctgctatttaaactgtcagtggctatttccaagctggaaggtgatttgacctgatttgcatcttgagaagatgatcctggctgaatgtgggggagagggggaagcttacagagggtaggaaaaggcgagtctgtcatattgtcagttggccttgcttaacaccctgttcatggtagtgatacgatctttgctccctattccattttccctggtgttcttttgtttgcttgtttttattttcttactgctgtgttcccagcacttaaaatacttcttggaacataggagggactctgtatttgtcgagtaaatagatcaaagtaggatagccagtaaggaacttgttggggttgtaacatataaggtgatggcagcctgccctgtgaaatggagagacgggtactgattcaaggcaaagaaatggagtgaacctggtggataggaaacaggatttctggtcagattaaatgaccagatgatggtgctttttgctgaaatgcaaaaggatgcagggggaagaggtgagggtatggggacttgggataagcagaaaagctaatgggacttagcaatccaaagtacccaggaaaatgctagcatcaccctgtaggtaagacccctgtggtctttgatgacagcaagaatgtcggcctgacacatgcagaaccttctcagtgggctgtctctcctgcacaggtggaaaggaaaagaattccagccaaggtgtgagaaagcctgagtgtctcagagcacacagtgggaaccaatgtgagatgcccctggcagatatctgtgtggtacaccctggtgggagaggagtggtaaaatgtcccctcagatccccttctctctacaactccatcgttcccaatccacagggaaacaacgtggagttaaggaaggttctcacaggctgcttttccattctggttcttcatactttatatccctcttccttttccgtttttttttttttttttctgtgaggctgagttttgctcttgttgccccggcgggagtgtagtagggcgatctcggctcactgcaacctccacatcctgggttcaatcgattctcctgcctttgcctcctgggtagctgggattacaggcgccggccacatcacccagctaattttttgtatttttagtagagacagggtttcacctgttggccaggatggtcttgaactcctgacctcaggtgatccacccccctcggcctcccaaagtgctgggattacaggtgtgagccaccacacctggctctctcttcctttttcaaatgagttgtttcatctcctcagactttctgggagaagaaaagggagcaaggaattaagccatgacaaaaaaaaaaccatttttaaaaaattaaatgaatgcactatgaacttgaaaattcagaagacaaatgtttcttcccccaggcttccattaggatcatatggagaagtccaggaaggttttctgagcacctaccctggagagcagggctggtgggcagggcctgtggtttcagggctggagggtctcattcccatcccagtgcttgttcttccaacagtccaagtattgctttcagttgctcatgcagatctgaacttgaaacagtgataaatatggggtgtcctctacaagatgtcatggccccggacatcccttcctgcattgtgctgtggctgcctcagcattattttgagtgttgacagagtgctcagtgcagcagagacagccttccttgtctgaggtctcacacagagttttgggcaagagcccaaaacaacagccatgatataatgtccaaatgtatttgggtgacataccacacgctaaggccccggatgtcactgatagcttccttcagagccctttattgctattcttcatttaggacgttttaataaacagtgatgtggaaaggttttgaccctatgaagctgagtgagctcgtcttggcgtatcatttgctatcacacaacacagggctacagaatcagatgccctggtgggaggagatatttgccacagagctgtggtcaagagcatggcagatttggctgaatttgaatacaggatttgccacctaccaactttatgaccttgggcaaaaggcacatccgtaaattaagtataatattggcgtgtgccacagaggagtgaacttttctgaatagaaaaagaaatgcacttgtaaaatgctcatttccacataaagactggcatatgtgacatactcagtaaataacaattgttatgatggagattttaaaaaatatgttatttgtatggatttattgcatggttttaattccaagatgatttttttccctttttgatatttataaaattggaactcataattttttgttatgtctatttattgtgggttttttggtacacctattagctattatgaatggaaactttttccattgtctttttaactggcagtgcaggttgacgtagagcttagtgaatttttaacctgacacattcctgcattattttttgttcaagtagttttttagttgactcttttccataaaagaaatggaatctttttcatgattttatgtactttctgaatagattatcatatcatatgttaataatcccaggtaagcttctcttttacaatagcggttttagtatgttttccttgtcttattgttttaggtggaatatctaaaacaatactaaatactagtggttatagtgagcatccttgtcttgcctctggatttcatgggaatgttgcctgtagttcactatttctttgtttgttattcagatgagatagaccttattaaagagatatgctcttattcttagtttcctgtgattttatatcaagaattgttgaatttttatttaatgcctcatgaacattttcttctaaatcagtggttctcaaactaaggtatatttaagaattcccaaagagcacttaacaaaaaaaaaagactaagactttctccagttacactgtaagataatttgccgtggtaggaatcagacccacgattctgatgtgtaccactgataaagaagaactgctttgaatgatctcatatgtatttacctctcttgacttactaacgtaatgtgttagattatggaattcccactattaaatcatcattactttccttaaataaaccctacttggccgtgtttgtattctttctgcaatgtgctgctggggttttttttgcaagtgttgcagcttacagtttttatatcatagtcacaagtagaattgacctacagtttcttcttttatgtatccaagatacgtcagctttgaaaattaaattgtgaagcagtctatatttccagaacttttttttttttgagacagagtctcactctgtcacccaggctggagtgcagtagcgcaatctcggctcactgcaacctccacctcctggatttaagtgattctcccgcctcagcctcctgagtagttgggattacaggcaccgccactacacccagctaatttttttttttttttttttttttttgtatttttagtagagatggggtttcatcatgttggccaggctggttttgaactcctgacctcaagtgatccaccctcctcggcctcccaaagtgctaggattacaggcgtgagccaccgcacctggcctatttccagaactttttaagcagccaaaaacattggtctgttcttgaaagtatgaaagtattcttctattaaatgctccaaacccagggccatttttggagataattttttggcaacattttttttttatttcctggttattgggttattggcccatttagattatctgcctcttccctattatttttgttttgctagagtattgtccatttcatctacttatatgcctattgtcattattccaatctcttctttatctgttctattcccttgcctttttgtcattttatagttatttctttacattctgtctccacctttttctccttgattaaactttccaagaagtttaattgttttacttgttgttgttttacttttcattttcctaattatttgtatgcatgaacatcctttatcaattagtcattcacatgtctttattcagagctttgtatattcatatcctttgcatgggctaatgatacataccctttgtacctttctgctggctgatagacctttttcttattaatgtgtcatattgtggatgcaaattatttatctgaaatgtgcttatctaattgacatttatcttacagctttgctcatttagggagttgctgttgtagctgttttttgccacacagaactttcataattatatgaatcccagtcttttcctttatagcatctggatttcctgtcttttgaaaagacctccccatgccaagagtttgaaaataaaattgagaaatgaaataattaggcattatgtctagtgaaatacatgaaatggaatagacacacagaataacctcttctccctcctcctttccttcctctgttttcttaccacaccactctgaatgtggtataaaagtgccaaaagtagagtcttagaaacagccggacttacccaagtcatgtttccagagaacctgatttctccagtagccctctgaggatttaaggaacacctgcatttttccaatcttgtgtgcatttacatatatacatacacacgtgtattcatttagttatacataagcatatgcatttacatcataggtactactctaacaaaatcccttttgtgaaaaaaatttttttaaatatatttttttcatgagcatttggatttacttcattgaaaaaggatcatgtcagccaacagcaggcatcagaaatcttacctaatctgatatgaagcatcatcaaggaaatttcctatggtctgaaagttttgtttctctttagaaaataaaaaacctaacaaaattaattttttttagaattgcctcattgaggaaatagtcaattcggtcacatttcatcttgataaacagtacactaaatgggcacagtattctgaagttcccatgtggaagagagccacacaagtgtaaaaagtaaaatttatatacaggattaggggtaaaagtgtatgttccagcatgtttgcctgatagtgtgtaattgtcaagcattatttgtcggttagggggatcagctaaagcctggtgtataaaaattcatgccagtaggaaatttacaataaatcaaagtatagattactccataacattacatctttcagttgtaaattaactcacacaaatttggctttctgggtaatgaacagcatttctaatggagctggaggctgacaataaataagttcagattagacacaaagcctcccttttccctccttccgccagcccacaggggtgcctgtatgcccacttttgtttctggactttctatctagagatggtctgaggggtaggtccttgggtgtgggtgaaggacacccatctttagcccttctgtagagcaccacatgaaatttcattttcactgtaacacagttgcagctttttcctgctctagctgggtacacttctgctttctgcaggttgttaccccagaacctgatgctacatgggccctcagatgccacactgaagccagatgtccctggcactaactggaatattgacaccaggtatgatccacagggtgccaggtgcctctgcctggcaaggccatttgtccctgaggagaaatcatatgttcctttttgagatgccagatattgctgttattattttttttttatgtatttttaactgcctttggggtgagaaggagaaagagaggagggagacacttggttctataagcaagaagagagtcttcccaagagaattccagaaaagattggggttgaggaagttgtagatgtctcccgtgttttttccagcaggagcagccaaatggaatcacattcacggaaaaactacaacgaatactaatactaaaatgaatgctaatgccaaccacactgcctagcgtttgtgtgtgtttgccatgttgggtgctatgttactccactgtatgagctttctcattttcttctcacagcagccctttgggatggctaccatttacaaggtcctgaggattagagagatctaggtcaaaggcctgaggccaccagctccagctcccaatctccaggatgttctggagttaatatttcaacccaggtctagctgtcccacagcttgacccttcccagcccctttccgtacccccaggctcacatgagtaactcacgcctatttctttgtgtaagtctttatccttttcctaagctcctctggtctcgagttcccaagaatgttcctagtgaatccctggacctgctccttcttagtcccatcgtctccactcagcggcttccctgctccatccctgaaatggtgttagccttctctctcacttagacctgctccatccttagtcacattatgtacctaagtatttaaatcctcagtctgttcttactccgttgtgctctccatgacaatctcccccatcatttctgcccttatcttctctccatggtgtgcagacagacccgcttcttgagatttccaggacctaggacaataggacaaatggaggccccgtgtggcttgtgtgccctttataattccagttcacttggtcagttactaaactttcaacaacaacaacaacaacaacaaataacattctaaagagccagaaaagaaaaaaaaaagtatgtgttggtgttttgatatgcaggccttcacagtagggccccctcttgcccagcctaaaggtgaggataggttctgtctcagctcagtgagactggtctgtggatcaccaccaaactgctttctttatccttcttctcctgtggtgcacagctcatggccagatgaggagatggattatgcaaatgttgctgacatacagactgcccctggggaagccaactgggtccacccctgctgcacaccaaacaaagcaaattatctcaaaactggcagaagttcgcagggaaaagttggtttggattcataactaattgtctgctgttgtaaaaatcagaggattaggaagggaaagtattttctcattggatttttctggtcaagacagggcagggccctctcagtatcttttctgtctcatcctctctcatttgttcatattatctatctctccttactctctctgtctgtctattatctatctctccttactctctctgtctgtctcactttttccttttttatttatttatttatttatttatttatttatttatttatttattttgagacagggtctcattctgccagagtcgcccaggctggagtgccatgacactgctatagttcgctgcagcctcattctcctgggctcaagtgatcttcccacctcatcctcctgagagctcgaaccacaggcatgcacaaccgcgccaggctaatttttgtagttttagtagagacaaggttttaccatgttgatcaggctggcctcaaactcctgacctcaagtgatccttccgcctaggccttacaaaatgctgggattacaggtgtgagctaccacacccgacccccactctctctttctttttctgtctctcatgtctttatcatcatcaagcaagcaaggaaaaaggaaacagaaaattgaagacaaagaaggcctttcccctgaagttgggtagttggaaagctgattaaggagattaaaggcaggaggacatgtgtggggacatttgatgctagctgggctcctgcttctgctgtggaaagactcccacaaggctgttgtctctcctaaaatgtccattgaattaaaatttgttctttagttagacctgggagtgagaatcagtgttgttgtaagcagtgaactgtaacaatttaaagtttaatgaggcaagaaccaaattgggcttgtgttttatgtctctaatacttgtaaaacgtgccattctcttaaccatgttaaaataaatattagtaattaggtaatattaatggtttgttattttgatgaaggactttctttttaaatggaaaataaaggaaattgactggaaaggcatattatgttccccctggctggccaaggctaaggaaagcctgcctgggtcacccaaaagggccaggccatcctgtttacctggtgggtaatctggtgggttctcccaggctgacagccaaggctctgaaggagatccgagcctctgaaggcctggctctgcaaagccaaacctgcagaatgaatacaaatgcctccttttgtaaaccaggtctttgggaaaccactggaacacctagagagcaggacccagagaacaagaccagggaaacaggagagccaaggaaagggggaagattgcagcatcataacattgatgggagaccacgaagtcggggggtccctgagtgctttgtatcctgctccaggcaacagctcagggaagttcatttccccagtgtctaaatgcacacacagacttgagcttgggctgcagaatccatcttagcttgttagttgaaccgatgttgacataatgcctcactgcctgagatcccatgagctttcttcccaaccctgttaggtggtccttggaccactaagaactatgtggttatggcccattgtctcctctttcccttcagtaaggaccatgttttacccagtctagcctgagactgaatgtatcctattaaaagtgtgtgttgaatgagggtgctccaggtctcagaaggcggtggggttaattactgctctgagcttaagcagggcagccagaaggatgtttttcaaaaagattatgattatgggccttctggttagaatactttgggcatcagacaggggtagcaacccaaatttggggaaggaagagaataaaatgacaagaatctcaaattggataagtatatacacaaaagccgccttctttccctctataatctctgttcctttcagtatatcctgggtgttcagtgaaccaaaaaatatacttacagtttttctctgtgcacttgcaagaaggcgaggatacttctaaccaaaatagcctttcccaggaacacctgtcagcaatgattttttttaaaaaacaaattgaaatggaagcactgtgccatattccatattcattgaataaccattgactgggggcctactttgtgcgcagcaccattccggatggtgggaacgaaaccaacattcctgcctcatagagctgatattctcaacaagggagaaataataagacaggcaagatgagtattagcttgtctcatatgaaactggcatgtggataggtcaaaaagtttaaaaataggaaattgtgtatgatttaacctagcatatgatattttgatagtgataagtgttaaagagaaagatttgaagtcagaaaagggaatctgaaatgttgggatcacaaatttttaattatgaaaagacctcatagagaaggcaagatttgaacaaagtttggaaggagtaaggaaaccagccaagtgcatgtccgagagggaagagcgctccaggcagagggcatggccagtgcaaaggccctaaggtgggaccagccaggaagcctgtgtgatggttggaggatgagtagaaataacgttaggcaagtaattaggagccaggtcacacgggactgatagccattgggatgactttggcttggctctgagaaaaatgcagagacctttgggaaggttttgagcagaggaatcacttgctccaatgtaacattttaacaggatccctggctactgtgttgagaaaagaagcaggagaccagctaggaggccattgcaataatccaggcatgagatgatggcaagccccaccaggtcttggcagtggggtggtgcgtcatggtccactttggacctattttgaaggtagggccaacaggaaatgctgaaggattggatgtgggtacaggggcagggagcaggttgtggtgctattaatcttgacactaaagttttgggtctgagaaatgggaagaatagaattacccttagctaagacagggtaactacagcaggagttgcttcaggcccaagggaccctcttcatcttggcaaatttgacaattccagcatgctgggctcagtgctgatgaatataaaagcttagggagggaaaggatgggtgataacttgaaatacttttttcaaaaattaacataaaataaaataggccaggcacagtggcttacgcctgtaatcccagcactttggaaggccgaggcaggcggatcacgaggtcaggagatcgagaccatcctggctaacgcggtgaaaccccgtctctactaaaaaatacaaaaaatttagccaggcgtggtggcgggtgcctgtagtcccaggtactcagggggctgaggcaggagaatggcatgaacccgggaggcggagcttgcagtgagccgagatcgcgccactgcactccagcctgggctacagagcgagactccgtctcaaaaaaaaaaaagaatacaaaaagtagccaggcgtggtggtgcatgcctgcagtcccagctacttgggaggctgagacaggagaattgcttgaacctgggtggcggaagttgcagtgagccaagatcacaccactgcactctagcctgggtgacagagtgagactttgtctcaaaaataaattaattaataaaataaatggtaattctaagaataggtattaatgccttactgtatgcctagagtaccatactaacctttgggcatggattttcttatttaatactcacaacagtcctgatgggcggagaggcccacagacgtgaggccttggagcccagatcctttatgagttgctcccaggtcgctgatggatatttcacccctccaagtgagtggttgtttgtgaaggttacaactggataggagcaaaaggtgagacacagttgagatttctgagaaaacccataattacagacatcctgtgtgctctgtgcaaaggttatttcccattacaggtggagagcctgcctcctcaggcctgctgtggggcagagtgggtactgaagaaggcacagtctcatcaggtgtgcagggttaattatctcgcctcagtgcaatgggagcaagagttactgctgttttgacagattgtgttaattggaagcccagtttgattaggaggctcatgctttgtgcctgcagtcagccagcctagtggggtttatgcctcagcatttctgcttattttcatcttctaatttttccaccacgaacaagtcacaagagaggttaagagcatgggatttggagataaacagacctgggttcaagtcctagctttacttcttactaacttttgtctaactctgggctcccagactcagtttccccttctgtgcaatggtagcagggtggacgtgaagactcagtgagataatgcacataaggtacctagtacctagcacaatcgatgttgctaatgtcattctccattttatctttaaggtaaatcaggataatttgtaatctgaatgatctatattgaatcaagtattaaaaaaccaacagttggtgggagtgtaaatgagttcaaccattgtggaagacagtgtggtgattcctcaaggatctagaaccagaaataccatttgacccagcaatcccattactgggtatatacccaaaggattagaaatcattctactataaagacacatacacacgtatgtttattgcagcactatttacaatagcaaagacttggaaccaacccaaatgcccatcaatgatagactggataaagaaaatgtggcacatatacaccatagaatgctatacagccataaaaaacaatgagttcatgtccttggcaggggcatggatgaagctagaaaccatcattctcagcaaactaacacaggaacagaaaaccaaacaccgcatgttctcactcataggtgggagttgaacaatgagaacacatggacacagggaggggaacatcacacaatggggcctgtcaggggtggggggcaaggggagggagagcattaggagaaatacctaatatagataacgagttgaggggtgcagcaaaccaccatggcacatgtgtacctatgtaacaaacctgcacatgtgtacctatgtaacaaacctgcacattctgcacatgtatcccagaacttaaagtataatttaaaaaaattaaaaaattaaaaaccaacagtttaacagtgatgataaattgcaaccaactcttagattcagagttggaaagatggtaggaaatagtgagggctggagagcatctgcccatcaaagggggaagggggcactcactcctctgttccagttgatttctgtcatgcaggaatacagctctgatgttaccaattcttccaattgttagagaaagcctcaaactgggattttttaatattttggcaaccgactaaaaaaataaatttttaaaattccatgcaagtcaaacacaatgttcctatggttctgatgtggcctggaggctgcaagtttataagctatattagtgggctttggaggataacaagtgacccctacagctcagtggttgcatgtcagccatgggtcactggggtctgtgcttgtgctctacatgtcaccatcactctaggatccaggatgaggtagcagcctctgtttgggatatgccattctcctggcagagaaaaaagagttagaagaagcatacaatggctcttaaagtgtctgcttgcagtttgcacgcattactttctcttatatcccattcgtcaaggcagatcacatggccaagcctgacgatggggcaaggaagtgtacttttcctacaggaaggcctgcaaatcacctggcaaagggaggggatgttggctgctattagagggaagcagggagcaaataattgtgaatgacaacatgatctgccacaagaaccttctgccatatccccctccttccattcacttgcctttccagagttttatttagctgttttcagagttattttccaaaacctggagtgaagtgtttttagatttccttaagatgaagtgtgacactctgtggcttgtggatgaataccgtcttttatggcactcagatatagtaaccaatatgtaatgtatattggttactatacattagattgaacccaatgaaattgctgatattcaactttttttatctgaaaagatagaaatttctaattgttcaaccaaatatatttataatttttatcccctgagaactgaagaattcattatctaacatcgtctgacaatatcctgcattctcaacctgcaaacctttgcatcctctgcttgtatataccttttctaccttctgcccaacccagacagagaccctgtgatgttccccctaagatgtgctcagaaataggttcagcaaggagggaaaagaggccatccctgaagaatgtaaaactactggagaagaacctggtgtgccccagagctcttaatccaggctggttcactatcagctcccaaactgcccccaaataaatgttgaatgacttgacctcatcagcagtgatgataaccacttaggtctaaaaagacagacttctttaatgttaagagggcaagtcttaggtaaatgaaaatcagagtcattcatttggtatatatttaccagccacctttgtatgctggagccttcggaggcctccaagcgagatagcagtgaaccaggcagacaggctcactgtgatcctaacactcatcccagttcatcatagatgttaaaatttcagagccaaagggaccttagagcccatgcaatccaatgtctcattttacagatgaggacactgtggtactgatttttctcccgtcctaagatctatccacacagtggccacagggataatcttagggtatgagtttgatcatgtctgttccctctattgcatgctcagaggcaaaaataatattaaaacataaaactaaagtaaaacccaacccccaactagggtgtgtaacctgctgctgcccgctgcctactccccaaacccatctgatgtcaccttcttctgtcttcctaagctccggccccattggcttgcttcttctaagctcatacttgcctcacagcgtttacacttagcgttctcccatctggtctgcacttccttgtgatcttcccctagctggccccatgtcctccatccctcagggctcagttcaaacatctccttcacaggaaggcctagctaaagtataccctctcccctgtaactctttgtccctttattcctttagattgtctttatctgaagtttcatttttttacttgtttattgttcttctctcttatgacactttgaatttcaggaaggcaaaacctagtcctttgtgttcaccactgtatccccatcacaaagcacagtgcctattacagagttggtgatcattaagtagttcttgagtggaagaatgagcgatggatgtgaaggcactgacttatggattcccagatagtgctttattccaggattgatgttctgatttgcaaaccagccttctttcttctttccatctgtattagtccattctcacattgctataaacaaatacctaaaactaggtaatttatacagaaaagaggtttaattggctcatggttttgcaggctgtaccagaagcatggctggggagacctcaggaaacttacaatcatagtagaaggtgaaggggaagtaggcacatcttacatggccagaaaaaggaggaagagagtggagaaggaggtgctacacacttttaaacaaccagatcttgtgagaactcactattatgagaacagcaaaggggaaatctgcccccatgatccaatcgcctcccaccaggcccctcctccaacactggggagtacagtttgacatgagatttgggcagggacacaaatccaaaccatatcaccatcctacatttggtactcagtagacccccaaatgtttgttgaataagtaacgagaacgttcatagcttaacttgaacatagggccaacacttcatttttcatgtctacatcagacatcactcattcacatcagttatttgttgttcatccctgatgccctttagtgtactcccggagaacatcacctacagagcagagctggcaggagggtctctgtgccatctctagtttaagctgagtcttgatctacctgggcatgtctgattaggcgggcttcttagaggtctatacgcatgaaggaccaccttgcctcctgggaattaaagcaccttagggaaactgggttgagagagaaggagtaactccgagtggagctgggcgtctgtccacagaggggtttctgttttacttccctcatacttggcctgaaagcaaagggcccacagttaagacggccagtggaaactgaataggtggccttgccgaagcctctggggtctttgagaacatctgaaacatgccactttggagctggcagatatgttagcaatggaaaaaagtagtagtgacttggaagctggcacccttggcaaaaacctaagcccgctgagcaatttacattttataagcactgcatgctaactaattatgccactggaacactaaagttacattttatctgcatgactagtgaattagcacctctccaactggtatcagcacctccctgccatttaagtcataaatccatgaatgcagcaagacctttgcctagttttgttcaccattttatcactgatgcccgttacaggacctggcacacagtaagcactcaataaatatttgttagttgaatgaattaggcttctctaacccccaagttgatatgacctgggaaacacaggtggcaggaagaacatgataagagggaagataaactaggtagcatgggaaatcaggcaagtaatcaccctcaggattcctgttccaggaagtggaggtgtgaaggtgaaggaggaatgcaatgtgacttttggcagctcttttttctcagacatttgggctttcagagaaggtgaattctgggttatagtcctagagctgtgtccataactgcatctcagtgttcctggtgtcttcaagattgccagcccttcccaacctgtgccagacataagaggtggggccagagggtgagtgccccctactagataccctcctttttgggtcttcagtctatcccacaagctccactcaccctcttcccccatcattattttaggggtgagctccggtctggtttcttctacatctacctgaaatgccaaacctgcccagtctccttgggtcatttccaaggctgggcaggaaagcttgcatactgttgttggattcaattagaatcactctctgggaggcggaggttgcagtgagctgagattgcgccattgtactccagcctgggcgacagagcgagactccatctaaaaaataaataaataaaataaaaataataaatcacctacaaactgatacgtctattcccctattattttgtttgggtccttgatcctttttttttttttttttcttgtggagagaaccaagagttgtgttctagcctttaaatgggggcagatgccccctctccaaatgggcagctttccttctgttgccagcccttggccacagcaggttttggcgatctgctggcatttagtgcttctgtgtgtggcctgggctttgaattcagctgctcctcctggcagccttggtagcttcacacagttctcttagtgtcctgggacttggcccaggcataccctacaggggttctgagcctcagcagattcttcccccaatttggagtacagtatccttgagccatgtttaaaagacttctctttaaaagactgcaccctactctactgccctctcactctcattctattaggatttctttttttcttttgagactgaagaagaataaaacagacagtgagatcacgtaatcattttattcagcaaaatgcaggaaagccaaactcacctgagcaggcagggaatagagacgttacagacgtggacaagatttcctcaggtttttagtctggtctgcggtccatctttaaagataaactttgcagtgtttcgtattaatatcgtatctgcatgatgtaatagccccagtaacagctgctccctcaacctcagggaaaaaagcctcaagtaacgacccactcaactctctgaagcatgttccctctgttgaggatacctctgccagtttggattgtctaaaaatgttcattttgagtcattagggcagaaagccataacaatagttgcacatgctacgtcattgggtggaatacaatagctctcttagaccctgggaaagattgattgctgcacttatctctagattaagtatgaatttggggaccctttaggatcagcctttgcagagccattacttgtttgaacgagcaccaatggctggagatggatgggcaatttaatctgccaagaaaagtagacttcagatcattcttgggtcttggagagaaaaaagtctccttttattcaagtaggtaatgtagataattgcatgtattttgcataatttgatttatgaggatattacagtcacatatgggccctggtctgaattctctatcttaggaatgccagttttattcagtcaaaaaataaataaatgaaaagaaagaaatagatcatgtggacttgtaggagactcagttttgacctatttttctgacattggaagacaagaagcgatctcctgttggattaaaactaatctcttagaaattgttctaataggtgactcttgaaattgataaagtttggcacagagttgaagagctgtataatttggcagctgaaatctcaccctatgtattgccaaaaaaagaagaaaatccccaccaaaaatgagcctcaccactgcatattctgttgtttgcccgtagtcacattaggctacatgcaatggaggtgaacgttctcatttaagaaacaggtgaaaggaggccccatgtctctatatttagcctctagatttccttgagtgtcagttggtctcatgaattcttgggaggtataagagtaaatacaagtggggattcattcaacaattgtcaaatgtcttaaggatgcatagaaaactatcagaaaaccctatttgtttagaagttgttaattcagactttaagatcctacgacctaagcagaattttgctttttctctgtctggaaaaggaagatttgatgagcaaaataagagcacagccaaagccataagtatctccttcatttgtgtagtcattcagccaacacctaactgagggcttagcaattgccaggatctgggctggggactggggactgggattgacacaggccctgtgtgcacagtccaaggtaaaagatcccgttagtaagtaaatgcgatgcaagtgttgcagcaggtgtgacagaagccagttctaagaggaggagagaatggcctatgctcacctggaagcaaaaattgcctaagaagaaaatggtttaaaaatggggcaagtaattgcaaatgtgcttttcatctgttatggctgttgcagagaaataatttaagttaaaattgtccatcttcagagagataaacacttttttaaaatttggagagcactgcagaactcttgtagctgaacagtgcaccccaggctgtatccataaaaagaaaaattgcaaaaccttattctgaactaaatacagaaacgcaaacagtggaagtatttctgagaatgttaatatttgggaacttgtttgggggactttaaaacattgaaaagggtaggtctgcatgagagttagtgaatgcactaaaataatattcataaaaatacgtcgtgagaagccaacatttattttaaaaagaggcataaaatatctgtaatattgtgctttattttattaggtactattatatagggaaaatccataatttttagaaacagactgacatatttaggggtggaatgtcttgatgtccaactttaaaaatacttcagaaataaaaggtgagaaaatatgacacatttattaaattttcgtaatgggcttgtgggcattcattatatgcttctccttttctgtatatttgaaaatgtccacaatttaaagtcagaaagtctgtgtctatactatttactgaataacttctatgtgctggacagttatacttggtactcatttctaaatttcacaacaaccctgcaaaatcagtaactatccccctttaaagatggcagaactgaagctcagggtcaccagttggcaggagtcagagtccctctctgaatctggatttgtttaatgcaagacacacccgatgcatctatctcaccaatgcaacctcctctctagagcaggaattttcttcatagtctcactcaagatggccatttgcttccttgttggaaaattctgtgaatgggcagcattctagcaatactagacatctgttccataagttaagccacattccacctctctaaaatcaatactatttaataattagtttaaacgctttcatgtctcatcaccatcgctgggagacaattaattcttcctctggtccaactgtgtaaccacattgaacttgtcattgttcctgccacatgccaagctctatgctttgagcatttgccagtgctttcctatctgcctacaggctgcctctcacccttttcttctagaccaaatccaagtcattcctcaagtccccaataatgccattttcttaggaatctctttcttgattctctgtttaattatgtatttaacctctatcattccaactagattgtaatgtacatgtggggccaggctttcacctacctacttagtatgtgttctgtagacagttgttaagttgaactgaactggacagtggttctgtcatcttgagctatgtgaaataattcaggtccttgcaaactatatggagtaagttaggtctctcctccacacaatcaaatattcagccattcttccttgcgtctctcttttgtaggcttttcttccttgaataaatatccccagtttgactctgcttttttgccgtatttgtgatacaggttacccatctgagtgcatgggtctgtcagtaagactgagccacactgccttcaagttgcaattcagccaaggtctgggtcccttcgtttcttctaccagctttggccaagggtttgcttgacccaactaactagcttacaatatgtattacctttaatattactttttaaaaaaaataaaaataaggaccctcctgacctgggtgggagatccttgaaggcaggcacaaagtctcattcatttgtgtgtctgttgtggtatgatattggaacacacatgtgtcaaatattgattttcagtggcttcaatatcaggtgcattgcagtgtcagaaacattttcctaggcaaggtagcagacaggaagacccaggaattgtggccaggcagtggtgaaaatttaccctatttgtccaaatgaaagaaaatgctcccttcaaatgtttagaatagtccatccttacattaaatccgattatttaactcagtgtaggctttattttgacctttgacatgagtcaggaaagtatggcccatgggccaactcctatcttcgtgtattagtctgttttcacactgctataaagaactacctgagactgggtaatttataaggaaagaggtttaattgactcacagttccacatggctgggaagccctcaggaaacttaaaattatggcagaaggtgaagggaaagcaaggcacatcctacatggtggcaggagagagagagagaggaagggagggagggagggggagagagagaggaagggagggagggaggggggcagagagagagagaaaagaaagccacatactttttttttttttttttttgagacggagtctcgctccttcgcccaggccagagtgcagtggtgctatctcggctcactgcaagctccaactctcgggttcatgccattctcctgcctcagcctcccgagtagctgggactacaggcgcccgccacaaaaccaccagatttgtgaaaactcactcactaccatgtgtccctcatgatccaatcacccctcaccaggtccctccctggggattacaattatatagatgagatttgggtggggacacattgccaaaccatatcacctcatctgtcatctgtttttgtaaataaagtttcattaggacacagccacatgcatttgtttatgtgctgtcatggctgctttcacgctacaacagcggagtcaagtagctgcaacagaaaacccatggcctataaatagggttgccagataacacatggaaagcctgagataaaactaagaaaaaaaaaaaccagataaacagcgaatacatttttagtataagcacatctcaaatattgagcaggacacacttgtattaaaagaaaatatttactgtttatctgaaattgaaatgtaactgaactcctgtatttttatttgcataaatgaaacaactgtacatgtaaagcttaaaatgtttactctctggccttttatagaaagtttgctgggacctgagctccagtagtaataacaatgatgatggtaggaatagcaaggaataagactaaacatcataacggcagccactctcctttcgtttgtattatcagtgtcaatgcattgtattatttgatcctcaaagcatctgtcttaatgttgacacaggctctgcatcacagaatgaacaagtggtgatgcttaagaggacatctctgtgtcttcatttggcacatcccaatctaccctgggcccacctactcttttcagagggagatttgcatcttaccattttctttttccacaggtttatgtcatgccctttaggctctcctattctagaaacaaatcaaggcacccctgacccactaacatttgccgtatttcatttcttggttaactgactccatatgcttattatatgtgtcaaaaagtatattatttctggattattttatctgagcgttatttgtacatggcgtgttcacgtgcactgaaccacctccatgcagactagcagagacaccccgtggaaagccagattcagtgataagtgagcatttagttgggatgtcctcagggtgatcttctgactttctctactgttgtgatccagtcatctcttggcaaagcaacatattaattgtacattatagttcagccatctttctcaccaatgtatatgtgaaaattctttaataatgcattaaacagcaactggaatatgtaactaatttttactacttagtctatttcaagtgtttctgaactaaagtgaaggaatacttctgcctctatatgcagcaaatatcaaagagctgacccatgtaactattacaaaaaaaaatatcacggaggtagggtcttcaaggtgctcctaatcaatttttcacaacctcactaaagtatttgcttacattacagacagtagacgattacatttaaggaagaaggggatgggaagataaaatggcttcagaatgtgtttctgaagaatccagtttgctccttgactataggcagtgggaagcacattaatttacctgtgatattacaggttctttgatgtcaatgtgttactctgtccgtgctgtgaatttgcctttttcagccattagaaaagtacgagactgaaacctacggtctgttttcatgtgataaccttgacactggctactgtttggtagggggtttatgtcacggaggggtgctgacactctgtaagtaaaaaaggttaagcccaatagcaaagtgtgtattatgaaaagtccagtgttggaatttactaacttttaaggaaacttcaaccaaaatgctaaaacttcacaagtacaaagaagagctcgttaagcacaatttaattactcatgtgtgtaaaaatctacttcatgtaagtttaagtgccctgctcttcaaaatcaaccataaaacttgaaagtgtcagtcattcagataattggaaacatataaatttaaggaatgtgcagctgtaaaattaactactggactcatttgaaagactagatttactaaaggtaaaacctgctgttttccaaaacccttttttcctccatgattatgttgcaagggaagaaaaaaacaatcttcatcatacttcagtgaattttaatgttacatttttttgttgttgtttagtctttcgtccttgaatattgagaatggaaactaccatgtttatcatacttattttgaccttaaccttttttttttttttttttttttttttttttttttttaatgaaagagacttaaaacgtcccagctggtctgactcccagagagggggaggagacaatagcgaacacttcttcctgtgcaaatgtggagaagatgaagtgaaacccgagtgatttaagtgaactgtggagcagtcatattattgtatttgcgaagaatctagaaagctgttttttaaaattgtaagatgattgtaattttcaaaatgacaagaagaaatgcacagcaatacaccaattcagggattgtctgtttcctttagaataccatttgcaatgtgctttaatttatgctctgttggattggtacaaaaggaggaattttacagataggtaaactgggggaggctgaaatgtcataaaacagagttgcttctgaagtttggcttaattgtcaaggagtaaaaatttattccaaattaaaattcctctgcaaagaactaaaaatatcaagaattagtcagagtctgtaatctaaaaagaaaaaggaaaaaccaccttatctggtggaatttagcggttaaccctcaccttagcaatccaagtgttttgaattcccaaaatggactctcttttaatatgcttaagccttatttgttggtagagatcttactgaagactgtatttgatccattcaccttcattgacataaacccaccataaccttcttggaaaacgttacgcagtttgagctttttgcagggagttggtttggcttttaatgtgtaataagaagaggggaaagatcccatatccacacttccttatattaaatggctggatttttttggctacagatatgacccaccttgtctgaacgccagcccttggcgtgtaggctagcgatgtcctaggagacaaggaaatctaagttagaaagttgtcaaatggggacaggcatctgtaaaagttagaacactgccaaagatagggccactgggaggctctgcaggatggcagcaagccctcctcctcattggtctgcccctcacctttggtgatacccgtcagagaagaagtggttctgagaaggatgaacttctggaaaagcgtgaaatgagaagaggcagagtttgggggatcttcctcagtatgagtggggtggctgtggtgtgcatagtttggagttggggaacccaagtctcatgattcggcttagcccatttcagagtcctagactacctcagtcacaggttccagtccctccatcctttggaaattaataatttcgtagatacagctttttgcacaaaagatttttagatgaaatatgagctctgcctcttcttcatggacttagaacaatccatgttatttttggggagaatagcagattattggaatcacctggcacaattcacaaaattgctgggaaatattggatagctgtgaattttttttaagtcattaatatttcagtcactctgatagtcatcagatgtaattctctccagatgaaaaaatgggctctatcgttatttgaatacaaaaaataagaactcagaggtataaatgtatatatatatatgatatttatcttgatttgatagaattttttttccaagaggaatattatctgagcctcaaatacaattgacttttaatgatctaagagtgaaaacagttaatactcactaagaattttgattacatttcttaaattgtaagctattgataaataatttatgtttatgtaagtggtaataacctaaattattaggatgttcaaagtgaacaatatttataggtttataactcctccttttcctactccattaatttactgaatgcttaccatgtgtcaagcactgtgttaagctctttatatatagtatctcattgatttctcacagcaatcctgtgaaataattattattagaattatttagtagattaagaaagtaaggcactgtgttattaagctgaatcttatgatattgtcatttttatgggttgaacatacccagacactggcagtttcacaggggtccacctagtataattttattataatgatttattacataaatttggatttagcactgatcaaatcatattgccaatactcacctcctcacctaaaaatttgagatagagagaccagtgtggaagggacatccttttccagttctcagatttctttaaaattccaaatttacattatgctaagtaatatcgtgctgtgttttttgtaaatgttaagtcttccagaacaacttacatattacagagttgctcattaaagctggggaatgtcacaaaacagagaagctctccttggccggaaatgacaataatttaccatgcctatacactaatatgatgtggtgttctgtgttcttttctgaatacccacatacaccatagtttcaaggggagtagtttttagttcagggagaagtttttagttcagcatggagtgttttcaccaaaagcatattgaatttggtatatcagcatattagcaaagtgggtttaagctaaaatttgaaaaggtagaagcatattttaacgtggatttgggtatactttttttttcttctttgcatcttattcattttttaaaatcagagataaaagcatgtacgtttcctttctccctctttgagggagggaactcttaaggtggttttctttgtcttgggtacagaggaaggggatggggtggtaggcgagaaagatttaaggaggtaaaaaggactgactattctttctaaaaagagtgatcttccaggcattttaatggcttagaaacagacagttgttggtgcccctttgttttcaagctgatttgatttttcatggcttgggccagtgtttggaaataattcatcagaagatgtcaggatgaacaagagacacattagagtcaaacagcctttgacatgtcatacttctgttgctctgagatttttaattttgaaattttagaaagataaactaaccggaaaaacagtgatccacagcctcaaaaatacttactgtcatgtccaatttcccattccttgtgtcccatggggcacatatgggaagctccattgcaccttttaaagtgagaccaagaatattttgatgtcaagggcatagactaagttcatcagtattacagtcacctaagatcatgttagcatcaaaaagtttcctggtacccccagttttaataattatcagcgccttctattatgtaggtacaaaaacacctgaagatgataaaagtatgtttaaaactctgaggataattaaattatgttcatctggctttttagcttcgtgactgtgtttcaatttgtaaatgttataactgttttaaatttttttttctctagcaagctgcaaacttttgaagacattaagcctgccaaattatagccacttatttctgcctgacgtatttttcagcttagaaccacagagggactgccaagcctgttccttttcattacctgttctgtgtctggccccgagtttagattttcgaaaatggaaaaaagctgtttgcaaaatcacaaggctcttgagctcttagtttcttcttagtatcaacatttatttatttaggtttgggctgggtttcaaaagattgaaattggaaacagagaaggtgactctgaacaccatttatctgtatataagcgaacgttcgatgtacgtttaatttaaaaaattgctgtttcctacaagagggagctatttttcacattgttacaacatttttagaggtcactaggtggtcatgtcaccagcagggagtttttgtttggcaggcagcattggcagttagttacaaatgcctcccatgattcagtgttcaaagggggctgctttgcaagtaacaaatacttacaacctgagaactgaagtataaaaagtagtgacaggggaaaatgtttggaaatgtaaaacagcatctttagtggccaaattggggtgttcggggagttgaagattacatgtctactttatacttgagcttagcgtttacagaagcaataatgccttaactaccgcagttggctgtcaccttgcttctagttagcaagtgctcttaatttgtgatttgttggttctcatgctttggagtatcactgaggttcctgacaataatctttattaacctcatcccctgcatttgccatcctggtagttactcaacctgtgcctctcggtcattcctcatcgtgaatgctggtaacttaagcaagattaagtgggcagctaaaagcaccaattactgtggtttcttctaggcttccatatttacagacaaaccagtatttcaaatttgggataagagagttataatccctctttatgggggaaataaataaatgaagtgcagatggatctttgaggaaatggctaagatgaaaaaaaaaaaagaagatgaatagccaatcactaggactgtgagcattttatttataattactttttaagtataaaaatggagattaatttgtgcctccatatcaggacaattgctgtgtctccttccccacctccacttttgtttaactaaggaatgacctaaagaatgcagctgtcacttaagaatacaatacagttattttgctatattagtacagcttatgggttatagatactttagcttttttaagctaaaagctaaattaattcagtttcagtgaagaattgtcatggctcatgttgcgctgtttaggatagaaaaacctaagaatctcagacttctttaatggacaaaggaagatatttagcatctgttatttgtagttcaaagagaaactacaaataaattgataggactttcatttatttgatcatagcagttcattgatatttttctattactcttgtgagatttaaatttttttttttatgtaagaatggataactgtcatagccacgcagggtttttttctcaagcaaattaaattcatatttataatgacattttgctacttctttaatcctttgcagaaagctttttggctctgaagagccgttgaaatattgagtttggatatccaaaagaatcctgctaggtgattaaagaaaaggaagccaaaatctagagtagaaatgtcttagttacactgtcatttttataatgcagttctttttgcatttatctgaaaaattaattttccctctccaatttacatctgcttaagcctgtggcagtggaattgtgataccatggtaaacactagaaatgtattgaatctgtagataaaagtacagaaaacagaaaataaaatattttctctcctggttttttaaatagttttctcaaaaaaaaaaatagttttcttatctgtagagatcggtgatttgaacatatttatcttgtagccgataataacttaatgaaccacactcatagtaatggtaaaaaataactatagcttgcatttataataataataactgcttgttatacaaccaactaaatgtgctaaatggtttacatatttatcttatataatacctcataagtgtattaggattctcattttacagatgaagaaactgagattcaaagagttaattagctttcccaaaatcacaccaatggcagtggtgcagaaccagaatttaaacccagatttgtggaatcccattcattgattcaacaaatattaattgcaagtttggtgcatttagaaaaactgatcattgtttaagtttatttagaagcagccattctctttcttgccaatggattattgtcagatctctcaatgaaccactggaaaaggaaaactcttttgtgcctcctccagatagtcgttttccgttcgtgaatttatgtttgccccagtgaaattcccattagccattcggactggtgattttacaccaacttgatgagtttggcttagtcaatagaagcagtgcctagcacatggtgtgtccataccagctagtgtttcaaatgaatccaattgcaccatcaccatttgggtcccagggggccacagctttgtgagtagggatgcccctgatagtaatgcccaccattcctgtggggttttgcagttttccagatgctttcctgtgggggatcttctgtgaacctcttagtgacctcgggggtaggtaatatcatttttattttatagattcccacagctaagatacgtaaagtcaagtgacttgtcaaaggcacatatataaaattggatgactgtctttctatgttacccctgttttctgttttctatgccttatagtattggcagtgggattggggggaagtatgttgaaggttcagacttctctcccctttctcactggaattgagaaatcacagcccatccaggagcaaccatgtgatctgctctgcccaccgagttctgaagtattgctgtcacccacttggggagttccagcagtgtgcattgtgagtctctctcttccccatggacttggttagcaactttgtgatttggcttcagtccttgggcatccctagaaatgaaataaatatacaatcaaatgaaataaacatccgagcaccagttgtagagctgcggtcggctgctcttactgacggcagcattgtgactgagggggtggtcctcttatcggaattcagccaacttctcacttgattcaaagtgaatctgttttttctgtgtcaagagtatctcaacttagaacaatgctagacataatctattttattttgagacataaaattataaatacccgggttcgaatctctactttgccatctactagccatgtaaacttgagtaagttaattcactcctttctgcctctcttttcttatctgtcaaatgggaacataatggcaccttcctcattagattgttgtgcagctcaaatgagttagtacacataaaggacttagaatggtatagtctttggcacagaaaatgtgctggtgtgtgttagctatgtatttcctattgtaggctctatggcctgtcccttgttcagcagtcttggcaaaactgttcaattatcttgaaacaggccaatagagcgctggtaaaccaggtcaatagaaaaaacaaaatccctgattggtagtgattgccaatttccatcgtgtaaatacttctaccatggccaaggtacaggctgacccttgtcagttggaaggagatgcacataattgactctcgctagctagcagccagctccagcacaccatagaaatagaccccttagctgtaagatcattagagagctgccaattaggatgaccctcagctcatagctgtccctttttcttttggtgtgatcccattatttagggtgtgtttctagtgatggggaaatcaggccataactgattgacctaggtggggctaacagattttctttccaggaaggtcaaacattactctttttccattaagcctggaggttgtaacaaagttattctgtaaacagtaggtcttctgaagaaaggtttaggatttcctgctactgagggtactggagcaactttctcactgaccctcctaaagctcacttgttagctcttttcttttcctcagtttattcaagtatccctctaacacttcctctttttgctaagttagccagaattagtttcttttgcttgcaatccaaataaacccaaccaaagcatgtgtttagtcacatcattcctccattgttagaattatttccctgggattttctcgacattgccttctgttgtttgtaccaacactgtcagagatgggtatgagggagcccaggccattgctgacagctctgacttagccagagttgctcctgttactaacttggcctcagccttacctacttgtgactttcatccttaagtcctagttcaaatcttagggtgcccctggagcaagcctcatctatgttactctagcagataattgaagggataactaccatgttcccaagtcttctctgttgctgattactcccacattcatattccaccaatatatatatacatattgtgctaaaatccaacaaaatgaacaaacgaaagagaggcagagtatgtcatattttacactaggcccttcttgccacctttagaaataattttcctaaagattggcattgaccaactcagcttttctttccttctgtggtcactgaagacccctagaaggacctggagctcgagctcttgtctgatggggcctatttgtgaaataaagagattattctccacttatatcctaaagataccatattggaaacagacattggcaaagggacggtcactcagtacaaacaatttgggttcaacatggcatttataaggcagccagcttggaagtgccaaacacttttcacaaggaaagcccttacctatgcagaacagaagaggatgttcctcacacataccctgatagtaacatgcagcaatcacgtgaatgttttccagaccgtggaagtcatggaccaatcataggaaaaaatattttttgccaacaacatatgcttgctaacctaattaagctattaaataagactattcaagtgttaactattatcatcatcatttgagaaagggtcattttaattccaaacattagaaaggacattactgaatgtcacaataaaaagctgctgttccccagaaaacaacttacacataatgttcctacatcctcatgtgtgcatgcgggcatgcgtgaaaacgtcagcactggccaaaccagtctttccgttggcacttaaggcattctttatttgaccacatttcttccttggtggtggtattctagcatccttgaaagttatgcaactaggaacaggcataagtaagcaaaagagaattttaatcgactgaatcatctcaactctcaatcagacacttaccccatctggaagccactcttttccttccagagcccttccattcctaccctcccttcatactcagctgtcacccttatcctctgtgaagcctgcccccatcatcccggaccaaagggacatttcttccttcctgcaaccaagaattgaaagggccaagtttagtctttaacatcacagacttggatacaaattccagttctccttttaaaagcaatgggaccttggacaaccttaaatattacagtctcagtttactcaactttacaaggggtgtaataaaactttctcttggaaggctattttgagcagactaaatgaaacaacgtactttacttatgccttgcttatacatatagtaatcaaaataataattattaacaatttcttatcctgtatcttaacaatgaagatgttaataaactattatttatcttttattttattatttaagtctttatataatttaagtctttttctttaccagatcagtttgcaagccttacccattgctgatccttcataacacgtagcatcgtattctgtccatagtaaattctctttgaaaatggtagaaattaagacactggttaacaacattagactgctcttttaagccaccacctataggtatgcagtcatccttaaagatatcttttcattatgcccctcttcaatgggatcttgaatccctttgtgtccggagttggctcctgctggtgggttcgtggtctcaccgacttcaagaatgaagtcgtagaccttcgcagtgagtgttacaactcttaaagatggcactgatccaaagagtgggcagtagcaaggtttattgtgaagagtgaagggacaaagcttccacagcgtggaaggggacccaagtgggttgccgctgctggctggggtggccagattttattcccttattgtccccgcccatgttctgtttctgtcctatcggagtgcccgtttttcaatcctccctgcaattggctacttttagaatcctgctgattggtgtgtttcacagagcactgattggtgcgttttatagagcgctgattggtgcattttacagagcactgattggtgcattttacaatcctcttgtgagacagaaaagttcctgattggtgctttttacaatcctcttgtcagaaaagttccccaagtccccactcaacccaggaagtccagctggcctcacctctcaccttaagggttctccagccccattcttccttgacccctgccttatgtcccatgccttgaagttcaaatctaagcaggggtgctttgttgttggtcagtggagctgggaagcctcaaggttgtccagggagatagatggtctgatctcagcattcaacagatcggtattgcagggagtggtagtcagtgtcaggttggagtctggtcaccaggatgttttctcactaagtggttttccaggcctgggggcctcttttacaggactgagttctgtcacttctctgggttcctaggcctccttcccccacctccaatttgtgcaaaaggccttctgcagactgggttaattacctctagtggtcagtcttgggtgtatgttgaatattgtggagagggaattacctcaaccttttacatctctgaggatataaaattataaagatttaaaatgatctatgggcatgtgttgtaagcaaacaaagaaaccaataaaactccttgtattttggaagactattgggttgaaccatacaaaatttctgatattcaattgtttctgacccataaaaaagtgaacttgaacttcgtattattcggcctagtagctatgactatgaggtttcatgtttctgtttatttgtttattttgagcttctgattgcaactggattatactaggcattcgggatgaagaggatgggctgggagggagcttttgaattgattatcctagtatttgatacatgcagagggaaatgccacatggattctttgcccagcatttgaattgggaaacaggattcagggatatcttctttgcacggtattgctgatgatccagcatttgctcatgatggtaatagaagggtgtttctttgtgtctggtggcatcatcacagggtctgtctgtctcatgactgtggacaatctctgggttctgctgtggtagcaatctctgggttctgctgtggtagcagtctctgagttctgctgttagagaagcagggatggtttctgtcttgcttgtccccattcatccctggtacgtggtacacagtggtcactcagtaaatatgtggtgaatgagttggagaaattgatgaactgcctctgaccacctggatggtttatttttgcttatgtggccagtaaatagccaccctagaggaacatattcagtttagctgcttcaggttggagttcataatttcatatctgaaatgttcctgcttccagtaatcgctcctcccagggtggaaatttcacttctgtgagccacaaggccacccatcctgtaaatctgagactgctttctataccattgtttcttgggctggctcccttgcgattctttccagatgtggagctcctccaggtagtttaccagaccctttccttctgcagctgctgtctggtttcaggttccttcaaactctgggaaggagcactccagtagcatcccacaaattgtattcatgagtccagaaatttcaggtaactaacaaatataactttttataatttaggaatacataagctgagtcttgcagctctttgtttggcctgtcttttgaaccgttgcttagcagtgcaaggcttcaggtgtatgtatgtagacgcatagttctatacttctgtaacttgggctctgaaattaatttgtggtcattgagtatgctcttgtgcctcctcttcatttgaaggctgtgatgcattggtgaaactttgcaaaggcaatggccacatgtatttgctttctgttctgttgacacaatcaacaagatcatgattaatgagtgtgcattagataggcttagtgtgttttcatagtggcgttttaaccatttcttcccaacacagaactattataaattttgtctcatttcttttccttacggcgtggaataaagtatttctaatctcactcatttggactttcagttatttccagaaaagcaatttcccttagttttcaggtatgaagccccctttggtttgacaatctattttattctgggtgttctcttagcaaatgtatggcaagtacagaaatgctgagactgtcattcatttggaagaaactctgtgtccattaaatgacctctttaaaaaaaaaacaggcacctaaaacttccctgtcacctcttaactgacttcttagtagtcccaatcctgtattaaatgataatttgatagctaattatttgaaactagactttagtcaaagaatgaaaaatgtcagcagaatggggatttgaatatgaaatgtcctagctccccctgaatcatggatctctctcccatgtgtaatgtttatttttttaaataagcattctttctggtaccttttctgaatatagattattagagatgtaactacagaaaaaaattgaaaagggcaatatttattgcaatggccacaagatggcagacctaaaatccagacttcacaaagtaatttagacatttacatgaagaattgcatctttgagcatctttgaggatgccttaaaagccatcagtttccttcaccctcccaaaatgtctcctctaggttgtcttgaattgctgtccagctctgtggcaggcacaacaagggagaacagctttgattaacattgaatcaacagctttgataaacagatgggaatctgtttagcccctctcccagaagggatcagaccttcctgcccctcgcagaaacctgccctttgcctggctaccaccatcacctgcagcacacacagacatgccaccctgtgtttccttctcctttgcagaagcacaactgccttttcccttctcatgaattaaaactctctcaaaggagctgcctccaataaactcacttttatgtttttctctctacaaagatccactccaggctgggtgcagtggctcatgcctgtaatctcagcactttgggaggccgatcacctgaggtgggcggatcacctgaggtcgggagttcgagaccagcctggataacatggtgaaaccccgtctctactaaaactacaaaaattaactgggcatggtggtgcatgcctgtaatctcagctactcgggaggctgaggcaggagaatcgcttgaacccgggaggcagaggatgcagtgagccgagatgatgccactgcactccagcctgggtgacagagcaagacttcatttaaaaaaaaaaatccactccacagaaccttaattcaattttatttgaatgttgcgctaacagaattccagaatgtgcccccttctgcacatattcttctcacagcaatggcatgacgatctgttttgttttgtattacaatttagcctgtgggaatgttctattccatgtaaacataaacaatggaaggtttgatttaacacaaaatattcaaattaagaagggaaatatgtagttcaagatgtaggcggacaatttgctgctctgtgcaaagactgagaaataaatattagcagctttaaatatacaatagaggcgaaattaaaacatattgtttttagagagacttacatatatacacacacataacctcacttcaccaataagaaaaaaataattgattggatgctatgggggctaagccttgatgtcagtgacctattttctggtagttactcatttccaaccaaaaagttaatgcaatacgacagtctcttgacagtaactgatcacccatggacaataggtttagtttaggcagatactggacaaagctctgtcctgcagtgaagtccagatgtatttggttttctcattatcactcatctataacctgccagagattctggttaggtgtatttcacatagaaagctaccttggcagaattgaatggtcaacagagaggctttcttattactgaacgggaataacaagaatgaccaagcaccatcatctaacattaccactaacagagggtattgcagtatgtcatggaagtcccttcatttcactcaccctccctgcttcctagatttaccaattttttaaaatatttttttccaatggaagaatcttttattttgaatttgtttgattttgcacttgactttgactttttaaaagtcgcctttcagaacacatttccatttctcagtttcttaaactatgtgacatcatgtcttgcctatttcccacgtggcctttcctatcaatttggatggaatgatattggacagttatagaccaagtcaagcctggcttgtctgggatgcaactcttctgtggtcagcagactcctctccaaagtctgttttcttctttatgtctgtttatggagcagatgtcaactcatgaaagtcaaatgtgcagcttaacagaaaccaattttaaaggcctctctgaaagtttgtcttgaaagtaagagaccagtgagcatgtttagatatattcactataaaggggagctcatagaaagtaatgcaaaacctttgaatctttaactttggtggggtctgtgtcatttaataagcaaatgctagcatttcttgtgtggtcatctcaggcactgaacaaaatctttacatgcgtgatcccttaattctcacgatgatccggttaccggtagagggtcttgactgcaagttgtccaggttcttggagttttgaacaaagaattggacaaaacacaaagcaaagcaaggaaagaataaagcaacaaaagaatgaaagcagggatttattgaaaatgaaagtacactccacagggtgggagcaggcccaagcagtggctacagggcctggatacagaatcttctcaggttcaaatacctcctagaagtttcccattgaccacttggtgctcacctcatgtaaatgaagcggtggcccgcaatcggtctgaaagcaaccaatcagagcctgaagtgaagttacaaaggtcacattcctgtgcaaacatctgattggttgcaaccaatcagaggctaaggtgaagttacaaagttgcacttctttttgtttgtttgttttgctttttgtttttttcatatttgtttttgtttttgagatggagtttccctcttgttgcccaggctggagtgcagtggtgtgatctcaacctcctctcactgcaacctccccctgctgggttccagtgattctcctgtgtcagcctcctgagtagctgagattacaggtgtccgctaccacgcccagctaattttttgtatttttagtagagatggggtttcaccatgttggccaggttggtctcgaactcctgacctcaggtgatacacccacctcggcctcccaaagtgctgggattacaggcatgatccaccatgcctggccacaaagttgcacttctatgcaaatgaagactgggctggcaatcagtctgattggttgcagacagccaacttcccatctgccatgcagaaaaggtgggagtttgcaaacggagtaacctttggtccttttgttacttaggcatggaaaattagggttttccttttaatttagttctaggaagttggagtgaaatggccttcggttccctgcctccaccatattctcctacctcaatccaagagagagttatgattgtccatcttaggttatttatgaggaacttgaagtttcagagacagtgagtaacttacccagggccacagtcaaaaggttatccctgagattcaaactcaggtacatttgcttccaaagccccagcactaaataaagatcagtacctcctcctcttaaaaacttgagtaatatttcatttgtgtgggtatgttttttaaaaaatcataataggctaaagtgctcaaaagaagtattttctttttttcttgtttcttttttttttttttttttttggtggatcaggcacatagtaatgagcaatgcctcacacatgtccactgccaagacctgggacaatggtccctcccatccttcattgcctttttatcaattctctagaaggacaggattcaagagaaacatttagaatagggggaatagctcttcctggcactcctcctctggccttggaccttttctatgtgggaaaatcagttggcttcagacttactgatttgtagcaggatgccaaatgatgctggcatttgccctcttagtgccctgaagcacatgacgttggcacttgagagtgttctggtccagttggagaaactggaggaaccgccggatgggccagccacctccctggctcatgcactgagcaaggaacagggtagaagctggtgcttagagtaaagaacttccacaagactccatggcccccgtgttaggaaattccagtcatgtgctattaggtttcaaagacagaattctccgtaattggagtaaactatttttttgaggtcagttttaggtgggcaacagggagcaaaccacattaagaagtctgggctgccaaagcctggcctttacgaatctggtctgttctttgtccttactgaaactcatgcttgttcaaatatatctcaccctgtgggccccacctcatgtgagctgctttgctttctgcatggccccttctgcatatatcatacatcattctgctggtgggtagggttgatattaattgatatcaaagaacttttctttctcaagatgccatttgaaaacacagcttttaaaatttaggcaaatgaacatctatctccacccaaccctcaccccaagggtgagagagaggctgttttgaataggatctttcgtcaccatctgtctgaagtcacctcctactgaacttacagttgaatattcagggtcatgagggaaagaaaatagtaattagctgagaaaagttgattgagcggactttttccccccacaatatgattagaacatgactgcctgggctaagcaccatacataatgtaggctttctcttatatgtcattatccaaacattcttaatggaatgcattttttaagcatctgcttttgtaattgaatgcattcctaaagatgggtcagctaactaaaacaagaacccacaagaaacaatgtgttaatgcttcttcccaaatccaatttgtaatagttcctaattggcctgcctcatttgcaactcctgaaattaattttagatcctctttcagagctcaaatcatcattaatagaacgacagcaatggggagtgaagtagaaatgtttacaaagctcccttttaaatggactgtgataagtgaggtagccatgtattaccatcagaggatcctggaactctctttgtgagggctagccacaggcgacactcaaaagaaggcatttatcttggcaggagatgcccttcagccctgttttgttttattccatggaaggttttgtttttttttttttcagggtggctaaaaccattttttttggtgttttattagctgtatcttgactacctcctacacactgaatgacagtttagggttattaaatgtgttcttgcacatatttttatccactgttaatcctgactaaatgtatgacagggcacagaatttcccccttttttcctctattgttgcccatatttgttaaagaaattattccccttgacatttgtttaggctgcacgttgataaaatgctgtctatgatacactttcttagcttggcattcagcagacttttatagatttatttctcttcacattatcttatcttccttcctagtatatgtgggcttccttttcatattttaagctacattttggggcatagacagatcaccttagtaattggtacttgaggatggcaatgttctcaagataattttgcaagcctttggtatatacttaaacctactaactgtctaagaatgggcatatatgtactttccgtgttgtctgtaaaaaggcaaaagggatagattgaacatgatttcaggcttatggaactctcttcaggttgatgggacagtaataatttctgaagcaatataaatctggtcttgattctagaaggtaatgctttcattggggaaaataatgatttttctgtttccggtttatatccaagtgtcttgtcactggtatactctttaaacttgagcctttaaaaaaaagtggtgcatcagaactggtggtattttagtttttccagtttttcaatggctggaccaaaatttgccgcgagaaaaaaaaaagcaaggatatttaatgtaagcttcctaatctatttcaatgtgattttcttggtaggtgatttctgccaatgtatcagcaaattggctcatgggaactgtgaaagtgtagaatctgacgtagggatagcaaaatgaaattcgtttttataaaattatattcagtatacccatcctcaaaacaaatctgacctttaaggcagggataatgaaaacccataactatacataattagctcacagtgatttaaattacaggttgagtatccctcatctggaatgcttgggaccagaagtatttcagatttcatatttttttcagattttggaatatttgtattacacttaccaactgagtgtctcaaatccaaaaatccagaacgctgcaatgagcattgtctttgaatgtcctgttggtgctcaaagcatctaggattttggagtactttggatttggggtttttggatttgggatgttcaacctgtcttagctaaattctattagcttaagaaagaggtattttaactcagttttaaaaacttcttgcttcaaaaaccaaattcaatggctctgttagcctggaattaagatttagtttaattctaggcctgccaaatctatacaaataggtaatagccagataagccttaacatattcagaataccttgccaaatatcctgaagtatgaaatgttcttatttctctagttttatatacctttttatcttatactaatgaccctttgatttaaatggactagaattattgaatgtagatctcaatcaaggtatttttggggaaaatatcattagtttatggccagtatttaaatgagggtttcaaaatatagataatcttagttacactaattttatttagagttctatgattatataatgccaatatctataaaaatagatttgttagccaaaagcaaaacaaaataaaacaaaaatacaataaggagaaggttacaaagagcaaactagattattttatatgaatattaatttaaggttggtgagtggctttaaatgtaattttattaaaaagattttaaatgtactttgagatttgataattaaggctaatttgacttggaactgtatttaatgacatttatagagaattagaaattgatatatgtttttctctgacagtaaagtgagaattagaaattaattcattgggattttttatggtattatgagaggataaataagtgttaaagcttaaaagcctaaattttagaatcatacacaaaaacaagcaatggggaaaggattccctatttaacaaatggtgttgggaagcctggctagccacatgcaggaaactgaaactgaaccccttccttacaccttgtacaaaaattaattcaagatggattaaagactgaaatgtaagacctaaaaccataaaaactctagaagaaaacctaggcaataccattaaggacataggcatgagcaaagacttcataacgaaaacaccaaaagcaatggcaacaaaagccaaaattgacaaatgggatctaattaaactaaagagcttttgcacagcaaaagaaactatcgtcagagtgaacaggcaacctacagaatgggagaaaatttttgcaatctacccacctgacaaaggactaatatccagattctacaaagaacttaaataaatttacaagaaaaaaaacaaccccacaaaaagtgggcaaaggatatgaacagacacttctcaaaagcagacatttatgcagccaacaaacatattcaaaaaagctcatcatcactggtcatcagagaaatgcaaatcaaaaccacaatgacgtactatctcacaccagttagaatggcgatcattaaaaagtcaggaaacaacagatgctggagaggatgtggagaaataggaaggcttttgcactgttggtgggagtgtaaattagttcaaccattgtggaagacggtgtggcgattcctcaaggatctagaaccagaaataccatttgacccagcaatcccattactgggtatatacccaaaggattataaatcattctacaataaagacacatgcacatgtatgtttattgcggcactattcacaatagcaaagacttgggaccaacccaaatgcccatcaatgatagactggataaagaaaatgtggcacatatacaccatggaatagtatgcagccataaaaaagatgagctcatgtcctttgcagggacatggatgaagctggaaaccatcattctcagcaaactaacacaagaacagaaaaccaaacactgcatgttctcactcataggtgggagttgaacaatgagaacacatggacacagggaggggaacatcacacactggggcctgtcaggggttggtgggctagtggagggagagcattagggaaatacctaatgtagatgatgggttaatgggtgcagcaaaccaccatggcatgtatatatctatgtaacaaacctgcacattctgcacatgtgcaccagaacttaaagtaaaataattttaaaaaatgattgttttttggttgatgatgacttttgacagtgattaaagctatataatctcaaattttgacgtagaaaaggaaaatgggttaaagcaggctgaaagtagacacagggagtctggttcggagactactacagttttccaagtggtagatgatgtagattgtatcagacattgtgtgtgtgtgaaaatatgtgtgtgtgcctatctgtgcatgaagaatggaaggacagacagaacatattatagatagcctgggtgggaaaatgagcaaattatatacctgctaagattttgaaccatgtacctgctgtttacttgatgaccgaaagcttaacttacaagttttaaatgtttactcttaggatattttctaagaataatgcttaaaagtataagcagaaaaaagttaaaaaatgtcttattcatcctgtcaccttgaaatggtgattattatcattttggtatacttccttcctgtccttgttttttcctatgagtatagctttatgttttagggattatcttggatatatatacatttgtatgtcgaaaactatgaagggtctgagatcttccctactggcatcctaacaagttagcctgcctcagttccatggatgcaggcagatgacaagagacttctgggccaaagataaaggactttattgctcatggcacagagtgaagaattagtatatttgtgtcaattttcctagctccaagtcccatggaggccagtcggatggactggatgaacacatacatgtagtcatttgtattataggagggcaaccctgagattagagaatctgaatattttataatgggcagtaacatgcctgccttttgctctggaaggagacactattatatggggcagtaagcgtgtcttccctttgatccaaaaagaaataccacctctgtctttcaaagctagtcactatacaaacggccttgaaagtttgtcataaaagaaaatagtgcctgtgcttgtaaaatgtacagaaacatgagagactcatagagaattgtttctcaacaaacataaatattttcacatcactaaggttttttaatcagcattttaaatacctgcatatgtctgtaaagatgccgttgtagaggtgtagtcaatttacctccaatccccaattttcctaatatcggtcctttagtttgttttcattaaaaaagcttcacttagatatttcagtttgcaacagaggggataaaatattgcagtcaccttgtgtgttgtagctaaagtttggaatagcagatagcaaataggctctccccgatttaaagtctgtatagcctcttcagcttcgccctctgtataaatatgcactggctgggagccgcaagcatgtctattgtctcagctgttatccaaaggcagacaggctctgtgaagctggatattaatgctgctgccggtagtccagcctgcactgcttttcttctggaaaatggagatatttcctgacatgttctgctgctcacacatctgcgtgagcttcaaacagaagctcctactaccaggcattagtggggcccagaaaactccatataaatccctgcagtgaaaaggggaataatctgagatccaaataatgaccaccttgtccaaacatctggagagggcctggtctggtgatggagattaaagaaaggcaaaacaggatcatgaccaggttttagtcctgggccttgtgtgcgagggaagttcccaatgtggaggcttccttggggctgtggggtcttccaaagtgtctagaatgtttcagaagagacacaaatggtggagataagactttcccagtggaaaggaagattcagtgaaacacacccaggagagctatttcctacgcaaaaatcatcccagaaaattccaggttaaaatttgtgacagatgtggtcataaaattatactgtaaagattgaaggaggcaactttaaaactttttgaataagcgatgactgtaggttaagcaggaagcaaagcattctaattttttttaaatgagaggaagaggtgtctggtgatatctttaaaagtctgtaaaaagtaaaaaatgaacttacctcttccttgaactaacatttttgagcactcgctatgtgctgagggatcttctagaagcttgagaattggtggtgcacaagatcgatgaggtcccaatttcatggagcgtcaagtctagaaagcaaataataaataagatgctatcaaatggcaaagagttctataaaaaaaatgaagtagtgtaatgtgacagatgaccgacttggacatgaggtggtctaagtcagtggtcagtcacagacctggaagataagagctgtgtgaggcaaaagcatagaaaggcaaagcctgtgatgtgaggggacaagggtaacatttttgaggactagcagagacctggaacgaaatgtgctggagcctaatgattgaggaaggagaagaggaacagaggccctcagagaggttgtcatggctgattagcgtaatgtgttgcaagcatcaataaaaggtctggatttcaagtctaaagagtgatgcaatggatctttacacaatagaatggtggaatctgggcttataatgttttgaaagatgactttactctctttaccagagagatcaatgagtaagcttttgtagtggtccccagtgagtgatgctgatggttcgtagatgtttttatagtagtgcatgagtttagataaggggcatactttcaagtaaaacctactgaagttgtcagtggattggctctggatagagaaagaaggaaagaactcagggatgacttctaagttcagggtttgcactacttagtggatggtagtgtaattactgaaataaggaaggctgaggaagtaatcgtttttggtgggatggcaaaggagcatcactaaatgcattgaaaatagaacagggtttccagtaaatttctctgcctgccttcaaaagaaaatcttgcattaaaaaagtaataggtgaaattgctacccagttttgggggggttttcgcagagtatctagaagcttacttggtgctatagtttgaatgtatcccccaaaagttcatatgatggaaacttaattaccaatataacagtattaaaaggcaggggcattaaggggtgcttagatcatgaggatcatgagggtggagccctcacaaatggactaattatcttgtctcaggagtaaattagttcttgagagagcaggttgttataaaaggaagctttgcttgatcttgtggtctctttcacgcttgctcacttgtccttctactttggtctctttcacacttgctcacttgtccttctacttttcttgccatgttagtacaaaagcccttgctggaagctaccaccatgcccttaaacttcccaatctccagaatcatgagccaaataaacatcttttctttataaattatgcagtctcagacattactttgtaacaacataaaacagactaagactcttggcaaattgatggatggatagatgaatatatgtatgtttggttggatgggtggataaatgtgtcagcaatgaatgctcagatttgtcccttcccatttataacatgtgaagccattaaaagattcctctctcagtggctgcagtgtgcagtctcagggattctgacccaaactactttgtccattctgaaagccaaagagctagtttgttttaagtagtattcataatttctttccattgagacaatactctgtggttcatttcaactataaatgccaattgtttgtttttttttttattttacaaaaatgatctcaataatctttattttaccagacaggaagcactacttgcagccatcagtgaaaaagatgcaaacattgccttgctggaattgtctgcctccaaaaagaaaaagacgcaggaagaagtcatggccctcaagcgggaaaaagaccgactagtacatcaattaaagcagcaggtggggcctcctgcaagacaggtgtgtttttctgggtttggggctttgggggctttctctggattttagccactcttcattttcccatgtccatcctgtgggctcaagctcctaaaaccaggtaggagtgcaatggacccagttgtcgctgcaacaccattttactgcttttctgtgtttatgtgcatgtggctgggcttgtgtggtttgcaaccagtgctgttttcctttcttttgtgtcagcgtcatctccccagaaatagctctcaactttctttcctccagtggactttgtttgacttctgattaaattctagaaacttataatttaaattctgggcaaaattctttcctgttggacctgttaccttccgtcttgctcattttctggtccctgtaaagaattgccctcatccaggtttttaggtttcattccctattctttcaactttagttctttgactatttcctccaatacctttcagccaaggagcatctcccaggttctagcactgccagactatgcttagagaccacccagccattcttcactctatttttaaaaaatcacctgtttgccccgttatcctgtgttttcacccctctaggccactgtatttgttttgagggacatggaagcaggggcatagttctaacttgtgcagaaaattccttgctctctggaaggttttctggaagtggcttaaatggaaataattacacctgaagtatattggaaaatcatccatgaaattttcagatgatatttctcctcctcatattacttggtgactcttgtaagcaatgattgaagatattcactaagattcgagttcattatgaaactcagtcagctcaatggtttatggccttgcagagtggctaccacattttacctagggccttatgtggctctgaagctctctaatggccacacagtaaccatgtggagtgtgtccatattgactcagcccctggggcaggctctctgcctgctagagtgatctgtgccaagcaccatgggcaaggtgagtggaagggaagcctgaaggaataagttccctccacttacaatgtgactaacccttttacccctcaggaaggaaaaggcatacattgaccctgcaccagagttcatttctcatggggctgccttgttcagagacagtgagagagacagagaatgtgtgtgtgtgtgtgtgtgtgtgtgtgtgtgtgtgtgtgtgtgagagagagagaaagaatgagagacagagagaatgagagagagagagagacagagaatgtgtgtgtgtgtgtgtgtgtgagagagagagagaatgagagacagagagaatgagagagagagagagaaagagagacagagagacagaccactactgtgtctgaacactctctccttgtagagggagggtcccagtcactgccagacactggggtcattccacagagtggcatgccttgctaacgctggcctcaggggtcagagattgcttacacctgacctctttgtttggagctgtgcatcttttacactggattttccacctacttggccacagaaagtcaaaatgagcgtctttctttgcttttccctaattccttccctgcaccctcctctcctgcacctaaccattgtagctttctcccacaggtttatagacctaagaaacagcccttgagctcgaatataccatgcacttgtggtgctggccacagtccagatattacggccaagtaccactggtccagctacgatgcatacatgatccaaaggtctcaggtcagtcagctgctaaggagacacttgcccccgtcattgggggtgggggtgcataagagctcatccaaccttgaccttcacctcttttgatgatttccagtactctatggccataaaaactgagaccatagatgatagcattagatcatgatttgcagtgtcatttcatttattgtgtatataccaatggttccagactttggccacctgatagggtcagctcttgcagaattagcttggtggagctgcagagcaaaggctgccagaagccttcttaccaggcagaatggataatttttcctttctttctcttagatactttgctcctcatgtccccatctacttttcccagtaaggaatttttaaggctaccttttttctttcccagcatcatgaaaattcacttcttgattccagtaaggattgagcatagtccttcagtttgttcctgggaacctgcacgaagcctttattctttacgacgagcttggtttttggtgtcatggggtacatttgggaaacctcagctacgcagagttcagctcctgtatgtgctaaggcagtgtccaaagggctgttgtggagaaggatgcagtgaaggaagaggatgggctccttcgtgatttaggtctgatatccttcctcaccccacccaccaaagagcaggaaaaatcacctgaatttcagtatccttattgccaatgataatgactctaagaacaatgattaatgtgctatcaaaataaccccctgttattgagcatttactccatgctgggtcttgtatccagtgtccctcagagatgttgtcccatagtcctcacagcaaccatgtgagtgtgtgcaggattatctcccttttctagggagcataactgaggctcagggtgtggaataaccagtccaacgactcacagcttgtaagtgatggggttcaggctttagatagtctaccggattccacacataccccatcaggttcagggagaaattcagagtgtcaagcagaatggtattcccagaaattgtgaggcctccttatcttcataaacgtaaagtagatgccaaaaaaaccatttaagaatgttctccagctgttcataaacagtgggttctgcctggagtccttaggcttaggttatttgatcacatcaacaacaattactaatacttttgagctctcatcatgtactaggcatgggtataagggctttacatacatcaactcatcacctcccaacaagactgagggtttgatactcttatagagaagaagccagaggcccatagaggttgggtatcttgctcagcctcacagttggatataccataatgcttaaggagaccctttgccaaatgatcataaaagatgacatccaaagttaagctgtttaaggtgaatcctgtttctaacatttattatctgagtgattacaggcaagatactaaaccttcttcaacctcagtttcctcatctgtaaattgggctaacaattcaaagagttattgtgaggtgaaaggtaaaccaagtgctttgcatatgcctggcacataataggtgcttcatatgtgtaagctgctattgcaactactattactattaatgttactattattgctactactactaattgacattatcactgccaaccctcagaggtagtttaattttgatttcatcattactgctttgcaaacagctgggcacatgttgagaacacattgttgagctgtggcaactgtggcagaaagagcagatagatgttgacacctaagcttcctggtcctcctctcctaaagccaaagcacttgtggagcagtgagcagacatgtcagaaaccctggaccccaggtcccagcctgcactgaagaggcccatagcgcctgtacttgcgcatgtacttggtttgtatatgcagcacacatagatatcagtgaaggagggcagtcctggaagggtgagtcccagatctcaattgtcttgacctgcatggctgacttggaagagcagagctctttcagggaccaggccaatgaaaggggaaggccacccttctggcctgctcagtcttctgtgcagatgttgaggcagactggctcatgagagatgccaccctcttcagactgccttcttttttcaagacatggtctcactgtcacccaggctagagtacagtggtataatcacagctcacttcggccactacctcctgaactcaagtgatcctcccacctcagcaggcatgccccacctttcctagctcatttttgtatttttttgtagaaatggggtttcactacattgcctaggcaggtctcaaactcctgggctcaagcagtcttcccacctcggcctcccaaagtgctgggattacgggtgtgagccacactgcctagcccaggtagccttttgagctcaacgtatacagaaaatctctccccttcccagaccaccacaagtgactgagttattgccaggcacatagtaggtgctcagtaaatatttgttgtatgaatgaatgcatgattaccactttccaggctctatgccaaatgctttatggtaacctaagtttacaaacatcatctcattttttccttataatcaaccaacttattgcctacctactctgccagactctctggcagtgctggggaatcatctataacagatattttgtctggcccaataaggaaagcatcacccttatttttgagttgattaaaccaaagtccaagagactatatgacttaatcaccatcaaaccactcatatctggtgcagcgttggccctggtgctgcaggagtgctaagaccttgcttgtggctaggctgaacactgactccctaaagcaatgttgtgagccatgatcagcccccatacctcacagctgtcatcagagaaacccagttccagtggttcagcttgtgactcccaacctgtccagggtgatgggaattaataggagtgtgcagcttggtgagaccaagtgctatgtttgccacattggaattcaacttaacgagtattcattgactgcctgctctgtgttacagtgctaggcatggaatacatcagtgaccaaaatacataaagaccgcttccttgtgtagcttacaattttttttttttttttttttttttttttgcgatagagtctcactgcattaccctggctggactgcagtggcgcgatcatagctcactgcaagctccaactcctgggctctagcgatactcccacctcagcctccccagtagctgggactacagctgtgcacaaccatgcctagcttgttttattattattttttagaagagacaaggtctcgctaggtcaggctggtcttgaactccgagactcaagcaatcctcccaccttggcctcccaaattgtggggattgttaggcatgagccaccacacccagacaggcttactttttaatagggggagaaaggcaataaacaacggacataatacataaattgtatggtagaaaagaagaaaaatacagactagtataaggcaaaacaggagttccagggtaggatcagggatctggtgacaatttaaaatagggtagacaggatgggtgtcattgggaaggagacattggagcaaggacttgaaggtggtgagggaatgagccatttagatgtctaggggaaggattttccagcagacggaatgaagcagaagtgtacgtgtgtgtttgggggatagcaaggagcccaatatggctggcgtagagtgagcaaggaggcaaggaagtgagttgtcagagtgggaatgggtggaatagactgtaggactcctgtgcaggatctgctaagagtggtgtattctgaggcagaacttctgtgcagttaggaagcagaatacactagctctgcagcctcagaacagggagggctcccctcatcactactatggactggcctgtttaaggctaccctagtgagctcactctccacatcccctagctccagcctccatggagtctcaaggtgcttggcttgcctttttaggaaacactgctgcttccgttggggccacaaaagagaactcatgccagaatttgcctgtcacacctgacgagatttttaagtagtgtgggagtagggctgatgacaaaataccctccgtgactttatggcagtctcaacaacacgccgtcagagtacaagtcttgaccttccttgctgtcaagaggcatgcaggtagacaagagtagccattccccaactcttggcctgcactgggggttgcctgtgcctaggagaagaagtacatctggcctccaggccaggccagctgttttcaaacttcagtgggcagaaacataatcctttctaaagataaatctcaggttacactcatcaccccccagtccttactgctgaaaacccttcccaggctcctctaggggttaggataaatacaaactcaaaccaatgtgctctgtatcttgcatgtacccttccctttgcctggaatgtttttccctcttttctttacctagttaatgcctactcatccattcaatctcagtccaacatcacttctccagggaagccttctgggacttgctcaattgggtcaaatctgccaagctgacatttttgagcacatgtattatccattttatagcacttgtaacagatataattttccatttgttttgtgatgattttaataatagctatctgccttgctagtttttgagctccataaggactgagaatatggtaacatgagtttttgctcatcattgatctctaagagataattgtgttatcttttgctaacacaattgctagcacatttgctgaatgctagtaggcattcagcaaatatttgttgaatgtatgaatgaatgaataaatcatgatggcaagaaaagaaacatcattgatcaatcatgatccttgttccctgtaggtaagacttagcctcataattctcaccccaatattctaggcagccaccaccagtctgtagggcttgatagagaagatgaggcctgtgtgtcaactgatgaccacaaaatggcaccacgccctttcttgccacattgcaagacacttttacagagtgactttctccatggttgaactaattggggtggcggcaattttggacttttattccaaatttttttaccttcttctagttcaaatctcctccaatttcttgggctctttttgagtaaaatgtcactgagttctcagaagtagcagagattgcttgctgttatgaagggaatccgtccatttcatccctgaaaactcctgagtatctcataaatcaatttgcctagaaatgttttaactcttgttaaacatctgtcaataaagctaaaagtgatatgaaatgagttcagaaattccaattgtgcttaacaataaaagaatctttgtgatgctcttcaggtgttgacatttgggttagttctaggctgagcatggtataaaggtaaaagagcagtacaaattaactttctgctacttgttgcattaaaaaaagataaaggattgattctagtttggtagagtagatatctaaaactatccaacttttgtattcctttcacttctgtttctttacaggcacatacctctgatacttttacttcgcttctttttaaaaataatcttgcttgcagatttgtgcagttttgagagagggcctcaattgggaatcagttaaattttgatttggttctttttctatggaggccagttctaaaaaatataagaaaattaccacctttccttttttggtgtcttggagccaatctccccaactctttttcttcacccttgaaaaaaggactgacatcaaaataattaattctgaaatcactggatttgcctgctactaaggggtttttgaagaaagcttaaaactaaatcttaccccgtaagccgtattctcaaatgctcccctgtgtgctgaagtagtgatacacacatccttgatgaacatgcctttttaaaatgagggccagacattattgtttagttaaaatgagaaccagcttatttctcagaactagttagactatttttgagatcagagataaattgtacttggttttcttttccttttcctaccagttctgggcattgcttttggccaccaggaaacacataggtcagctagagcaggaaggcattaagaccaggagactagtcccctggttctctgtgatccccctcccatggggtttgcagaaaaaaaagtcccatgtctaggtaaacattctggaggccataacaagttgcatgtaatgtaatctatttaggtagagcctctctgccctgtgttgtccgaaaatcataggactgtctacaaggattagtctacaaggattagtcgcagatgtggtaaaaaatgggagaaggcagaggctgccctggaatgtgttcaggagagccacctacaaggatggaatcctagtcaaaattggatctcagcagaggtagacccgtcctgtccaggaaagtaagaagcacctgagtggagtgtttagccagacatttcttctcccctctgctagaagccacggttgtgcttcccatttacactttcagtgcttcatgtgcagatgacttttaattaccctttatggttcaggaggttagcacagttaaacagcagtagaggaaccccatgcagtagggttcccatagcctcctgttgtgtttggattacctccagaaaagcttgatttgatcccagcattgtaatgcatcacagacttggtccagatcaaattgctaaaatgcaaatgtattggtttttacagcagacccactttgggttaagctgtttgtgtcccaccggtagaatctagccacatctctatttatttttgacttcagtgcaaagtgtctttacagtctattctagagaaccccttttaataaaaaaagaaatactcagatctggcaggttattcttatggaggtaaagcctgaactgctcagtgttactgtaaacaatttcctcttaatgtccaagcaattgggtaagacactcatctgctctcttagcctggaaacattctttatcctaggcagctggtgcctcaaccccagtactcagggaatccactcagtttgcccttgcaacaaaaaatagcactcagtgaatatggaggcaaagtattttctctgatttcatgcatttttcaaatccctatcagaagggcatcttcccagagcatcaagctgacctgatggccaactgtgtgagtctctcacttgagtgtcttccttgggtgaaagctctgttttaaacatattttagttcatctccctaaacatgcatggagcacttatgggcactctttggctataggaggtgttgattttgtccttaagccttggagttttatcatctctactagcagtatcatagatactagctcatgaaagataaaataggacaaagtgctatttttttttgttgcagagatgttactgaagttcaaaaacctttgcctgctggaggaatcagagaatgctttctacataagtagaaattcccatgaattctgtgattggcaatctgtagcccaccttttgtgacaaatgcctatttaaccatgatactttctcttagggttttaaggatcccagtacaagtattgctagttttaggaggagtggagaaactcactctttgctttttaagtattagtttagaaaaacttgaaaagatcaactttaccattgtgttccctggcttttagaaatgcataaagggggaggtggctctgatttttaaatttcagagtgatttgccaactttgcttcagtaacttgaagcaccccacagcactgagcagttggcagagcatatcagaataacaggcttagctgaaggtgaccaaaacagggaatagcatgcaaatgccaagaagatctctcactgtgctctctctctctttttattcaaatttcacatctgtgctctatttttaaacatttattctttaagtgataacgcatgttttaccaagcctcttattggattagacatgtttgaaatcccttcaactttaacctgttcattaccgcctcagagaacattcagatccaccaccaaagtagagtgtgtacaggagaaacttcccaagatgttggccaccagggagccattaggctttgtggggaggaatccagctgttagactgtgtggattttgggagttattagactgacattgcttcagtgaggcttaggagtgggtataatgtgtgcagagaccttgcttttcatcattgtttttctattcacattttagaatgtgaggaaccaacagtttttgagctcttattgtatacttggcattgggctagggattttaaatatattatctcatttaatcctcatgacaaccctaaaaaccagatgttaataattctgttttacagatgaggaaacttgggttcaggaactatgcagagatgccacagctggtaaggggtggaaccagagcccaaatgggactcacattgaagcttttccatgctcttcccaggagctatccctgaattggtgcaatacttcagttaggtcttagcccctgtaaacttgaggctaaaaagcagaataaagaaggctttattctgtgaccctgagcaaccactccccacccctcctgacccttctcgcctggcccctgctggctcccgccatgacctgaggccaccatgtgcaggctgggaagggcgacttatctcttcctgcatcaccagacatcaccggttgccactaggggagaaggctgcaggctcaatcaagtgtgctgtcattttggttttcttgcaagaaatgttggcacttacctcctgcagcctttgtgtttcattctcaaggtatctgttggaaagcctttttctctttagttttacattttctttttcatcatttaacatataaaaccaggtttttcctggtccctttctctctctccctccgttccttcctctcatcatataattaaaagtcctttcagcctgtcttcaccttatcatttcaaatacattgaaaaaagatcccacttcctgcccttgtgtcctcctgatgctggatttcaaaatgaaagaaaagccccttttcacttcctttttgcttcatactgccccttgaaaagctgtgttaaagtgatattgattttgtcattgatcaccattgtggtgcacaccaggtctgtcctttcctggcttcagaacttcttctttttcagctttttcaaataatagtatcaggatttttttcctgaaaattaaggaaaaggatttttcaccctctcctctcatgattacaggaagacatttatcagacttggaatttaaaatttccagtagtttgcctttaatctttctcaactttatattcttttggggaagatgtcactttcttcttttgattctctgcaacacactaaaagttccagaatctcccttgtttattgttttttttcaatgttaccccttaataatgcactagattaaaaggtaataaggatttgattttgtagcattctttctatgtaaatgagcttttccatagttgaaagcatagagatacatcttttatcatagaaataatatttgctcataatagaaacttcaaaaaatgtaaataaaaaactaaagttacccataatcccactactcagaaataactgtcactaagatttatagtttcctacattccattgtctacatatatatttgaacaaagacatgacatactacataataaagtttgtttagccttttaaacatttaatattttgtgcattttcccatgtccttaaaagccttcgaaaacatatttcttggtttatgatttccatcattttgcagtcattaattttaccattctgttttggggattttgatttgtttctagcttttcacttttataatcacactgtgatgaacatcttagtacataagtcttttattttttatgttattttctttaggattaatgcccaagagttgaattattagacttgtgggtagttttaagattttagagcattaagaaatggccgtctcctacagtggacttgacattcgtaaatatttaaataaatgtcaactgttcgtgttaaatttttcaggctacattctgaaaacatgccactcatagatttggggcagaatcctactacaggaagtgcaagtgatcagtaaacagagacaacaagaggcagagagagattttcaaaacttaggtgggcatggaaagaagtaggcagtttatccagcaaatatttgttgagcatgtactacgttccagatactatctggacaccggagacacaacagtgaacaaaacagacaattccctgccccaactattccagtgaagaaacaagaaacaaaataaagacatcaaatgtagggcatgttgcacgataataaatactatgggaaaaaccaaagatgatgctctatgagggatttggggagctgattttgaatagggtgttccacagataccctgcccgggaaagcactagagttttccagccaagtggggggtgagccatgtggaagccctgtgcatggaggggagacctcagtgaggacaaactgcagccaggaaagttggaatctgttcctctgggccagctccccacgtgcagttgctaagttgacaaggtgggggagccagaaccccacaacactagtgtttagatgacattattatttttttttaatatgcatacaacaacccaaccccattctcttatctctgccctgatatagccactgagacatgaccccgttgggcacaaccaaaaaatcttcattcaaatgatctttgacacagcctgggaatggaattgggcaaaaagactataactttagatcagatagagaggtggtcatcccagaaaacagtgaaaacccacaagaatggcaactcagaaggtctaaatccaaggctgttcttacgccccagaaactacaattaactgattatcttgcagctggcttatttcctctttctcatggcccagcactcctagaattacaaacacagctcagaagccaaccagaaaggtggctctgggccaccttgggtgtgatgaagccacttagggtgctggggtaggaaggaggtatgtggatcacaaagccaggcagagtttctgttgtcagtcttcctggtttgggggtctaatgctcgctgagatgtctgatgcaaaggccaccttaaagtgtaatgttaaaagtttaaacaaagcaaggcaacccacctccccaggggagccctggcaggcagtagaaggttcagggtctgagaatggacccaagagttctagcccagctctggtcccaatgcactgagaaaccttgggcagctcattttgcttctctctcacaggctcagttcccccatctgtaaagtaaaagagagaagctaacagacctctaagcccttgtagttttgattgtctgagattattccagtgcattcacacatagtacgttaagtacttgatctatgacaaggcctttgaggatgcacaggcaattggcaggattcgcttttgcagagcctacagttgagtagagaagatgcattgttcagtagaacattaacacagctaacacttcttcaagaaatggtatactaggcacagtgttgtgcctttgttttattatagtccccacaaaaacttgaagaggcagtaccatcattatgcccactttgcagatggggaaaccaagtcacagagctgataagtggttgggccaggacacacactcagctaatctgcacgtaaaggcagcactctgcccatttgctttcccatcaagatacaattgccattttccccatcaggaaatattgggggattctagatttcaaaggcaacagtgaagaaggaaagctccaaagattgctcattgactcacctccactcactagttgtatgatgctgagcaggtcaacttaccttcctataaaatgggtacattgtttcctacctaactcacagagaagcattatcttgaagcatcttctctggggcaaggtctttaaaacccctaaggattaaagaaatgtacaagatgctgatcttagttgtgaggtggaaagatggggctatcttattcttccccacagggtagcactgtgcttcaaggaatggtggtcccataccatctctggtgacaatctctcaacataaactaggatctacatgacttgttcactgaccaaggaagaaagaacttgagtggcagtgttcaaacatagggtcccctcttctgcttttttgggagccaggtactcatttatctgtgaagaaaaacaaatagaacagaatgagcaaacattgtcttcaaagaaccctgttagctgggtgcggtggctcacacctgtaatcccaacactttgggaggccaaggcggaaagattgcttgagtccaggagtttgagaccagcctggccaacatagtgagacctcatttccacaaaaactcaaaaattagctggacgcagtggcatgtgcctgtagtctcagctactcgggagactgaggcaggagaattgcttgagcctgggaggtcaaggctgcagtgagccatggttgcgtcactgcactcagcttgagcaacagagtgagaccctgtctcataaagaaagagagggagggagggaggggcagagagatagacagagagagagagagagagagagaagaagaagaagaagaagaagaagaagaagaagaagaagaagaagaagaagaagaagaagaagaagaagaagaagaagaagaagaagaagaagaagaggaagaagaagaggaagaagaaggaggaggaggaggagggggatgggagggggaggggaagggggaggggagagaagaggggaggagaggggatggggaggtgaggtggggaggcaagggaaggagggagggagggaaagaagggaggagagagagggagggagagagggagggagagaaggaaagaaaggaaagaaaggaatgaaagaacccagttcaggatgggttccagaatttttccctccaggaaaggggtgtttatacccatccaacaatgatgtttgcatgtctaggcttctggggggtctgctggggccagggtcttctgaggcttcttgagatgtggtttggcttccaggaaaagcctgtgtgttcctgagctttctactgatgcaatccttgctaaggcagggaaacaaaaagttgatatattggtgggggaagagcaatctctgggggtttattttttatgaaccagacacttaagtgttgctgatttatcttaatagcagatagtatgagcaaatgtcccagttgcctctttgtgcttttggcaagtatggatgaaaaatggaatggagcagacccaaccagagctgctagccccaagtttaggagtcttaatcttcctcactcccaatatgtaatttagaattgtttccaacattttccaagttgcaggtggacacccagctttggcaagaggcagagtgggttctatcactaggttttctgcttctagaacaatgttcttaggcttgagggaagctgcacatctcccctcagtggttctttagacttagttatcacattctggttctgtgggtactggtcctgtgtaaagaaaccttttttcacataaagagccctcctgcttgtcatgcagggattctcagaggacacagcatgactgctctctgtatcctcctatgtcacggctggaatgagaccatactaaacccaatggcttagaagttggaatataaattatgtccaagccatgttcagtgttgtaacatttgctaatccttattagatatggataaattctcagggcttaattcggcatgttgaatcagttcttcagattgtctttggggactggaaaggaaatgtacgacttcactacaatttttcttttgtttcttcagaatgggacataattttttattgttagctggtggaaatttcggtgaatcattgccaactgtggctcacccccacaggaagaaagaatcaggctttagctgagaacatgttctttgaaacaaaccagaatatttgatttttgaaatatctttccactttaaaaacatgctgttcaacaaatattaatgtcctgaccaagaccagaagaattgaggaagtagaagaaacctaagatttctctctgaggaaaatgttagagtgatgtgtgatgcttgagtctaataataactccgctgagcatggagagagtctgtgaggggcaggcagagcatccttctgaccttggtccttacttcctccacagtggaaggagctaagtgctggctggaagtcaggcattccacattcctttaccaggtcacccacatttacatgacctctggcacatcctgtcatcttacttacatttctggtatttggtccagaaaatatacttgataataggttccccctttctgctgccaaacagttttatcttgtaagccattgttggatattttaaatggcttgagttgaaagctgttgtcctgttcttttttcttttatcagcagcatctcacctagtttggtggtcagtcatgcgtgcccagtaatcacccttaacggactcaaatcttctcaagtcggatgattctgtgactgggctttgggattattgaatttcttgatattatagctgcaaaattatctcagtgggattcttgttctgttcataattagaggtttgttttaatagatctgttttgcaggcttttatgagcaggactcctcttggacaaatccatcataaattctctgtggtgataaggcagacaatttttcactgcttgggtactttgtcagaacagcggtcacataaaaaagcctgatcctgtcttcttagccacacctaattttcagcttctgttgagagcaggacccaaaattatcccgacatctccttatgaaattttgttgaaaaacattagtccctgtgcactgagcacaaagccaaattacttctggaatgttccatggaactctgggaccccagatagggatcagggaaccagcacaacatctttcctcccttctgcacgatctgtggattgatttgtagattattatcctcaccttgagccatctgaagtcaaggcttgggtctaacttttatggttgtttggttgttattatatttattctcaaactcagagaatgcaaaggatagttctgggaaaggagaggcctcattctccagtcaaacgattgttctcctgacagtttgccaggatgttaggatgtttctcagatctcttacggtgttgaagtgcaaatccaaaaaagagcttctcgaacaaaccaaacagaaaccacatacttattcagggacaaagttagtatatgtgcctgctggttttcatgtccaacaacaccaaggtctttacgggcatgaaagcttccctggaccccagagaggcatccctgagggagaaaggagaaaacttgaaggagaaggttaaagaagccttttctgattattccttggcagggacatgctaagaagagatagtgaacagcattggaccttttctagcatgcagtaattcccagcttggaactcccaagaggcttaacgttgtgccccatagactgacaggtaaagaaggacagtgtcaaattaaagttggaaattagaggaaataattataaaaatgatacagatgattattttaacttctggttctctgggttatttctggctgtctcaaggcacagtctttaaaaacaaggtccgtgagcctcaatgtttaaaatagttagattacctgcagcagcagttcctaaaacctgactctgttttaacatcgcccagcaagctttttttcctccttcactgaatacctactctagggccactttcacacctacacactcaaaatctcaggggagagtcaccaagaagctgatagatctggttgacagatcagcatttgagaggcattgatctaatgaaatgagtcagtaacccctaaatgtgggaatccctgggcccctaaacacttggtctccatatatagatagccttgcaaattcacctactggaaatgtaaaataaatggcaagattttggatcactctgggctgtaattgtcaccaggaaaggtataactggagactggtataggactgtgtcacaggagtcagggtggaggtggagataagcctgtttgctcagggcacatgatgatgggtaagacagacagttgatccacagagtttattgagcacagagagggtctggaccttgttccagaatttcaagggctataaaagggaatcagaagccacagacttagctcaggtatctagagcagcttccttgatatcaagcggcttgctgatgccttttgcacataattggagaggttaaataacttgcaggtagtttcacagctgttaagtggcttaactttgaccatttggctcaggccttctgatcccacttgtggttttctttactctccaggaccctgctagttatggaaattttcttaataaggtacattttgaacccaactgttatggaggctgaagtacctggttttgtagggagaagttatttctagcaagggaagcacaagagttgagatcagtctgtgtgcttgtaattagagacagacaatctttgggagagtttctgtgggggaagctgggaggaggtggattgttaaagaaggaaagtgagaggttggctttgcccagtaactgaactgtttctatctgatgcacatgacatagggagccactgtgtattcttaagaaagagtgtgatatgaaaactgtcaacacaaagtcagcttggaaccagcattttcaattaatgataaaatggctgctgagattagattgctgggtcattctgctcatgaaagcttgccctgggtttgatgaaggttgggtgccttctagggcatgttcttattttctgcatacttagctgtggttagtaggttatgatttgggtctttcattaatgcatcccccaaccaccactccaagagtaaaataacagcttccttccattgtacagcttttgagacatggaaatttgaagtatattcccttgagcacagatttcaaataaaatgtcctataaagcttcagagtctgagagatccttgggccattaaccttaaaattccagaactaaagacctatttttctaccagtttccaaatcatgtctgttcctaaataatcattatggtgctttattcttttaatgggttatttcccaaaatggcagagaggaaaaaaaacaccccacagcatacctttttttgttttgttttgtagggtaggacttggctggcagtgtccccaggcacatgctgtttctgagccataattatgctttttaatccactcctttatgtctgggtccttaatgtccaagcttctatataattaccaagttcagtgtgtgggaatgagaaaaatttttttgcatgactttagcctatacattgttgcatcgctgtattattaaaagatattttctgaacttagagctatactattaactctctcaacttgaaaagacccagcaaagagatactcccaatcttaggcccatgatgtgacattcagatagacagtgacttgatccagccgaggtcccctggattcttgggggaggacttgaatttggcactagtgtcttggttcagagcctgacagggtcttgggaacctttcctttcccatccagctgtttgtgcatagacacaaccatgcctgtcattgcagtttgctaaacttaagagagattggtgatgctggttgttaggagaaattggaattttaaaagattaaggtggaaggaggaaagctgtggccagtaagttagggtgctccattgaatggactgttgtagttcactaaaatagaaggcaacaggagtctcaattctccaaagtcaaaattctcagtctcaggagtcttttccccagaactaaaatgatttcaacagtatctccccctaatatgagatgtaatttatatctctgcatttttgtatagggagcagagaaacctttttttttttattgttttattatttcttgtacctgattgaatatttaaataatatagaaaggaataaaggagaaaattaattccctaaaatccaaatacccagcaataattataaatggttggtgctcatctttctgtacttttcatatatatatatatatatatatatatatatatatatatatatatatacacacacacacacacacacacacacacatatatacaaacccatatatatatttaaatgtagacttttatatactattttatatgaacatgttgtttcacagcctgcttttatttccatttaattatatgttgtgatgcactttccttctggtgaatacaaatacgtatcactcttttgactggcttctgaatatttcattataggaataacagctatttaatgatttgataaaccaaagcctaatatatggacattttggttacttctcattaactgctcctatgattgccatccctgtgatacccttttgtattcatccctgtgttcttctccaacatttttttcaggaagagactattggaccacagggtagacatatgttaaattttgatacctagtgccaaattgcccttgagaaagtttatgccaacttaaaatcctgccaacagtggatgaaagcacccaaagaagacagaaattaactttccatttttttaggcttttctgaattttacccacctccagaactttaccactaaatgcctaaaagacaaatgtcatgttgattaagttctataggttcaatattggtcctcacctagattgcaaaataagtctttaaattgatgtcttatgaaatgagaataaaatcagcaatcactaagatttatttgttcctgaagattaagtaatgctaacgtcactttggtttttgataaggttgatagaaagacaagtcaagggaatggcatagtcgcagggtaccagggtaccaagatttcagctaggaatacaacaggacaaacttatatgtatatgaatagcttttttaccacatggagaaataaggactggatggatggatttatagttgattgaacagctttataataggcaggttgattagggaatcctgtcacctctatagggaggttgccagaggagctaggctgtgacctgccagcatgtacaaggaactaattatacaaagcctttgaaaacatgctttttggtgaaaataggatgcatcaaagccatgtagcttaccaaaaacaatggcagacaaaatcagacttgagaaacatctcagcgagatgaaactatagacccaaatttagtcagtataagtctaaacaaaatatttagtaagggacaggagcggtggctcatgcctgtaatcccagcactttgggaggccgaggtgggccaatcacctgaggtcaggagttcgagaccagcctggccaacatggtgaaactcccccaccatctctactaaaaatacaaaaattaaccaggcatggtggcgggcgctggtaatcctagctacttgggaggctgaggcaggagaattgcttgaacctgggaggtagaggttgcagtgagccaagactgccccattgcactccagcctgggcaacaagagtgaaactccatctcaaaaaaaaatttttttttaataaggaaaagaatgaagtatatacttagaattaaaattctggggtttgtgtgtgtgtgtgtgtgtgtgtgtgtgtgagacagagagagagagagagagagagagagagagaatggcagaggaactaacaaccaggatatgagtttaatcaattgtaaattagagcattagcattgcacagcagatggtaaaaatcaatggaacctaagagtatattacttatttttaaatcatgcttagcagatgtaaggacacatgtgaagacttagtttcaggctttattcaaagaattctctcaaaggagccttgatgcatgtagtagcaccttgtgcaatggggtacagagagaggactaggagaagtggggagtgactagttgagagaacaacaaatagataatgggcataactgtattcaaatatctgaagacgtgagctgcccaaaaaggcagaagtagggtacaactgcaggtacaaagctcaaaatatgagtgtaggaggcagggagcatcctatttaagctgcttaatacattatcaaatagctattgagtctcccatctccagtgataaggaatgaagactggaccaccatccaccaggatggctacaaagagaagtcttgtttgggaaagcaggttgtattagattgtttctaccaacacaagcatgagtggcatttgcatgcttaacactcaaaaaacccaacaatcttctgcagagaagtaaagccccatatcaactgctaacatttattcctgctaatggttcaacagaggccaactctgttcacatcccagcatatcaactacctaccactttccccccttttctcttctactcaagagaacacctaaagtgttcaaatgactgggctcctgggcatcctcgcctctcacctgtctgcacaattcccttccctgcatggcctgcttttatgtgccctcttcccaccttcacttatgctcttctcttcctgaaatcagccccaactaattttctttagatatacaattattctcacaacaaataagaagatagttcccaaatgatcaagaagaaacgtgggaaaaaaggacattaaaagggggctcacagataatgaagtagaaatagacactaaatgaatgaaattatgctcagcttcaaattataattagggaacacatgggatacaatattttacctatcatatttttgaagattaaagagtttggagaaactccatgttagcacagcatagagaaagaggtacaggctggatgttgattgacagttttgaagggaatttggtgatatccttccaagtttaaaatgtgtatattctattttagggttctctcttgaacttgttttttcctagcacattatagaaacagctatgatatgtttaagcatccgtctttgttggaaacaaacacattaggacaagcaaagctgttcctttgcaaaaatattgttttaagcattgttggaaaaaatgaaaagctggaaatgacccaaatgcccatcacttattcattcaacaaacacttattatatgtccatatgtgccaggcagtgctttaggtgcttgggatgcatcttggaataaaatgaaaaaaagatatcttcccttttggagtctctatttgaacacatcaatagaggactggtaaacaaaagtatacgcatagagtggaataacatgcaaccattaatgatgaggaagctctctatgttcttgatgtggaagaacaatattggagatattgtttgtaaagggtaagtatgtgtgtctgtgcttgcattaagcacaaaattttttagaaagattggcagaaaaaccttaacagcgggaataaatattggagcagagggagggagaacattacttttctttttataaactcttttgtactctttaatttttcataactagcatgtatgatttacataataaaaacttacagatgttatttaaaaaagaaaaattataaagcctaatcagtagttctgctagagaagtgaggctcctatctcaaaggaaatggaaaattccttaacctatctgtagccatcaagaacaaaatgattaggtgtttgatgctgtttagactgaaagaatggaaattaataccatagtactttggaacgcaaaaccaatgacatgagtcgggcctgtggtgttacaggtcatggacatggtggactcatctgcagttgcaaatcaaatgagaagacggccaggggcaaggacagggccaggttccagctgtcaagtattctgggggtttctcctgggcccatcagcaactaaccttccccctcttggagcctcagtctcccctctgtaaagtagtaagcttggattcactaattgaagatgtggcccagtattaacattttatgaatttgggttgttctggcaagtccttatttgtaggggagagatttgaaatagccctaaaattctctagtctacgagacggtctccccaactttcaagttacccgccttttcctagtactatcaagaaacatcagttatgtactttagtatctatttttgttcagattcaagtttaaatacatttggacattttgtacttaagctatttcaacttcagggtcacagacaaccaggctttttggattccaccttaaataggtgactaagagaaagtgttttttgaaatgtacccattcaatgaattcaagttgatgtgttaggaaaaaaaaaacaaccatatgactcaacacagtagacatttccagatgaaatttgagtataacttcatcctttctggaaattggatttctgtcagattcacacacagattcacaaaatttccactttgcctcttctttgggggggtaagttatcgcaggagaagaggtaggggttattgatgagttttcatgttcatgtactgagagaatatcagcttggatgaggctgtggggagacctgcaaatgatgtccctgtcttgtttgtgcatctctgggggtgtccacagagaccttctatcctgagtggagtatgtgactcctcatagaactaaatcgaccctagttagggtgagctccaagtgttccgtgtaaagctagtaaaggtgttgtgatccagacgaaagggaggacagcacagcgggcaactctgataaacacctgaggagatgtggcagagagttggtatttggaacaatcgcctgccatttttctcttcccatttgtttttcaactgattggaaaactgctaatgagcatgtttacattttctccagttgtctcacccaagcgtgagaccagctggggagagggatttgttccccctccaagggcctggctgcctctccctgtctcgttctccctcccagctgccaagcctctcctggctgtctccacacctcctggagtcaaaactgtgctcggtgctggccaacacagccccaccacatgttttgcatggctcaccccatcccttctctccccctttggggggtcatttgttttgttttgaaggaggtgaggtgctgggaggtttatgcccttccattctgctttagaactgggagcaggcccagattgcatttgcttccacttctgcgcgaaggtcaaagcccttgaaggagagcgtccttccgtcctcccacagttctcaggacatgttcattctctctgggctgacctgagtttctagtctcctctgcttgcccagtccgttctcctttgctttacccttcccttctgatggtggtgtctcaagcttcagacattttgaggattaccttcacagtgttttccacatcctaagacataatttctatgaaacctctctttgatgtgcttgttataatttattttaatatattttagagtaaatatgtaactgttgagcagttcatttactccctgtgaattatcttgcctccaagggtatgtgaacccctctcttcatagccctgtttaagactctcacggcctctttcggagggcgctgctggcttttactcaacctcacattctcctagaatctcacatgctcctagagttctactagaatgttcacgctccagtttctagcctattggccaattctgttaggcgataccccgaggctgttttgcccattcattagttagggagctgttttgatgatgccagttctccctaaaccagtgataataaatatttgttggattatgaatggaatgaaaatgttgtcttcacttgtcagcacaattctagagtccgaatctcaatacctgcaaacactgtctttcctctctccttcctttctttttctctcttctcttgtcttctcttccctctcttctccttacctctcctcttctctctctctctcctctttctcttccctccctcactctctccctcctttcttccttcctttatttattcccagtctccttcattctctcccacctttcttcttccactcctccatttatttatttatttatttatttttgtctttttacctttgggttaaaaaattaggattttatttggagttcactttctaaagaaactcctaacagaccatgcacagaatgtttccacactgtagtagaagagtctggagtttttttcagagaccctctattgactttctgagttgaaacagtttagactccacataaaatatgtgttgtttacccaggctcttcatgctctgcatactgttacagtccttgaagagcttgtcagtgacaagtaagataaatgaatgaagaggactttacaagtgtttaaaagctaagtatagcatgtgctgcccacgacttaattaaacagacctgcgcttaactaagtaactttgtggtggaaacatctagggcctttcccttcccccagactctgccactagcaatggtgctcaggatgttagaaattccttggttgtctggagttgctaatgtgttagcctagctgttagctgtctcattggttgaagcattaaacgctagtgtggactgtgcataatgacttttgaatttatattaggggatggtcagtaacatggacttctttggggctccattaagattttctaatgtgtctgagttccatcgttttcagagggaattttaaaatcaaaagtgagctgcttttctttaaagctatgattggagtgggtgatcagagcccattcccaggtcagtcttgatttgtttatgaaggggctggtccttaaggatctgagcagtgggatgcactggttacaaaggaggctgcacagtcagagcctcagatctaccagttatttgagctctgattagttgcttaatccctaagcctcatcttcttcatctgtaaagtgggagtaataagaagcttcaaccaaggcaaatattcagggcatgtgcaactgtgtcactcttggttctcatgggtttctgcatctgtcatagcagctattaaagattttaaatacaatccccacccctgcctgcatcgcagggttgatgtcagactgacttaatgagatgatgccaacacagtgttgttcacacagcaagggccaagcaggcattggttattattttttatgttaacaggaggctccatctcacaatgtcggttaggatcctaacattatgagcagagcacatagaactctttctttataaataatccttcctcatgggctgtactggctgacagtagaacaggggagatgctgcttctggctacagtcactgtccataacccttcaggggattccccaggttcctaaggtggcagcagaaagcaatgtttttttttgagacaagatctcattctgttgcctaggctggagtgcattggcatgatcacagcttattgcagcctcaaccttctgtgctcaggtgatcctcccacttcagcctcccaagtagctgggactacaggcatgcaccaccacacttagcttattttttgtattttgtttttgtagacgtggggtttcactatgttgcccaagctggtttctaactcccgagctcaagccacccggctgcctctgcctcccaaagtgctgagatttcaggcatgagccactgcgcctggccacagaaagcaacttagcaacataatttccctcccctgactttagcaggaaaaaagaaaagaaaaactgcacaaaatatgcaataggagcagtagatcagcatctgtctgtctatctatggtgtttggtttatgctgaagacattcttccctctcttgcccattttttagatataggaaatgagactcaaggaatcctgattcagtctgagtctcaatatgaatgtttggccgaaactgaattagtgctaggcaggtgttacttccctaaggaaggtgagagttctgtcacgctaagtgatgagaactctcaagaagtatccatggaaaagagcctaggagtcacaggtgtgttagtcctgtgcaaaaattaagtgcaggcttgttaattattcaactatgattagggttttagctgagattcttgcaaaaacagaccccaagctgggtgaggtagctcacgcctgtaattccattgctttgggaggctgaggtgggtggatcacctgaggtcaggagttcaagaccagcctggctgacatggtgaaaccctatctctactaaaaatacaaaaaataaaataaaataaaataactgggagtggtggaaggcacctggaatcccagctactctggaggctgaggtggggtaatcacttgaacccgggaagtagaggttacagtgagccgagattgcaccactgcactccagcctgggtgacaggcaagactctgtctcaaaaaaacaaacaacaacaaaaacaaaaacaaaaaaaaacagaaacaaacaaaacagatcccaagacaagcttttactgcaggtagtttatttgagaagtgatctccagaaacatggtgagagaatggggcagtgatacagggaagggaaaaggccaacaaagggtgcatcaatgggcagttttctgctatagtcaaacagggctcccactgctgaggacctagtgaaagattctggagcacactgtagggttgtccactgaggggccaggatgctggctatttatgtaccatctccttccctcacagatttagagttgtttcaggggcgtgagctccctaacacttcccatctgccccattccctggccaagtgtgcacctgtggccaaagcaagacctcaagccgaggaagatgcacgggctcctggtgggaagacagcagcacatccaggactgtccatccaagctgcagacaagatctggtgtggaacaagagaatataggagggaccctgacattctctgcaacaattaaaaataaaataaaataaaataaaagtgcttaatgagtaggtataaaaacaccagccaaaccttcatgatgatctactaaatttctgtctgtaaatagggaccgagagagagagccacctttaacaaagttgggagggagagtccgaccagtgttctgttctgctatagaggaggggcaggaaggatggatcagctgaatgaatttggggagatcagaccagtgctcagggaaggactgatgctatagcagtggattgtgtagatatctgtaaacacacagatgccaagagcctggcccattttcccagagatgttacagtgtgacatgggtgagtatatggctgtggctctgtcttaaattccttccaaatgccacaggttgatgttattttgaaaaataaggtggtgaattttcatctcacatacatttcctgctctttccacatccagtaaaggaatgaaggaagcccgcacacatacacacacttgcatatctcacatttggtgttctagttcccctcattgacctgctttcctctcaaggtgattggagggccactttactgtgcgatctccccagtgtactctccttatacctatagccaagccaactttcaaatcttaactcaaggggcgtttgacccatggagccttatttgatgcctctgccctcagctggaggggatctgttgcctctgaacatccatttaaaccatacccttctctcctcctcctcttcttatacggttttatagtcaggcttctatttcctcatgtcctattcatctttgcctcacccctgcacctggagtggaccttacccttcatgacactgctgtaggactctggagtcagacatctgggtttgagttctgttcttctactcactagctgaatagttatgggcttagtttcctcatctgtaaaagagggccccaagaatagccatctcaggagtgaggattcagcaggagaatgctggccaaacacttagcctggcacataattattcttggcatcattgcagttgcagatgttcagtaagtgttgagtgaatttcagtgcagtgtccacagtagaagcctttacatcatttattcttacatactcccagaaagttccccaatgcggcacattcctttaatagcttctgcatcctctgacttcattttgtcctccaactgtgacctgagtgctgcaacttagattctactcaattatgattcattgctatgtgagtctagtggatggtcaggaaatctctcctctcctagccatcccattcttgtctggtttgctcatcttttacttggagacaagagctgttcaccttgctctgattaggtggaaacaagacagtagaagagttcctgaacgtttgggatttccctagtgggaaaaagggacagaaaagaaagcctgatagaataaaacagtaattgctattgtacagtattatctccatatcccatagcaacagatcttattatatttttttctatttaaaccgtattcatgaaggttttatcgttaacttgatccagatgactgatcaaagcaaagtttgttattgccaccttactaaaatatttttaaaagcagttttaattcaatgtgtttatcactccatattgccattaggctattgagtctattactagtcgatcaaggattttcattttgtttcaagagctccttggataaactcttcagaaatgtcaaaagagttggagtatctggcaccttttcacagatggtgctcatcagatattttagttaatggataaagtttcagttttccatgtttgacttttggcactaacagaggttttctaaaggctcctgctcccccaaacgctaggggatagtaagaaatgaaactaataacaccccaacaccccttattcttagtgaggtaagtaatcagggaggtggtagagtattgcactgggtccaattagctaaggaatggcatatttcttgaagaagaccaattcgacttgcctaacagctccaaagctatgcacatactcttccttcgccactcccaagaattacaacaaacaaaaacaaataaacaggaaaagttaaactgccacatcaaaagttaaatactcaactggctcatcctagactcccatcttccctcttatgtgttccacagtagcctgtgtgccctctccatccatccatttttacactcatatactttgacacacttttacttacagctaagacatgagactctgcactagatggagagtgcaagggcaatccacacatagtatttccctcaagagattttcaacctagtggtggagaaagccaagtgaacctgcagttagttaccattggttcagataagttctgtgatggcagagacccaggggggtggctacaggattctgctgaaagcagtggaagaggcgggcttaggaaagttgtctctggagatgatggcattgaagctaagaccagagaactaatggatataactcaggtttaaggggtagagcatgaagagcaggaccgagagagagaacagcatgtcccaaggctgggacaaggagactgggaggtgtaactctggaagtaactagcagtcacctagcaagagatgcctaagcatgtcaaagacccaggctgttttcctgagtgtggcgggagcctcccaagaacttgaatccagggaggaacagaaatctgatgtcactctggctatggaatgtgttcaatgggaggtgagagtgcagcaggagagctgttaggaggcgatggccccagagaaataaggtggcgccttgaagaaagaggaagtagaaaatgaaatctgattagatttgtctccacagtcatgacgtaatatagtaaaaagagtataacacagttagccaaaggcaaaggtgtctggtcagcagtttggtagacaccgcaaaggaaataaaaatgggcctcagtgaatcgctaaatgagtccctgagttcctaagtgctatgctgtggaaagcaatccctctccaactctatattagttttcctgggtgtttagttttgcctgcccagaagatttgctgcttcaggcttttcagcgggcacctcaagcatctgaggctacagggctgtggaccattatgtatgggatcacctggtaagttggcctagagttatttgaacaaacagtatccctgtccaatccttgttacaaatttctgtagtttttctttcattgactgttagggagtgttatttgtgacttcctgtccttccagacccttgtctatgtgtaaaccggtataattgggtggggatgaagctagatagtgcagacttaaaaaaaaaaaatttaaaagagatccattttaaatttgacaattaaaggatcaagattggtcaaactgtttttataggagagaacaccagcaactagccggtaagaaatcggtcacagtttaggggatatgttacaagcaagataaataaaaacggtctagagtatcagaccaaactctcatttttcatctctgtttcacactcttctcttccagcccagactaatcaaaagaagcctcttccgctcacaattgctctgtgtacatttcccccagatctggtattcacatgaacaacgtggtttatttatatttcagcaccaaattggaaagatgacatcattcatttacagtctttatcccatgacatgcctactctccaacacctcattttagcagacacatttaggactgcatatagcatcttgtttagcttgtacattcttttatgggatacagttcaaaggtagggaactttaggcttgttgctggtaagaaaataatctcataaaatcacaggagcttccccaaaggatgaggatattacgatgtttacaatagcagaattattatttgttcatttaggctccatccttcattcttgagcgagtcccttccttcttgcccacagcagatcttacagctcccctcaggctctcagaattctatttagaagaaacaattccagatttattagttcatgagttcaaaagtacaggatcctgacaatactggaattttaggtgtaaacgccaaatttcagaatctcatgtgcaatggcaggctggctgaggggaatctcagtacttagtctgcagcagctccactgacctgctctttctcacaaggcataacttgcccattgggtcttctgacactttaagtggacaagtgaaggatggaaatgctctcagctgccagaggttgcctgggattttttatttaattttaagtggctctttccctctatttttattgtttttattcatatagacagtttttttttaacattcactttggggcctttcaaatattgtacacatttttaaaaatggagtgagtaaatcataagacatcctctggcagatagaattgggatgtgaggtgtttccaaaacttaacagaatcaaagcattttatgggaaagttctttctacctgtttagctgtttgccttttctgctagcagcaagacaaggaaaaaagcctagagattgagaattggatgacccagaaaatctccatgttctatgtcaagaaagagactcttggggctgaaatctacaccttacttttctagctgccaaatgaggatagtaataattgctcctgggaaagtattgagaataagttagattgtatgtgaaaaatactattaagaatgcacaatgttaggtccagacttttctttattgtcagtgtattatttatattacataataaaactccaactggttggaggctctgccaaccactgacttctggctctctgaaagtattgttggttcattgtcatcttgagccaccagtgggattgttatggcaactcatgaaatgtcctcaactctccgtgaccttccctgctgaaaacaaacatgtagcttgtctctaggatggcagcatccctcaaaatcatggccccttcattcttttggtcactcattacagcagcatgtattatatatctacatctgctaggccctatgcgagattctagggagaggcagatgaaagaaatagcttcaaggtctacagacatacggacggataaatctgtggttatagagccatggtatgcaggaggcacgtgtcacccagcctccaggacagggtgaggaaaaggctcctagattaaatagtttgagttagccagacatagaagttaaaggtgaagaaagggggctagggaggcattgcaagcaaaggaagcagcacatacaaaggaggaaaaatgtcttacagcaaacaacaacagcagtaactatagtaatgacagcatttgactttcattgccagttactggactgacacttgaagtccatcgtatcattcgctcctagcggcaaccccgaggaaagaggcactattcctctcattttagagttgaggaaattaaggtttataaatagtttactctcttaggttcacataaccagcaaagaggtggagccaggacttgaatccaggcaggtctgtcctcaaaccctcatttcctgactttctgagctggataattttgtctgcttttttcccgtggtctttaggcatttttctagattctgagagcctgtcaggccaactcatcactggtccatttcttgccctgcataataaagcagtacacttctattgcattgggggtttaaccatgactccaagttgcctcatgtgacaggcatcgtggattgtaaattagagtggtcagttcttttcccattgactttgtaccttttgctcagttcccttaaggaacaaaatcggttaaaatgtccgtagagagccatttcccaagaagtcatcatagcagtaaaccatctccatcagtatttttgcatttggcagcgttcaagtggatttttctgccttgtcttgtgagaccattgtttatctgtagttctgtgtttctacccagcccttcccatctttccatacaggacttccatctccagcttgctctagagtgttggtctagagtctcagtcataattgttgcaattgcaagctcaccttggatctctgtgattgcttgataatgtaaagcaaagcaccttagagtatgtccattttttcccttttaaatcacaagaaggaagtacattaacatttacagatgtaacataatagctttaaggatgtgacagagcttttttcaccaaagttaatgtcatggtgctttctttattaagtttcaacttgactaacagtgaaaattcctgaattaggaacaaagggatccctataggtactgtaattatgccctgaatctctttgactgatcttctggctcctgatggaatcttccttggtttttgttctgcacagacccagaacagaatgaagttgatggcagacaactatgatgatgaccatcaccattaccaccaccaccaccatcaccaccaccatcgatctcctgggaggtcgcaacattccaatcacaggccctctccggaccaggtcagtttcatcgctgcttacctccaagaccccttttaccctttagatattttaagataaaataaataatcctcaagaaataataaacatcataaagtgatacgttctttgaactgaaactaatagctttggtatttatttccatcagtcaaggaatctaaatgtttttctttctccttcctctttaaggttttgtcttttcttgtttatgttatgcattttctttcctcccctcctttcttctttcatagatatgtagtctattgctggctcggtatctcatggcgggttactttggaatgtctctttcagagttttaagagaaagcactttgtttccatgagcttggcaaccagagaagccttgagttcgctgagcactttcctagaaaattctttagtgatgcaaattaatggtgaggtaaaacaacaaggagagaaatccgttttgcctgcgttttagccagtgaagtcaaggagtctggtttatttgatttggaccctatctcctcccttgactaagtaacgcatgtgaaaagatggattgacaaaaacaaaaaccgcctgtggttttacagcaatatttacattcacccaccaaatgcaaaaactatttacaatgtttagtattaaaactcttgaaggtgaattttatggaaattaggaaattaaatgcaaactagcaggataatatagtcaatatgagcaatatttcttactttgttgtactaagattcctgcctccccctgcccccgtttttggtgatcctagtgtaactgatacatttccatagatgggagcaataggtaacaaaatagaaccatctggataagtatgcactcctttggatatggcagggtgaggggttgtcagaattacctgtgtgaagaggcagtttaattgtttgctgggggaggaggtacttgtgatgctccgaaaacttttcacgtggctctgtttccttttcacctcctgttgctagcatcccaaagaggttaagatttgaagtttccaagatgttttacctggagtacaagtcctgggggagctgtttatatagaacacagcattagaagttctcctgggagctgtgcagtgaggcagccagcaccaggaggctccccagcccctgagcttgacctgacctttgtacctggaagcttttgccctccgagaccccaacattgctgaaggtgttcacacagaaaaaaatctagatttccgaagccaagtacagacagggcatgatttcatgttttagctcccaaaatattgctcttgatttggagatctgaaatgtggagagaggtgtcaatttcatgtcattatcttgtatgtctgtgttttggttttatttattcaattaccacccttcaccatcaccaccaccaccactaccacctccccacctctgcctgctccagtagacctggcatcctgctaactaaaccaactcgttctcattcctggtccctgcctttttctccttggcattctcccagatagggtgagtatgaggttttattggtgggagcctgcagtccccactttggccattcattctgagccacacatgctagaagaccatcctgagttcccccactcaaaccccaacagagagacaaaaacagagagtaccataagagtagaaagaaggatttggagccaagtcaggggagtaggtcatccagggacctgctgagataacaaaccagcttgtctcatcacagagacacatatgctcatatgttctactgggaatgaggcactagagcacatctatctgctttgtgaatggtatttcttacaaaagctaggctcctgctacttttccagagaggtgtaatcacaaactagggtgtcttgtccacttgactgactcttatgtttgtccactgacactagagtttgtcatagggtggtgtccttcccagaagagttagcattccttgaagagtgtctggctaagccacgttgttgagacctttggcacatgtttctcactgctactgttaggaagatggtgatggtctttcactttcacatccaccatctcagtgaacactctaagcaacccatggacatagaggcagttaacctcatcgccttctccagatgagaaatctggagcccgggaagtgggtgaataggctggaatcctgttccgagttcctaacctaattccatggcagccactatgtggcacttggggaagagcatgatggacagaacccctgtcttcaaggcatttgctgtctagccctagaataagaatccaggttgtctgatgtcttgttcaattcttttctggttcatgtcaatcagaacaaggcagataaaaggtagctccaacttaattaggggcccataccttagaaacttattctgcagtgggggtcactgtgaaagtaaaatacccttgaccacaaggatatttttgtggttttaaattgaagtcatcaagtcagtaaggctcctttgctagacttttttaattagagaaggagagattaagcaaggaaccctagtgtgagagtaggttggcaccagtgctggagatggctatatctcctgagctggatgccccttttgactgggcatcccaggtctagtggaatgataccttgtcctatactggagatttgagatttggtaaccaataactaatatatcagtatatgtactgttataaatctaagtcccagaataaagtcgttatcaatggataatagttatcaatagttatctttcccaattgattacaaaccctacacttaattgtgtagaccacatacactaatagatacagggtacatatgagtatatgtttcttcttaggagaaaaatgacagccatatgaaagcatgagagtcctaataatggggtgatgtggatgagattttaactaaatgttcataatgtacataatgttagctgacctgacttaaaggggaaaggtctctttcagggattcctgattccctttctgtgaatcttccagccctggccttcctgtggccttaaaggcttgaccaacaatgacttatggaagaagggctacaaaatgttgatattgcctcttgaactttattaagagatcagaacacatgaaaatggagaaatatgaaaaatcatttgccttgttacttttccagaaaaactcgttttaccttaggtaattcaattacgtgagtattgccaggtacttacagaattatattctttttccatttcttccatgtttctttctccttcactatgatttttcttgctccttaagagaaactgaatccaagtattataagtctagactagcatttcccaaagtaacttttagaacattagtcccatgaggaaagccttgaaacaaagattctctgggcaaagtattttgtgaaagtgctccatattacaactctatcttcgagcgtcctggggcaattagtagatcaaaggatctaaaaagtcatataagaaagaaagctccccaatttaatttaatccagtatttcccagacttatttgattgtagatttcttttttctttcaagtaacatctgtgctgtaagaaatattgttctcagagtatcaggtgaaaaaagagactacccattttataacatgactgatccagtttccagcagtattttttatcagaaggtgggattttccggcagcttcttgctttgcacaaccgaaaatggaagtgcctcttccattcatttcctgggataccttcttaaaggcaataatatctgagaaagagtgatcccaccaataacccagtagatctaaactaagggagtcattaaggttgaggacccaggatatcaagaatagtcataaatacacagcccttgagggattactgagggggtgggaagatttggagaagatgtaagagaagtcagtgcagtgtggcagctcaagaatctagccccctacctgagagagaagcttttaatagctggtgggctgtgacccccaggatggtcacagccattgaatatgtccaagtagaatatctagacaaatcccagtaatgacttgggaaatccttcaaagcaagaagtggccatgggggcagacaacaaatatttcccatgacacaagctgctggtgtgttttgagaaacaataaagtccaaagagtaaatgaaacatgctggagacacattagagatttttcttaggttaccaagattgatttcacaaagccaagtagaaattcagcttttcctaaatgttctctgtatctgttgtcatcagtctcatctgtcattttctttaaatagcatctccttctctgccttaaaacatatcagtgataccaagtctttctactttcctttttctaggcatcatacaagttttactgtcccagtaaaagtcatattttattaagctcattccattggctcccaggtatagactaacctggtgaataagaaaagcacagcatcagcatgaggtccacaccccagccaacttaaaatgccaggcaccatgcaggctaccctttgtgcatctaggactcacatttctcttcccgggtcttgggttgggtgttaggtcttcaaggaccctgatctcactgcttgtttgtgcaaaatgtacttctatgtgttaaagcacttgccgctctgattctagttgggaagggcctaaatggcaaagaacctaaatattttggggctggaaacctcagaataggtggccacttttgaaagcccaagagaaaactcttctctcctcttcctccttcattgaatgcaaatactcgctcataggtgttggagagctcgagggattttgaccacctttgagactttctgatagtatttaaattttaaatttcacattttacttacagaaaaccaacttctaaatgagggctatgagtttaggagcatggagacatgatacttatgtgatcagttacagaaaaatttggttgaatttcacattttatattcagattctttgtcccatgttcacacatgtctggcccttacgaggtactctgtaaatgtctgttgaatgaactgctcccatagtagcttcgggaagtaggaagggcagatggaagtatccccattgcataaataaagaaactcagaggttgttaatgatccagagtcacaaaactgaaagtcaacaggccccagatgaaatcctgagtctctgagtactatacattggtggcaaaccccttggatacatctatgcaaccacgtgtatttatgattgcacaactatgatggatccacttattcttgagtgcaaatgtgctttttccctttcccatggaattgtagtaaattttatcctattttgtttattttccaaaattgaattaaatgtcatctttgccgggcgcagtgactcacacctgtaatcccaacacattgggaggctgaggcagtcagatcacctgatgtcaggagttcgagacgagcctggccaatgtgctgaaaccccatctctactaaaaatacaaaaattagccgggtgtggtggtgagtgcctgtaatcccagctatttgggaggctgaggcaggagaatcacttgaacctgggaggtggaggtggcagtgagctgagatcgcgccattgcactccagcctgggcaacaagagtgaaacttcgtctcaaaaaaaaaaaagaagaaaaaatatgtagtctcatccattctctttccatttgccccagctttcattgtctttatttccattcttctgttttgtgagtttattccttccatttccccccattttacctgttcccttttactcttctctattcctgctgtccctgtgccaattgcaaactctcctgcttctatggaatcaccagaatgagatcctcaagtagtggagagactggcccggggagggaggggaactgctctgggtcacagagggttcttggcagtggattgccaagactcacattcccttgctcactctcccctgagcctctgaacatgtaaggatctggagcaaaccatgcccccagagcaaaacagaggatgctttattctgctaagggctgctgtcagatcagccagggtgctaggggtactttcagagagtgacttttctgtggtagaagctaggttttccctattgcattctgaactttaaggtgtctgtccattctatggatcttgtcctaggaaattgattgccctaatcctaaatattatccactctacttggtaatttccagaatctgtctgtggatataaatagtaatccttggtgctttctctgctgctcctgatgactgtgtggtcccagcatgtgttggctctcagccaaagtgcgtgtttgtaccattggacatatttcagagcattgaatgttcacttccattttctgctgaaaattcccatagaattctacttgggacacatgttgttttgccataagccatcaaatttcttggttactaaagaacccatgcctagatttggccttctcttcaaactctggtcacagaactgatacacagattgtattttaagatacagtaaaatgatcccagtgacctaatttataatggttgataggaatctgcttttcctttctgtgtttggattctggattcttgcatataggcagatgcttacagtactgaacctatactctgcttcagagaggctgcagcactcactgccttggttttgagatttctggtccctaaatatgtcccttctcccctctttctacaggcaaaagagccataaggtagagttggctcagaaaagaaaagcagggcttttgctctctcacctcctacctctgtccattctgcatacacctgagccttgggtactgctctcaggtagaattagtcagcatcctataagagcattccttaaagaggggaatttccagccatccctgcaattatgtcctcatcgatgttgtggctggaggcaggtgacagctccaggcccatgtgtttcctggccctagttcttttttcataaaacccacctgcttttgtcctccttctgcattttatgcttagtccacaagaagttggtggggcctcacagtccaacagaagaatgaagcagtcacagcagcccctcctggggcaccagcttgaggccgtgggatcccgtactcccactgagcccctctctgtgaatgcagggccagcttttctgattgatgctctgcttcccttgcactttcaccaacagattagtcaatgtgcagccctttgaactctgacagacaggcaaggggtccaacctgctctgttgcccccagaagatgaattctgtatatagagttgttattcctagcttttgcttagggaggaataaaaagaatttattttatgttttgaggttaaatgaatgtgggataaatgtatacatagcatcctgtgtgtatatatgtatgtattgctctatgtcagatgaactgacgacttttccacatatggaagaatttcacaagatcatgtttagctagaaacttctctccctaacttcctctgagtgcatgtttgaatatacgttatatatacatatatatgtatgtgtgcacataaatatatcttcatgtttccttcactgaagaaaaattaacaccgtatatcagggcttactaaagtatagttatggaacatacaaaaaaccaggaatctttagttccccatgatagtaacctgataagaaaagttacatgttttaggcttttaatatcagtttccaaccaagctagtatgtctaaagcttgcccagataagagacagtatatatatatatatatatatatatatattttttttttttttttttttttttttttttgcattgcaaatctaatgtcatggcccacttcttggaaggagccttgagttttgtttcacgtggggatgaagccttcagattcaacaacccatgaagaaacctcttattggtgctgatgtgtattgcatgggagaagggttcagaagttttgaccgttgccactcctgggccagtcctttcagaactgtagccaaggatatcctggcatgcattttgaaatagctcttgagagccacttgcctctttcccaatacttcttttctcacaagtagattggaggatactgtgtttagcaggttaagaaatagaaagatatcgcagatgtctcttttttctttatccctcagagactactaaaaatccccaaaactactagaaagtgagccagacggcatatgtgatttcccacccttgggaaataaaaggggcagtttatttgtttgcttgtttttaagagcagaagctgtagagtaaccctgcagtggctctctgtgaggccacaggtaaagaaggaaatggggacaaatgtctgaactgttgttgtgggaggtatttaactgcctccttcctctaccagcagttacatgctcacccaaccattaagagctacaggagagggagggaggcggagttacgcagcagttgggaagctggctttgcagatgagcaggttattgtcaaagccctttaatctgggtgcgatgctaattccctgcatgtgagcacatgagggcatgattaataagccctgccaggtagggtcttcactgagtatgggaaaaatgcagagctgcttaatgcatcaggatcctcctgttagaaaaggatttttccttaaaggaggtttgagcctactgaagatttcattcagtcttatgctatttggggtagagtgttttttttttcttttactgatttgtctaggttttacaccttgtttgcagtattagggttacattaagagatttgttgcagtatcctttgagtcaacaggggtttttcagacatagcctgcactctccagcttacagatgcaacgcatcttggcaacattggagggttgatttcttttcaacttgctgctttaatccagtcgcatttgtctaagaggcagcactttagctcccccattgagagggggtggccaaccttgaaatgtcgggaagcagggaaatccattttatattgctaaacaccattgcctctctttttttctataactgatgtaatagggatcatgtttgacttacaacactccaggcacttgcagcactccaaagataagggaccagcagaggaaagggagtaggaagcatcctttaaacataccctgcacacactcacaaagtctgttattgcaggaaaccaccttacagaccaatagcattttaaaaattcggatttgggcatccatctattaatgatcttaataatgtcaattttgaacagcccagagactctaaaatatttaagaatcattttgtaccccatcagatcctttttagacacaccattttgccttcagctttagtgtaatatcaaataatttgttttactagtaatcaactcttaatgctaccaacagggatgatatgtctagttatattggtctaagtctgtaacatccacaaagtggtttaatttacattcttgggtttaatttgcacagcaaacctatgaagcatcagggccaggatatggtagtcccattttcttttcttttcttttttttttcttttttttttttgagacggagtctcgctcttgttgcccaggctggagtgagtgcaatggcgcgatctcggctcaccgcaacctccatctcccaggttcaagcgattctcctgcctcagcctcccctcattttcttttttaagcagctgaggaaatgaagagtcaaaaggaaatttgattgcctaccatgaaggaaatggcagaaccagagtcatgttaaaaacacaattttcactttgtttaacaaagccaagtgttaatgactgatcgatgaaggagcgaaaataaagcctgtcttcactcccacccttttttatggttatctggcaatggttccgcttttagcagatgttgattttaagctcccaaacaatattgttggccgacatagaggcttcgaccattctcatcttcagctgggtatctgatgtccttgagctgaatgaactggcacagtgcaccaaagactagtttgtcacagctattttgcttgaaggaaatagaaaactagtttcttcaatttgccctataatgacgatgcaaaaaaaaaaaattgaggaagcacttaaagatgttatattagaagtggaggaaaaggccacccaaacttctataacgttcttgatggcttgacaaagtggtctcaggtggctgccctgcctcagcgtgtcctagtgaggtgaacttgctgagaagaaccaatccaggctgcacagattctccagtacctgcctctcccttgagagacaccccagtgtgtcttttaaaatatggacatctcctactgtgatccccctcagccaatgaagtttcgctttcaccactggggtgtagaagaataaaccagagatgtggctcgtgcgatagaagaggggaagagtcattctgagaagacacaagtcaacacaatcttggcaatcgtaaggaactctgggaatccaggaagcatattccttcagaggaatccagtcattcaaaacagtgagaactgagccttccataattactcatttagaaatatctaagttcccacatctgagaatcatggcacagtatgaaggaggtgaaggtgctgcctttcccctcagagatcttaaaatgtgttggggtgctgctgatatgtccacgtaaatagcttccacttgcatatgaagacccctttcttccaagagccagagggacccaactaaattgtagcttctagttccaaccatggtcttcaacagcttggaaagaaggcaggaccaagttcaacgtactctagagctgagctaagcagaaccaacaaatgtcttctggggtcaaagtgaactcttctttttgtggcttctcggctcatatggtggagtcagaagggtgtacttttgtggttagacaggctggaatttgaccctggctccccagctgctggccaggtgtcctttggtgagctacctgacctccctccctgagccttcctttccatatctgcacaaagaacctcctgacacctgtgtcactgggccttggtgagcctcagggaggaaacacagaagccgtcagcactctttctaacctggaggaggtgcaaatacatactggctcttttctatcccagctcagaaataagctaacgcttatttttaaaagagcaggaagcagatttctgaacctggctaggactttcctgttttggcgggggatcttacctgcaaatgggccccagagattataataaatacaagtcatgtaagagtttatagccatacctgaccccatcacctgaacagagacattcatccatggactaagcattccaggaagcaggagaaataaaagacagaatgaatggtctccagagggaaggtttggacttgaccttagcagaaaacctactagtaccctgatgaggctcggtgccccacatttgcaggctcatgcctaagcctattgttttcctttacagatgtgtctgtttttcccggctctggccaagcctgcagttggaaatgctaacagcatctgctttggttgagcccaggctcagggcacatcataaattccacactgtgatcttgctttcatgacttgtgcagccaaacgttgcaaagtcctggggcttgaagtttcagaagctttagagaagccatgaatgaattaggggtggaggcgagtctgaagactgcccacaccagacctagttataaccaggatcatctccttgcaccccttccagcaaggtagccaggtggaccttccaggcagagaccgtggctgagttcccacaaaggcagtaggctatttgaaagtgatacttcgctggttctacttgctttcctttctaggacaggagtgacagtaagatccccattaggaacttaattctttgatttcaagaaaaaaagccagctatcaactcaaagagaatttcaggtgttttaaaaaaaaaaaaaatccggtggtggcctcaggtttgcctgctggctatacctaatacttcaaaatagagaccaattaaaggtttacactgggccattcatttatcatgtcagattatagagtttcttctcagagcctctttgctggagctaataaatgcccccccacaacaacaagtctcttgtcttgtcaacgatgactcagtccctttgcctttagagcttgtcatcaacatagccgctgtgagcagcccatcggtgaggaattttgttttatctcaatatttacagaatcccattagggcgcagcatctgggactacaggatttccatcaagacccccttgtctgtcacgtcatccctggaactgtagatgtgtcctgaggttatttgatagttaaacctcctccccttcagaatttgctgggttttgtggtcactgtgctctctgggcttcggtccaccttggatgttcccatccccagatgaacaaaagcatgcagatgactgatggactagagtctttcttcccatccagatattttggcaactggtggcagaacaatcactcacaaaggacacacaagggatcaaacaccgagcagcattcagaacagccactgcaaagtagatttggaaacagaaaaacaaggaaaggaaacagactctcccaggcctgatagatgcattttaaaatgccaagtatttctcaacaacttagcatgaagttaaggatcaagtgatacttgtctgtttcttatttttgggtccccaaatttacatttctgtgcagtaaggttgctgaacaaattaatatttgcatacagagatgcaggcagcgcagcagtgaaacagctgcatatgtttggaaagacttggagctcccgcactgattagctcctgcatttttgttttttattccccaaacggacactcactctgacccagatcatttggcgatgagggtcaattcatgtttaagctttgaaggttagagagaccagaaagagccaccacttctctattttcttttaaaaactttaaactttaaaaaactaaaaacttttaaaaatgcataatattctgagttcatgaaaggaatttatccacatttctgccacattaaatgttagcaaagtttacattggactgtcatatttctttactttattcactagcatacaagatgtcgatctgaacatctggtttttaataaccctcgacatctgggagcccctttttattcctatggtggacgaggaacagtagtagtgatattggcagcgtgtactttcaaactacaactcctgtctgtttcaatcataattaattaccactttttaatatatttaatttgctaaaagtgatttgcattagaccacattccactgttaagaaaatagtagtaggttttggtggcagtggcttttctttttgcttactttcttctcttttaaaaattaaaacctgataggaatggatttggaacaaaatgaatgtatatatgttgggttttaaatgtgaaatgaaataaactgctctgcaagttattttatagctatttaggaagaagtcggcagtggccgtaggctgtgttttagagaaagcctcctattttgctttgtgactttggcaaatcatagcatccttctatgcttggagtttttctacagcagcgattctgggggtcaagaatcatatgatgaaagctagggcctccatccagagacatatatttgcacacatactcaacaacattcttcattgaatttcaaggggttgctaggccccttgaaacccatttatgaatggcctagggtctcatggtgtaaacttccctccttcatgaagatgaaaaggagcatcaaagtttcttttctccagggacagagaggaagttaaatgaatgtaaaaatacatttttcctaagtcacatagggaaaagggaagtttcttggcaagagcaattattagactgtttaataataaataaacacagataatttttacataagaaggcccagctaaaatgatcaatgtgttttattgtttgccagaatattcctacctaagctgtcaagtgaaaattcatactgagttgtccagttcagactctgtgcaaatcattccattgactcaagtcagtcagggatttgtaaccttcgtgggccgtggatccctttggcagtatgatgaactctctggatctcttctcagaatacttttttcaatgcataaaataaaatacatagaaatacaaaggaaataaactgtattgaaagtcagttgaaaaataaatctttgagtagataaaaatgactaggcctattggccggattaggtggaactgtatgaaactgctatttttctaggtaaaaatggccaaatattggcattttcataggattcaacctaagagtgtaacaacttaaccaataaggagtcaaataatgagaaaatgttccaggttattttttttcttctattcctgattttcaaaacaagaagcaaattatggaaaaatctgacttcactggagacctattaaaaggcacagctctcaaactatgtgtgacaccagggtatgtttcaatccttgcagtaaactgtgagaattgttcaaaaaagggactttgctttggggatatacttctgtcttcaaagattccatttccctctatattagccacttcactaagtgaggaaagtcaccagagctattttcgaaacacttttcaacaagaattccaaccaaagaagtttcagtttatccataattgaacacaattttaagttaagcaaaactttctttctacaagcattctactgaattgaaagtttacctctcttttctttgaaacttatttgattgcaaatgtataatcattccatgcaactgtataatcataccatcgccagtgcatcctctttcatgctgagagcaaaatagaatctgtcaactaagaagatcgcagcatgtttgagcctttgtggaataaccaatatgaattatcgcatgctgaaaaagtttgttccaccccagtagatggagttgtgtgtgtgtgtgtgtgcgtgtgtgtgtgtgtttttaattcttcagcctttattgatactttaagcttaagagaaattaagggtatttgattactataattacttctctgcttacttaaaaggtttaatctactccttaggcatatgcaattcagattgcatgctttccaaaaaaataatcatctgctaatgtagactaattttaatcttctaatccgattttgacacagactcagagctgggtgggtggaatgtttttgtgtgtgggttgccatagatacaaaacccggttatgtatttgacaagtcggtgatgtggaatttaagttactatggatttttttcttcagtcttgaagattaaaaaacaaagtgaagattagtgtgcctttccagtgcatctcggtgtaactaaccttctcttctttcattctggtgctcccctcctctctgtgcacctccccacctcgggccggccgcaggatgacgaggagggcatatgggcatagccgggcctgtaaaccaaagttccagttttgttttgaggggtgagaaaccatcttttatatcatttttattaaaaaattgcattctagtgttgtattgtgtgcgtgctcgattgtgctcgctgatgtttgtgaattgtgccctgtgtttgctactgtgttctgtgagcgcagaatgtccgcgtgccctgacccttcccaagagccccctccatcctacctcacctccccaccccacaaccacattactgctctgccttgttggggctgggtttagcacgattcaaatgtttctgtgttatttaagatgtaaactgtgcccttactaggatttatacacactttttaaggcatgattgtggactcagaaattgtcgcaattctccagtcgtggttttcagccgactgcttgctttcaccagatatgccagtgtggtgtgactctcacgtccttctggttgtgtcaaatgtttggcaaggaataaggaaaataaaatatgtatcttcatggagctgaaactatcatctctaagaaggccgtttaatggattgtgctatctcttctatggcagttctgaagaaaacacaaggatcaaggcatagtaatggtgaatgggtaactgtaactctttaaatgaattagaatagaaacattcatattagcaggtcttattagtgacattttatctgttgctttttaaaaattatacttctatgaggctttgcattagaaattatacacattgtatttatcagagggttttgtattttaaaagctgatctttagctattgagaatccaccctttatttacatcctgtctgcattacgattgaatagtgacacatgtaattaccacatggttatgaatggaatactgaagtctagcaacttttgctgctgggaattacacctctcctctatactgcaggctgtttaacaccaagtcacaaactccctggagttgaatatacacatggttacatggaatatggtattaaacttgataacattgcatatgatgttttattcagaacaaggaatgtggttgattgtgtgccatggtgatttttttctgatcagaaagtattcaatctatagctctttattctgggacaagcatgaaatgacacagtgctggagattcaacaggtgtgggacaattctttgggataacttagcatgtatgtctttccccgagtcttgccttcaaatagcatggcaggtagtgcttcaggtgaagtttaaccaagagctggtacgtttggcctgtgggtgacgtttcattgttgtgttttacttcttagttgaacctgttacatgtcccactaatgggtcagtttgctttttttggtactgagggggcagttcacaggatggtggttttcaggtacgacatctttctacatagtaaagatgtaatgcctcctggatccatttgctgccagtaaaacctgcttcatgttaatacagaagtatctcatctcttctcccttttcttggcaaaggggaaaacggcactggaattaacacttccagatgcaaagtcattctgcaggaaagcttgtcagtatgaggaagtggggaaatcagagaagttctggatgtctatgggagcaactctctccctatgtagggaaaatattaagagaaatgtcacatttactcacagagaaaagctaataaaagtggcaattgacctaaagtcatatgaaatgagaagaaagcgttttatagcgttaaaaagcaaacacatgaagcctgcctcaaacatgcatggaagaggtaggtaaaggaaagttctaagagtttggcagttgtcttgaaaagtgtagatcctacttggggctcttctgtgaagctacttctgccatcatgagtatcagggcgctaggctgcacttgtgtttcctcctgaatagtgaagattttgtattgctctttcacaagattcatgacaccctgagatatgaacagtgttgttatcctcaggatggaattggctccaagacccgtaggaaatcttgctttgcttaaggcaaatgcagacgattgtattaagccctatcccctttatttcttcgtgaatttccccaaatgccatgcacaccagaaaataaatgtttttagaaatttagtcaatatataatcctactttagtatgctgtaataaatttcatatgcttcagaggaaaactacttatctttctttatgactcctttaaacaagtttgcttagatatcctcaggcttttaaaaccatatctttaaggatttaaataatgagatactgggggaaccttctgtttttgagcagccgttgcatgttttgagttgcattacaatccatgaggccttaggagacattaaatttataactaaagatggataatagtggtacattaaaaattaactgttttcaatgttttgatttatggcccctataaaagaaacatcacaagatgttattttactagacatcagtaatatgctcataatagcatcggaaggctctgacttgaatctggagttttggtgctgaaatgaacataatttagaaaaagtcactctaaaaattacaacaaattggaattagcataacaaccccatcagctcctcccttttttgccacttctggaggctaagtccagacatgatttatttgtctcactatggtcattcaagagtggtattttccgagcacacggtggaccggggaaagtttacttttctaaagagttttgacaccccctagagctagcctttcccctcttaaacctcacacccaggcctggatttatcagcgtatggcctgtgcagtccacaggccctacacttggaagggcttcactcttaggttaaaactctgctgtcactgtcttgaaattcctaatgtttttcaaagaaggggcctcacatgttcatttgccctcagcgccactaattatgtagtctatgctgcctacaccaaacatatattcctatattctgcttcccaattctctttatactccccctccctgttggatcatccacactcttgttttcttatgcctaagatttacctgtggccagcctcattgttctgggtttcttctagagactccacgggatcacttttccagcaagttcttgccatcataggcatccctggcaaagcatattcaaccactgtcctctcaccaccaaccccccaaaccccacactcacacatactttcaattgtgaaaatgtgctcttggaggcctaactgtattccctatcttgccttgcaaaatgcagaaaaagcagctcctcaattctccataattgttcttcaggaaaatccacttaatgtaggtatcatttgtgtcagcaaatacttcttcatttacattgaatgaaggtgctttccatggatcccccaagaggcattcgggtttgcgaacatcaatgaggtaggcaatggaggagcaaatcgaggcaccttgtgagatttagtgccacctctgcctcgacatttgaatgtttgagctcttactgtgaactcttgtaattgagcaaagatagaacacaagtttttatttcttaaaccactagaaaggaattagtcttttttgattgaaaacatatgcaaatttttaggacccgattcataaaaatacagatgtggcattaacaagttttggcatgaggctgtgatgctagtagatgcagcctgttcaaaatgaagaattgtagctgtctgccaccagctcatggacaatgttatggtgagtaaaaatatgaatcccagaacatttagacacgaggaagtggtgttttacaaataaaagcagtgctggatggcccagtggaactccctgccatgcctcccctctggaagaatgaaagaaggaggaaggagatgttttattgtggctaggaagttcaggtctgacttgccttcttttagcggacagggtctggacactaggcctgtgcttgtcctggaactagagaaatttaatggctgcaaaaagaaaatcaaggaaagagctctgagctctacacaaagcagaggtttctatacaaagtggtggtttctatgcaaagtgcaggttttctttcacaccgcctgtacaggggtagctactgctgcttttaatgcaatttagattttgtataactgaggatctgatatatctctttcttgtgccattggctactaagactttcatttattcattcattcatttattattcactcatttgtccattctttcaccaaacggttaagttctcagttagatgctaggaaaccagtgacgaataagattgccatggttgctcccctgtggatcttgccatctagtcaagggacagaatataaataattagacatctcaatagaaaccttgcacgttttggtcatggctttgatggaaaccagaaagatactgagattaacttgaggaacctacttaaggaaggatgttcagcaagcatctctccaaggaagtaagttttaagccaagtcttaaaaggggagagtcaggaggtatccatgccaaggcgtgcatttgggaggtggtcccgggaggcatgcaaaagctggaggtgggaaggagtttataagctgaagaggcttgaagaccataactctgggtagagcacaaaacagtgagatgaggatggagaagaaggaagggaccagaaaacgtagggccttttatggcgaggtagagagtttagattttaagcctaagaaaactgagcagacatcagaggagtttaagcagggacatgacatgatttgatttatgttgtagaacaaccctggctgctgtgtagaggatgaattgtcgtggcaggaagagcagaagtagaggctgttccatgatctgtgagagaattgatggcactgacccagggcagcagtagtggagatgcagacaagtggataaattggagataagactaggaaggtgaagccaggaggacttggatggggaggtaagacaaaggacaaaattgagaatgcctccagatttctaccttgggtgtcaaagctggagcaggccattattggtggtggtgggggcactgagagggaactcagagttctggtttccccagatgtccagtcgctctggccaagggaagggcaggcttttgaccttggctgttttccatgttcctgcatatcagcaggggaatctctggcctcttattgcagtaatgtgcaggctgacaagtttaaagcacgtctgaagtctaacttcaagagtgggtggctcctccaactcttgaagaaaaggagattgcaaagcaaaatcagtagttatagaataagaagacatgtaaggggtagcaatctgtggaaaaacaaaaaccccagagttgtaggaggttgaaagggacctagggactagagggacctagagagaaggaagttgccattggctcttgtagttccccctgagatctccagggatcaagaattctgtcagttaaggggtacaacatgagattttgattgctcttgataattgacttctcatcttgaaattctaagtatattatttttctgcagaagaagctttcaataatctcttttcaggagttaatatgagaactaaccagaagtagctacgaggtgttttagaaccaccatgacaatgtctctgcctacttccaattgcaaaatcgattcctgggcaaagtaagatgtttttgctttatctctgtccccacttcctccttttattttgctcttctactcctctggaaggtgtctgtatatttatatcttctattcaggcttacaaagctgctgtttagagcttcaacttgaatatcctattcacagtctttgcaattagtaatttattcaaaaaatatttcttcatcttagtactggagatgtactggatatacatctcagtactgagtcaaggtagtgaacaaagtgtgattcctaccctcgaggagcttagagtagtacatagattctcaagcaggcgtccataagccctggaggctctgcaaatcccctgacatggttaataggcttcaatgtggatgtatgcacatccccacaaagagagtatttatttatgttcctcagcagatagaggggccagtgactcagaaaaagtgaagaagaccctcatctatggtggggtggctaacagtgtggtctctggattcagatagacctaggtttggatgatcgtgggtaagtcaccttccgtctctcccctccattttctctttgaggaaggttgtgacacccccagggctgtgatgagctgagtaagatgccaagtcatgcctggtgcacagtgagtattcaaccctgggtagaatatcagtatatcactattattgttacttctgggctcaggaaagtgtactgtatccataaacagaggaaagtggttgatactggggttgttgaatttgggaggtaaaagaaaaggcaaaagaaaggtaatctattcctatggccatagctacacccaagccacctacatagcaggccttacttaaagcatgtttaccctataaacataccctctccagttacctttgatttttataacacttgggtatagcaaaggaaagtttgattgttggagagtatgaattagtccctgtttatagcagagggtttctttcggcttaaagaaaaatctaatgagtaacatgaaagccaatgaatatttaacaaataattaattgcgagctaatgaattggaagagagaaaaggataataatgtctcagtccacctctttctgctctcaagggtgatggacttgggggccaaggtagaagcttttaaggagattggagggcagtaaataagttcttgtgggtttctctggagctcataagggttacctggcagagcaatgcatgttggcttagatatgaccacactctgaggacctgaaatctggctgagaaatcataaacaaacagtggtgataaattaccactgggccagaggcgggaggcgtctagcagagtgttgttacattacattacatccttcctgtgccagggctggcgcacagggagcatgctggctctcccacccttttgtcatttgctttagagtatgctgttggtctggtcttgtttaacctctttattaatgatctgtaaaggggagaaaagagcatgtgaaggaaagtcacagatgacactaatttggaaggtgttggaaacactagttgaggtcagagaaatcacacaaatggcctgaagaaggttaggaacatggagggaaaataacaaatcttggagaagtccagacactcacatctggtgaaaattaatctgagacacagataccaatgggtgggagggatatgaaaagctgaatgctaaaataataataataataataataataataataataataagcagctcagtaaacgtcagcgaaaccagccagcccaaaagtctgctatgggtgagagtagggagagaggtgcctttggtagttagcactgtcagtgttagcaggtgccagagagacatgcgtgatcttatgtgacaattgtcttacacctgggacatcacaatattatacatgctttatctcagaggatcacccaagttatcagaaagatggaaagaaaggctgtgcacgctggctcacacctgtaatccaagcactttgggaggccaaggcggacagatcacttgaggtcaggagttcaagaccagcctggccaacatggagaaaccctgtctctactaaaaatgcaaaaaaattagttgggcgtagtggcacatgcctgtattcccagctacctgggaagctgaggcaggagaattgcttgaacctgggaggcagaggttgcagtgagcagagaccgtgccattgcactccagtctggacgacaagagcgaaactctctctcaaaaaaaaaaaaaaaaaaaaaaaaaaaaaaaaaagaaagaaaagagaaagaaagatggaaagggtttttaaacgatgcagggcatcatttaatgttggaggcagaaccaaagcttctaaaagaattattaataacatttgaaaatggccataatggcactttcagggagaccagaaggtattgctctagaacatgcaaatgtggggttgagaaggctcacaggtttcattttgagacttgtagcctgagaatagatacttctcagaggcctctttggggagccatccaattggtggccaacgtaatgctctgagtcagaattgtcttgttggttcagggaaagcaactccagccccacctctttccaaccatctccacagccccaaccaaaggggaaaaccaagacgacatctaaaatcagagcacatattatggccaccactaggtgtatcaatcagaatggctagattcctttctgctattggagcatccattggctggaggtcattagccttaccaagacgtaccttaactctgtcctcaggcctcccccatatattccttctccagagtcacatgatctctgcaggaaaattgctagtccaccatctggtggctacctggtgttcttatgaaactcttactgcaaccctcattgtggcttccccatgaacatgtttgtcagagactttgagatgggaatgtattctgggaatatacatgtcctctagctttgttttctgggaaatataatgtaaatgctgagaacaacagcacacagcaactgagaacttccactgtgccaggtcaggatctaaggtgctcgtgtgttcaatcttgagtggagtaaaattgggatgtcaggcccccatccctctgaagcagatcctgcacttgtaaacatgggtccatgcatgccttgcagctcacagggttgttcccatggtgacaaaatcactgagatgctgagcctttataaggagactccttgccatttctttcagcctaagagtcagcgtttgcaacctcaccgtgtgcccttctgctgtgcaccttaataaatcaggtcccttcttttaggtttgtgtgggtggttgaagggcaagggtagctttaaaatctgccagtccccaaacatttccttagttcctcagtcactgtgtatatgcagagaggtagaaacagagcccctggaagtttgaagaagaaagattgttataatctcttcgagagaagatttctcagttaaacctattagatccagaataaaaaggcagactcccatatgtggcgaaagacccctcgctgcacattgtatctttgtccatcagagggcaaacataagacgaggccctgaaataataatcgcagattgctttcactgggaaatctgagcttcctacagccaccaattcattttcctcatgtattacttttatgctcattttacaaaacttaggaaatttaataagtatatcaggaaaaaaattttctcaaaatcctcattcagagaaagcatcatttttaacttttcagtatatatcttgccatatttttcctatgcagatggtcttgtaaatatgtacttgatggagatgggaatctctgtctttgcataatctttggcgcagagtggttgggcagtacccaggctctagagcctcacagaccaagttcaaatactggttccaccactcccacctgatggattaagcctttaaaggtagctaagactgtttttggtggtgttatcatttacttggcattacatgactgtttttcacatctgtttataattttaagatatgctctgcatcgggcagtcgggaggtcagggcaggctggagtggccacgcacactagagccctttggatgcagaggctgggaagagtacactgttgcccattgggtttgttcttggcagtggcatgaggcttcattgttccctgctcacgtgtcagaggagtgcctctgattgccctgagtcagcgtgtgatggaattagcaaccttgctgatcccccagcctctgctgttcttctttctgtgcaccttgatccctgaagtcactgtgttatttgaaaggagtttctgtacaaatcactctactaaaaaaaaaaaaaaaaaaaaaaacttggtaattaaaaagggagtctccccattggcccacggcactggattgtaaacggattcagtgtgtgggactctggctgctgttttgtgttgggtttgtggttttacttatttttttgtacttgtctcccctggtgctggggcactagcttgggagcatgataaaaatcatgttatcgaagaaacctctctgctcctctttttttttattttttatttttttgagacggagtcttgctttgtcaccgggctagagtgcagtggtgtgatcttggctgactgcaacctccgtctcccaggttcaagtgattctcctgcctcagcctcccgagtagctgggagtacaggcgtgcgccaccatgcccagctagtttttgtatttttagtagagacggggtttcaccatgttggccaggatggtctcaatctctcgacctcgtgatctgcccacctcggcctcccaaagtgctgggattacaggcgtaagccaccgtgcccggcctctgctcccctttgtctgaaggcaggtgacacattgggaaactcatggcaagcctgttttcttctcagagaggaagggcttgcagggctaacagtgtttcccccagctgatccgaaacatgatttgggctcagtacaattggccactgcaaagaattgtccttccccctcacggaatgtggaatgagaaagggagaatgaggaagtcttctagagccagagagcaatctttgtccctcattatataacaggcttgggacacagggaaatctaatatatcagataaggaggtgacgatgtgtgagggtgccagctaagatgcaccagatgaattttctccatgttattatttttaaaaattatgaatgcaccaacatgctgatggagcccggactgttgagccattttttcatgtgagggcctgactccatgcaagagactcctacgccccgaagcctgcaggagctttatgtagctgggttgcatttccatggcagggactggggacagggaaggatggactctggcgtttgcccctctgtaggtcactgctgtcctgacaaacactgagggggccttcagcacagtggctttctgcctagttcactcatcttagggaaaacaccttaaagttccaagagctgacactgccatttcttctacttctgtctcactcacatagcacccttgccagtttagagaaaatgccctgtgtccctgattttcatctgatctcccatcagctctacgaggagggcagacaggtgacaccatgcccattttatagagtaagaaaaggaggtttgtccagggctatacagatgagacacaggggaactagtacgtgaacttcaaacatgtgactcttggccagctactccttccactatagtagtaattccctaaggtgttcctcagtgcactgatggtgttggatattaaaagacttttttttttttttttttgagatagggtcctcctctgtcaccgaggctggagtgcaatggtgtgatcatggctctcggcagtctcagacttgtgggttcaagcgagatcctccacatcagcctcccatgtagctaggaggcacacaccaccatacttggctatttgtgtaggggtggggggcctagagatggcatcttgccatgttgtccaggttggtctcaaacttctggactcaggtgatccacctcagctcccaaggtgctgagattacaggaatgagctacccgacctggccactattttaaaaaatagtcataaaggcatatggtgttcaaataagtttgagcaaagctggattaaacagcattaataggtttctccactgcaggccttctcagagccttcaataggccagggtcctccagtcagctgtcacactccagagagacagcgtttgctgtgcttattgctcacagccccttttcttctcacaccctcatgtagaattagggtgcacagaatatatctggggaaagttttgctgcagcctgacttctcttggactataggatgagccattttccaagcaggtggagctaccaccactgactgaggtggttaacacgaagcctggacaaccgcatgccaaaaatgatgaattggcctgaaaaggagaaggccgatagcctagcaccaccattaggcttttctttttctatgtttggcaactatgttttgccaagtgcttacttatgtggagcttaatgggcatatatattcactgttcaagaagactgagacaaataaaaaggaacttggggcctttctcaaaggatgtcggcaaaggagaggctagcatttcctctcctgtgccgatgaccacgtgcccaccactgtcccaagttagggcttactagaaaactttgcaatgtccagatagtaaatattttaggttttgtggtccaaaatctgtgggcaaaatccagatatagatgtttatataacaagaaagaaaacaaatgttcatagatttttttattgaagaaattcaaaatataatgagtataattttttgtaatatacctctactaatgagaagagagtgggtttcttttaggggataacatgtcactttattggggatcaaaattagtattctctgttatcaaaatatattgcaaatgttcatctgttaatgatgatctgtaatggtattttatgtatttcatctttaaaaatatctgtccatacagataggtgatatgcatgacactcaaagtctggtcaagttagagcaaccttgctgccatttgtagtgtgtgaacagcagtgcaaagccatgagtgtgccacgtgtggtcttggctgcaactccataaccctgccattgccatgcaaaagcagccagagaccatacgagtgggcatggctgtgttccactgtaaactatatttatggacagtgaaatttgaatttcatatcatttccatgtgtcacaaaatattcgttttaaaaaaattcccccccaactgttgaaaaaggtaaaacccattttcgacttgcagaccacacaaaaaccagtggctagctgaatttgacctattgggccattatttgccaccccattctaagtgctttcacattggtcatcttgttcatcctgatgtctccgtatgtggtatgtaccactatgatcctgtcttcaagatgaggaaattcagacacagagagggaaagctctttgcccaaagtcacaaagctccaaaatctcagagctaggatccgaacccaggtatgtctgactccagagctgcagggcggttgcttgtctgcactgactcacattgcattccccatggtgacccttttcaatctctgctgtagtcttcaagctccccaacaaactcccctcatgggaaggggaagatgggcccatttctttaagaatcgtgaagacagccaacaagggctctgtccattttcatcctctccaccttaggggttttctccattgaccacttctctgctttcttctcacatcttatttcaccacctcttcctccttttgttcttcccttttttcatgagtagaatgtccagtctgcatataggatctcatggggtaagagtgtgagctctgcattccagatctgtccctgaaagctgtgtgaccttgggcacaatatttaatctctctgaatttccaatgtcctcatctggaaaatggggaaagcgatttcttacattttcctccctcatggagttcttgtgaagatcaaacgtaatagtggtgtaaaatgcgagctcagtgctagtacatagtaaggcactccataaatactagccttgttgtttttattttcttccctaccactacctactctacattgatcacctctcacaggcttgccacgtcaatatctctgtaattatttatcaagtatctactatgtgttataaagctttaaaagtttacttgctccatgtctcctgaatcaggttgagcattgagtgctgggctttgcattggcacacacggccaagggaacaaatggaaccattctccctggagacttcatgctatgcaccaaaaaccacctggctgggatgggttggatatagctctcgaagagtcaagcaaactgtccagccaataaaaaatatatgcctgcaagttcaaaagccctccatccacagtgccaataaactagcccagttaatagcccattggaattaggtacatgaagaagcttaaaacttttcagccattacaagaaatacaatcatgttttgaagtaggggaaacttcaacagaggccacaaccaagtgaaattacaaagaaaatgtgaaagttgtcttttccctagatctttgtactctcttatcttggccgagccagaatagttacttaaaatattggaaacagcttgttgagaaagcaatgttgcatcttccttgcctggagaaaagcatgtacacacttgcaggctttggtgtattcttagagaggcttcaaggaattgtgcaagcagggtatgttctagcagattatgggttctttgtgtttcatgtttcatggctgccagcagctggcatctttcagaaatcacatgaaaagtgggcagagctccttgtgcaaacttccgagccaaaggttaaggagactttgtgtgtaactcttaatcttgttgggaaattttagggtgaaaaatataattatacctgaaatgccaacaaccaaggccaaaggaatgtctcctctttggagggttctttgttgataagatgaaaaactaagctcttgtgctcctgcctacaaattattcagattatttgaaaagaaatgaaagaagacactgggagggataaccgttgcatactatgctatgtagcacttaactaatacttacctgtttagcagttagttcaataaatatttattgagtacctgctatgtgcacctcaacagaagctaaatattcaagttcctgctctccttgagtagttttactcaagttaagtatattcttactcatctctcaatgtgaggttctggtcataagaagaattcaaggactctggaggttagcacagggtaactttatattgcataatctataattgccatcaattctgtatagatatagattagcatgggcgattcaacaggctggcattgagagctgtgtggtgtggcctgaacaccagtcccagaggtcaagaggggcaacacacaaaggcactaaaaagaagataggaaagtgatactaccacattggaatgaggtgttgtcatcagccggcagaccccaatggagtcctgtgagacttgtagccatggaatccaagtcatgacgatgagcataacttgtcctggagtggagcacaaccgttaaggaaggcttcctttgtccatgtgtaactctacttagtctttctctgccccaccatgtgggtcttaggttgccccattttacagaggagaggctaaattacatcttggtcacacaactcagaggtagaagaacccagactgtaacccagttgtcattccccatcacattccgtgttctttgttcagtattatgtggccaccgctagctatctgatatagcaaggggttattcagacccagctccttaaaccacatgccaaagtctctccccagatgagtttatgagccagctaactcatggttgggaaatcaaatagtgagatacatatatatatataaaatttattatgcattatatatcttatatgtatatagtgagagagatatataatttattatgcattcagcaatctctggaatcatttttggttgtcacaactaggggctgggggtggggtggcagggatgctattggcatccagtaggtagaggccagggactctgctaagtatcctacaacagacaggatgcaagacaaagaagtatccagccctagattcaatagtgctgaagctgagaaatcctggcatagagcatgttctccaggggcaaactgcccacttctcaattccagctccatcactcactagttctgcaacttggaggcaactttcgtaaactctctagggtccagttttcttctctttaacatgtaactaataatagcacacgcctcctggatttgttggggggcaaagtgagttagtgtatggccaggcactaagtgaagtgctgggcacggtgtaattgcttaggagaggcacccttattatttccaaaactggaaggtaagcatctgactgtggggcttccatagctgattctcagctgcactagctggcaatcttagctgcagcatgcagtctcaggatgatgaatggcagactcaggcacttagcatgtgcacaaatagccaggtgcaatgtagaaggaaactcttgttttaaagtgaaattaagtataaataatttaggcgatcactctctaaaggtttcactttaaaagagttcagaaattccctctggaatctttttaaaggtctccatttatctatgcaactagcatttacatcacttttacaatgtgctagacggtttacatggtttaacagatttaattctcaaaacagcatcataagatgagcactatcttcccttgttctttctaaacaaggccacttctcctgaagtatgtggccctgagatcaatcaatgctgttaagttttcattcagtattgtttttcgtattatgttttagctgttatattatcttccattatcctccccaaccctctccacaagcataggaattttagcaacatgacaacatgatataggtttttgtggattagcctgggaaactaacacaatgtttaacatataatatacaacatgtgttatgtaataatgtatacatataagatattggtatgtgctattattcgttacataataactaatattatgtatattaataggcgtgtgctattattagttacatgttaaagagaagaaaactggaccctagagagtttacgaaagttgcctccaagttgcggaactagtgagtgatggagctggaattgagaagtgggcagtttgcctctggagaacacgctctatgccaggatttctcagcttcagcactattgaatctagggctggatacttctttgtcttgcatcctgtctgttgtaggatacttagcagcgtccctggcctctacctactggatgccaatagcatccctgccaccccacccccagcccctagttgtaacaaccaaaaatgattccagagattgctgaatgtcccctggggggcaacatggctcctggttggttgggaaccactgcttttcccctacatgtcattcctggatttgactttgaacattatcagagtttgacccgcagactgaaggaacctcacagactttacagtctgaaagttacctttgacactactcagaggaagcagagctttctcacagagggagggaagggaagtgaacattgaaaatgtccatgtgtgtgttacgacatggaagaggggaccaacagtcaaggtgtgcatggcaggtggaggtacagagggaggagatggtgatttggaaagggtgacatacttgccactgagaacccagcaaatctgaacttgctggtctcctgcgcagtgattgagagctcctgctggagtcaacagacttgattcaaatccccgctccaccgctgatgagctctgtgaccttgggtcagtgatttaatctgagtgcctgtttcctcccctacaaaacctaggcaatagtgtctacctcatggtggtggtgtgagccccttacaggttctacatgagaaagggcttcatagatgctaatcagttgtcctggccaccccacctgaggctgtgatgtttaagggataatgcaacagagtctggactcagactgcccaagtctaaatccatcttggccacatgctagctgtgtgatcttgactgagtagctcagcctctgtgagcctcaaagccctcatttctagtgcctacctagcagagtccatgtatggaagctatgagatgatgcagtgaacccttgcccagttctggagcccagcaaactctcatcagcattagcaccatgatgacacttcccaccttatgatttgtctttcctttctagggctgccataacaaggttctgcaggctttgttcaaggtgtaggcaggcgcacttccttctggggctgtgagggacaatctattccatgcctctcctttagtttctggtggtttggtggcaatctctggtgttccttggcttgtagatgcatcactctgatctctgtcttcattttctcccggcgttgttgagtgcatgtgtctccttgtgtccaaatttccccttcttataaggacaacagtcacctaagatcaggatccaagatgacctcatcttaacaaatgagatctgcaacaaccctgttttcaaataaggtcacattctcaagtactagggattaggatttcaacacatgaattctgagggggcacaactcaatccataacaagattctatgaatcatttaaaggtttcttccagccctgaaattccttgcggaatggctgagatctgagtagcttggggcaaccaaataatggaaccctgagaacagtggaaagagcgctgcttgaagagtcaggaaatgtgctacttgaggaaagtgtcttgatttttttgacttttaaaatcagtttacttgattatgtgtcttctctgtcctgtggggctgatgacggctaccttctacaccttcaccgcgcaccctcttcccaaaattattctgcagactgcagaagaatgtggctgtaaagacaccttgaagctttcaaggctctgtctcagtgtgttattattatccccattatttataaggaataaggcgaaatgttgactcccgtgtggggattcagtgtctgttaacaaggcctcatttctccatcactgcttgcctctctccatcaaatgcagacctactgctaaagttttcaaaagctccctgcgttgcgagatttgagcaaacttgatcttccaggttaaacttaaatattgtttccattttgaagcctgtcatgtgggtgtaccacaaagagcgtttggtttccccacaacctcgcctgaagctctgggccgcggtatgtaggcagtaacagaatactaggaagaaagagagagcctgaaatggatccttggctctcagcctgtgcagagacaaagcaggatgtaagtaaaaccattacttctacctcctgatcaaaggcgagatggtaacccagcccctcctccccaccacccagcaagcaattaacaccgcctggcgtctcctctgcagcgatggcggttcgtgagctcgggctcaggagtggttgaaagtgggggtgccctctgtgcccaggttgaaaaatgtgcgcatttgcgaacagaatgtatgacgaaatggggaaaacacagaaaccaagcttgttgacagcttactcttttcatctacatttgatgcagagtgagatcagaatttgccagtggaacttagaaggtttgtatcacaggaattaagtagactcaagtcgattttgcaaccacctataaacttgttaaatacagattctgattccattaggtctgggtggagcctgagattttacgtttctaacagactcccaggtagggttatcagatttagaggggggaaaaaaataaaaggcttgacatccagtaaaatttgaatttcctatattttatctggcaactcttctcccaggcaatgttaatgctgctggtgtgtgaaccaccctttgagtggcaaagatgtacatcataaagacataaaaacctgatgaaagtataaggctgagttagtggctgagcatctggtacaatttacaaacaagcgcgtagtttacagaatagtcgcactgcaaaatgtgacttggctataggcagagacaaaccaatagcagcaaagagtgtgtgtacatggttagaaacagggttccttgcattcctaggcttagagtcctgggggacagtgtggtactcatgtttgctttatatatttatttacttagccacttagttaatattggtaaatccaaagtaaatttagaactataaaagtaaaaaaagatttttttaaagagctaaaaacaatgcaaagtttaatgttgagggccttgaagaaggcattttgccacattctgcctccctttccaacttgccctccgaaaggaaggggccactgtaattcctcctgcagctcaaccctgataggtgatctgcagacgaggtgggggctggggcataggtttacaatgacatttgacatgcaaacccaagggtctgtttctttgaagctgaaagaactgattctagctcctttgaggatactgggcaaccagagtggccacttacagattgccagaaagttggcactgaaagggagcttagccatcatcgattctagccccacttcactgatgaaggggcagcgctgcagacagcaagttcctcctcctccgagcccctttctcctctactggctgctctggcaggtacattggaaaagctttattccaggggctgtgtagggttaggatttagtttttaaggtctgttttttggggaatttttttgtttggttctgtttgaaagtaaagaacgattgtctaattccaaatcttacttgcctgtattctgtaatggaaaccatctcccttccgttcatccattcttgacagtgggttgaatcttgtatatatgtctcctgtgattttagtaggcttgatttatttaatcaaaggcagataccagacttttcccaaatttaatagtgccatttgttttattattcaagtatttattgagtaccttctatgtgcgaggtctgtggaaggtcacagccatccagaaactagaagttaaatagccctctctcattcagcatgtctcatcaggacttggctctactgtagcaatgaataagcatggaatttaagctgaattgctcagaggttagtcattttagctgtttggccggccttaatttctgaaacatcaaataacatcatatttcaagtcccattgatagataacctatatgcccctacccttagtaatatgtctaacatggtatttttcacccaattctttaaaataatctacattcatgactcaattctcattataaaatatttaagctatattgaagtagacaacttaaaacctgaatgtctccttcactctgtcccccaactctacacttctccccagaagcaatagaccccaattaattggtagatatgtcctttgtctgcatttacaaataatgcacacataattcatttaacacaaattagattatattattcagcttcttctgtgatttgcatttttcacttaacagtatgtcttggtaaactttccgtttcaatatatatagacctaccttattttctaatagcgacagaagtatttcatggaattcccctgccaaggtttattttagccactcacagttaatgggcatttagatagtttgccatgttttgctatcacaaacaagactgcagtaaataattttgtgtatatgcctttgggcgtatgtgcaagtatttctgcacaatagagacccagaattttaattttctacatgaaataaatctgataagctgataagaacaggattggttgccaattggcaaatacattccaatctgagtcttgagtttcccagcccacgctgtcctgtttgtgttaatgcaggattgcccccaagagtcctccctgttcagaccctgctggctgacagtttgaaatctggagttcagcttcatatataaaaaccttagctttgcaatatttaaattcttaaataccctaaaatggtatggactttattaaacagaaagtgaaaaagggaaaatctaagggaatttccctgataaatggattgaaaagtccatatttaacaaagcattagtctcccaggaaaggaggtgggcccactttttttttttaaataaccttttcacgtttttcttctcagctaagccaactccacaaatagcccaaactaaacacgtaatgactgtgctgtgttgagatgtgttttgtttcagattttaaaatgcagcaaataagatgtgataggcagaatctaaagatgcctttccaagatgcccatgctttattcaaacactaaccaggtactggacgaagggactttgcagcttatcttaaaatagagagagtatcctggattatgtaaacggacccaatgtcatgacattagcccttaaaagtcgagaaagaaagtctaagagtcagagtggtgcagtggaagagggaaggggagagattaggcagcagaagaggcagagaggtcccaagggggaggagaggagagacgaggctgtgataaaaggaaaggggctatgagccagggattgcaggtggcctctagaagctgagaatgatgcttagccaactgccagccaggaaagtcccacaaccagacggagctgaattctgccagtgacctgaatgagctggaaagtaaattcagcctcagagctgcaaaaaagattgcagccctgttgacacctggtgattttggcctcatgaaactcagcagagaatgaactgagccgtgttgtgccaaaattctgacctacggaactgtgagataataaatagatattttttaaagtcactaagtgtgtggtaatgtgttaggatagcagtagaaaactaatgcacagacgagttgaaccaacatctgtgtgtgagacttggcccacaggacaagctggtgcattttttactttctagcaactggagcagggtaagggcccaatgttataatatgaagaagaccagcttgcattttctaggtgcttacctcattttaggtgctgtgcacggtactttatgtgcatttcttaccttgttcttcacaacagccctacaaggatttatgcttttattgttattatccctgttttataggtgagggacctgattgaggctcacagaggttagctacctgggcaggtgtcacatggcttattaatggcagggctgggactcaaacccatgtctgtgggacatcatacccaagtctgtgcacataagtgctgtacttcacagtgcaccacgaccccaattaaatatgaagctaatatgtttccatatacaaaattgctgatatttaaactcctgctaaacactcacaactaagaatgcctttcatcacataaagccctttaaccttgttttaatgcccttggaatactacaccactaggtgctgagcaaggagaaaaaaaatcaaatttggatggtcaaggaaataggagactcccacgccacccccgccccaccccccaggttctgcaagccaaagctcagagcacactcttacatttctcttcaaatccttggaggtctcacttgctctagattgtgtcaaagattgtgccccttccctgcaccaggcactcaattccaggggtggaagttgtgatggagacatttttataacttggacataaagatcaggagccaaaaggaatatcaggtggaacaaatgctattgcttacattttatctggaggtgggggtgcgggttgatgtgccaatttgctctcagttgcatgtacagaaattgtgacctcaaattcagccaatggaaagtctgagtatgaacattcacattgttcagacatttaacaaatatgaactgagcttccataatgtgatggggtttgcatgagaagctaatgatgcagtaatgaataaggtgagttccatactcatagatcttccaggctccattactccaggctaatgaaggaagcacagaaaagcaagcaatttcaggatagtataataagtgctgtagtggaggaggcactagatgcctagagcaaatatgggagagacgccataccgagattcagaagccagaagtagtgacccttgagctgtggcctcacggataagtaggagttggccaggtacagaggcggcagaggagaatagcccagccccaggggatgtcatgatgtagatctgatctgggagcctacctatgtccataaatacatctggagtataggaggcaaacaggctatcggttgagactgaggtcagaaagcctttctgctagttttttgaagagattgaacttaattataaggggacttggaaaccattgaaagaaaaggctgagcagtggcatggacggatgtgggtgctttagaaggacccctctggtggaagagccaagaattgatggaggggagtgagtggagcacagagactattgggacctgagagaggtggtagggggtagaaaggaagggtggggagatcagggatggggaaaagcagcgggattccagagctatctgaggaggaggggccacggggtttgttcgtctggtggagggagagaagggagcccaggatgacagacagccaggcctgatttggccaaatcatcatgcaaatattattctgggctgacaggcccaagttgcagtcagcagaggcaacacgggcttataatttgccatttgtgaatgtcctgaggactggagaatcagctaggaagcaaatcttccttctgctgcataagacagccaaaagcacctctgaggataggcatctcagggatttcagagcaggtaacgccttttggttgttttgaatatgctgacagaagaacaaaagctttcaggaaaacaaagcccaaccccttaatgaaacaggaaaggatatacagtttcaaatgcttgcttgctttccttgttttctgagaagaaagatgccttgcctgttgaaggtggcagatgcaggttgctctgtgggcctcgggaaggttcactgcagctgtcacctgcccaacccacgtgtcctgaggcactgtgacatcttgacaggtgtcctgactcttggccttgacatgtcctgtcacgcctgcctgtcagctgggactgggcttggggaagagcttgtgggcctggggcctggtagtacttgcttagttaaacatctgtggctgctatttccctgtcacaggctggcaagtcagaactactcagattcacttgcacagcaatggtccttcagtcttctgattatgtggctctgcaacagggagagggagatattcatgagcaagtgtgcaaaatgcatttaatgcctgctaatggtgtacagccatccattgctttggtctgcccagtgtctgtctccctatcttttgataccaggggccaagtttctctggggaattcctttcagtttttgcagttctgggacagttacccttcacccagcactatgtcaatatgggcacatgactcaagccagccaatcagagttcactttccctagacttggtcactcagagggagctatcccttaggccacagtgattggttcagaaatgggcacataatcaaactagaccaatgagtctcagttctgaaattttgagttaagattgcttggaaaaagaactgtttactctatggaaatagaagctggagtgatgaaatttggggtaccgggagcgacagggccatagtgagaagagaaccctacctgaaaatgaagtcagaaggaaaaggaaagtagacaagaatgatggagagagaggcagagacagatccctgaagacatcatttaagatcccgaattcacctgtgcccaaagccagactagtcctgaatgatttagttacaagaactaataaatgcctttttccataagtcagtttgaggccagatgaatagaaattgcatcccttattgagtcctggctcaagtcaatttagcaagcatttgttaagatccacggtgggagctatacctcagagctccagggagcacaggaggtgtgctacaatcacagccattgccagtattgttattattccatttattagacatttcagacactcctcagcactttacacacattatttcatttcaccctttgagcacatcctttaattaaaaattgttatctacactttacagggaaagaaacctagaccagagaagttaagaaatacatccaggggtgggtgcggtggcttacacctgtaatcccaacactttgcgaggccaaggtgggaggattgcttgagcctaggagttgaaggccagcctgggaaacatggcaaaatcctctctctattttcaaaaaatacaaaaattagccgggcatggtggtgtgtgcttgtagtcccagctacttaggaggctgaggtgggagaattacctgagcccaggaagcagagattccagtgagttgagatcatgccactgcattccagcctaggcgacagagtgagaccctgtctcaaaaaagaaagaaaaaaagaaatatgtctaatatagtaataatagtgacagaggatgtgagttatcgtctacacactggcaggcaaaagaggttacttcctcccatctcaaggacttggaagtaagggaaataagactgtacacccaagaaagcaaaatggaatagatcggagtagagatctgccaagttgccttacagagccaggacagcttccagccagccaggctagatctagctgcctgaatgtattgacagcaaaaaaaaaaacaaaatgaaaaagggtatgtcaggagaggtgtcagccaaccatggaggcaaaagcgggggagtgaaagaggaggatcttggggatgcccttcataccactatccaggagatgggtgtcatagccacggagcttcccagtggccaggccatctctagggggagatgagagggaaggtggggccaggaatccagcagtcactctttccatcaaagccaccatcctgctgtggaatagttccccagggcctcttagcctgatgcccttacatgactacttcaaccaacatccctagttttgaggatgccattcttctcttcatcgtgaccccttctactctcttttaaaattatttctaggcctcttcttccctagaggccgtgtctatgggaaggggactgtgcttgccacagttggacattccaggttctgcagtgatagtttcatatcattgtaaattcagctggccttcggagtctaacttggtttcccctgtgacttcctacaagaagagactgagttggtcagaagctaatgaatcttttggtctatacatctttcagagttctccttataagataatcacaaggtctctattttgtaatgctaaggagacaggagctggctactctggaggctgcctttttggagatgtacttcttctgtggcctgacaaggaaggtttcagagcctcccggactcaaggccaggcctgggtgatggcatagctaccatgtaaagtgcattctccaccaggaatggtggctcatgcttgttaatcccaatgctttgtgaggccaaggtgggaggattacttgagccaggagttcaagactagcctgggcaacatagtgagactcccagctctacaaaaaataaaaagtaaaaacaaaacaaaaaaaatagttggaagtgggggtgtactcctgtagtccaagctactcagaaggctgaggcaggaagatcacttgagaccaggagttcaaggctgcatgagctatgattgcaccactgcatttcagcctgggtgacagagtgagactttttcttctaaaaaaaattctttaaatcaaaactcagaaaaataaataaataaataaataaataaagtgcattccatggatatacctgtgccctggatgagaggggccaagcagctttgcagacagaaagaacaccacaaatttaaactggagtcccagcttcattactagctaagtggataagttttccaactctttaaggctcagtttcctcagataaaacatgaagaaaataataggatctgcctcccagagtggctagaagactaaaatggaaaagaaaagaatgcaaagggtttagcagggcacctgacgtggttgcactcattagctgttagtggctctcttcttgctgatatttttgcatcctgggatgaacacacatccctatccacatacttttctatgtatgatctaggcctgagtgttccatacagtgactcagaccctcaggaaggcagggagtcttggagaaagaaggcacctggccttataggtggcctggctgacccagcaactatccatagggtccagtctggaaatgtcaatgagggaaatgggccagggaggcttggttagaggggcatcacaagtcagcttcagccccacatgccataagggaatgcaagctcagtatagccatatctgtgccatttttcaatagaatccaagaatctagatttatttatgatagcaacttatttcaattcttttaaacactctgcaggcccaacaaccagcccaagtgcaggaaacaatcttggggctcctctaattttgatccataatctaagggctgggcagaaataggtaggagttttctgagtttgggttcctggaagcagactcttctttgtactacatgacaaggatgtagtacaagctgtccttgggggatgtgttcccaggaaacatcaataaggcaatgggaaggcaagccaataaagggggagttgtcaagccaccactgtgggcaactggtgactgcagcttagtcctgctgtggaatgctggaggctagtgtggaacctgagtcatcccactttaggggtgagggagctgtgatatgtgtgtcttcattcctgacggtcatcggccgagggctgctccaaggggcatcaataccctcacactcctcacctgccacaggcctgtatagggtgagccttagaggccagggaagccctcaggcaaaggcatgcaagaatgggcagttagaggttgggctgcatacactgaaatggtcgagcctagcaggccatggaaggggcacccacagtgtcaatgagagacaggcagaggaaggaagcaggtcaccaccacccactgcattaataaatgtccaaaacatccatctaacctggcaattagggatggatggcaaaggtcctcatactggctccatctgtcctgtcagaggaggcttccaacacatgcctccggtctccttctcgtgccaaagcaggagttgaggctggaaagagatgtgagctccttgcaggaatgtctgctggccgcgcttgcctctagaggctctgcctgtcaattacagaaagatctgcgagactccattctcctctgttatcttccaccgcagtctccagtggcaactctgcaaccgttttctgcagagtggttcaaattgttttatatctccttagctgccaagtacaatgtcataagcaataaataaataaattgttggcctatatggaaagcatattttgtccagatgcatgcttgaaacttcagctctgaaacaagaaagtcagactggaaaccacatcctcaaagctcaggagaagtacacacagaaaagccatttgattggcaggtgctaccacccaacactggatttgtgtcctgctgataggacagacagtgcaccttctgaaatgctgagcatgtgaggtgatacagtttgctggtgttcatgcttagcatgggtggccctgctagacagcctggaatgaaagaggaatcaagtttggaggatgacttagctgaggagctgagacctgtgtgtttcttttgatctcctctttaccagctgggttggggcaagccttcctcatcaagaaggctgagttcagcatccttttctggagtgcaaactgttttcccagctatctgggccttcttggatgcaaagagcaagggcatgacaatatgtaaccaggaatgaggaggaagaggagggagaactagatagctcaaaatcagctgggcatggtttagctggcttagccagccatgagatggagcgggcattccaagaaagagctggggccagcaggtagatgatctgaggaacaaatatggccttgatggcagtaatcaccatagagagcgcaccaatagtgacttggactgcctgggacagctggctgggaacacttttaaatgtcatttttatcactttttaaattaaaaatgcatatgcataaaaagttaaacagtctagaagatgcatatagtgaaaagtgaaagtcccttctgcaacatccccacatctatgcactctgtcattccagagattcttccaggcttacacacacacacacacacacacacacacacacacacacacacacacacacttttaccaggtttgagattgttctatacaaattattccacaactccctcttttgcactttgtgtattgtggacttctttccacatcggtataatctgtcattgctttgtggtgctcttttgatagattataatactttgttaaaatttttgaggtgacttctcagattgctttccaaattgccagcctatggtgtttgcagttgttgctgtgatcactattgcaagtaagagtaatcttttattatcttacctgttgaatgcaatagaattaaagtgaactatggaaaaattcatgaaaaaagtgattacagaaatgatgattttgaatatgcacttacacacataaaatatatatgtatggtgtaatgaaattcaagagagatattgggctgtctgaataaaactaaagatgtcacttctatatgtgagttatttttcttgaatgaattccttcacctaccaccaagatttagtttgaggcttgtgtgtgtcccttgactggcagcccaacttggtagatgagtgtgagacttctgaaagatactatatagatggttaagaataatctaagccatgaactcagacaccaattctgatacttttcagtacacagtcagtgcgctcaactgtctgtgcctcagtttctacatttctcaaaacagaacaataacatgtattggttttttttttttttttttttttttgagacagagtcttgcattgtcgcccgggctggagggcaatggcgtgatcttggctcacttcgacctctgcctcccgggttcaaacgattctcctgcctcaggagattacaggcacctgccatcacgcccagctactttttttatatttttaagagagatggggtttcactatgttggccaggttggtctcgaactcatgaccttatgatccacctgcctcggcctcccaaagtgctgggattacaggcatgagccacctcacccggccaacgtgcacttctttgggtggttgacaggagcaaaagagagaatgcatatgaagcccttacctggcatgaagtacctgcccagcaaatagtggttagtagagttaggaagaggtatgtgatcaccagcagacagcaggcatctggtcaggtgtgtgtgcctcaaggacctggtctgtaaatgtccacctttataggtgctcactctcttctcccagccaagtagttgggggaaaaaaaataaaataaaatgaatgtagactaatgtcaaaagtcaatagtcaactaaaactgttccagaatgcctcaggttgtcgcaaaccatcagctattacagactagaaacagaacctgctttccagttgtagatgataaataaacacagtgcactgccctttacaacgagcagctatttttttaacccatgcagatgtgtcctatttacatttaagctgtcacacaaattagcaaaggcccacagaatctgaaaaaaggcaggcctcagagcccagaaatgttcgcaggaaaggaaaatggcttatcccgctcctcattgctgtggtggcacagtcttgatagggattgggaagaactgaagagcttttctgggacagcagaaatgtttgctgaccaagcaggctttggagctaatctacaaggctgggtaaaatgaaatgcaacagcattccgagctgctgggattttgccttttttgcaatctgtgaaaagccttggacctttaacagatataaaaatcccctcatttggtataagcctgtgtgtggcagaatgagtctaattaaaaacaccaatcagagaataatggatgatcccctgtttctctgagggtaagatttcattgacaaaatacttgtttggctatacctagtagacttactccttatcaaaccacatgtatggactgctagagggagaatatgaaagactgagccacatattcaaaaccagtaagggctgggtggggcagtcttcagaggtttttcaatctctttcataaactaaagagataaaggttcagagaagcgaaagacccagttcaagatcccccagctgaagcctgagactagaacccaggatgtggggcttacacaaaatcagtgtccgctcgatcacatggcttccagatgatgtttctcttggggaaggcccatggacaggaagatgtagacaatttaatgtaagctttaaaactcttatggctgaactttcctggagagcaaacaaagccctgattgtatgagtccagagagagtttggttctagacgagcaattccttaattctttaagcactgtggaagacctacagagggctagcctctggcggaggctgtggacttgcagaatgacatgcacaggtccctgccctcacagcagtgagggcagactggcatataacatcctatgagaggcaggccaggtgcagtggctcacgcctgtaatcccagtactttgggagcctgaggtgggaggatcacatgaggtcaggaatttgtgaccagcctggccaacatggtgaaactctgtgtctactacaaaaaaaaaaaaaaaaaaaaaaaattagctgggtgtgatggcggatgcctgtaatcccagctacttgggaggctgaggcagggagaattggttgaacccgggaggtgaaggttgcagtgagctgagatcgcgccaccgcactccagcccaggtgacagagccagagactccatctaaaaaaaaaaagaaaaaaaaaacaccctatgagaggcagacacaaaggccgtaggaatacaaaaaaggtggcttttcaattttgcctaggtgattcatagaaggctttatttgacatggactttgaaggggtaagcaggctttttttctggaagagaatttcttcattcatttaattgaagtttaataagcacctactttttgccagtctttgtgccaggtaaacaagcagtaaatatgaagcaataaacaatactctgccctcatagattaccttctctcagggagagtcagaaattaagcagataaatgaacaaataagtaagatgattttagacagtggtaagtacaaagaaggaaatgaaggggaagagaccaagaggggaggatgttgcctcagacgaaatagtttgaagggctgatgtgagaaggtgaccctcggatgagaaggagccagcatgaagcaggccagggtggtgatcatcaagtgagatggggggagagatggtagatgaaattggagaggtgggtggtatccagtgtgcactgagccttaagtgagagtcagtagactgaatgttctaggagaactggggagccttgcgaggactctttttgcagggaacgctctatgaataaggaggcagagaagcatgacaatcaccgtggtggggtgggcgtttcagtggtggatgtggggctctctcaaatgccaagtagtcaacctgaattctgacaagcctttctctttccagtcataaatagccaggaccaaaagacaacacaatcctctgtttcacagtgaggaatcaggcttggagggttggaggcacatggccagcaagggcagtggaagggctgagccgggattcaggacctgggacccagagccttgtgcccctccctgccggcccctctgcctcctggcccacctgcatgtcttccagcgacgtggatttaaaaatccgttccccatcagacatttcagagaggcttttacagtttgtttttagaagtgtgttaaaaggcagtcaccttgaatgacttctgcttgacagaagtgtcagcattgtcaccacctattccaaggagcactggcacatgacgggggtgccctggctccatggggaaatgaggaggagggcaaagagctgttcaccagagctagcattcaggttcagcatagctcctcactgactgtgtggcctcgagagagtctcatcttcttcaccctgcacctgcacttctttatgtataaaacgcatacattggattgggacaaaggcattattttaaaaaattattggccaggtgcggtggctcacacctgtaatcccagcactttgggaggccaaggcggatggatcatgaggtcaggagtttgaaaccagcctgtccaatatggtgaaaccccatctctagtagaaaatacaaaaattagccagacctggtggtgcgcgcctgtagtcccagctactcgggaggctgaggcaggagaattgcttgaacctgggaggcagaggttgcagtgagccaagattgcaccactgcactccagcctgggagacagagtgagcctctctctcaaaaaaaaaaaaaaaaaaaattcagcgttggataactttgaaagaatcaagttaaacagattgtctatgcaggacttctcagagcttttgatgtgctaatgagcacagtgtgactcctagagggaagtgaagtcttatgcctgtcacaggtgtatttatgcaggtgtctctggaatgtttggggaaggatgacttgtagaacttttgttcctcaggacactcggggagctggtctgtgggataagccccaggttctgagatgggggatgaaagggaatcttcattcatgtccctgcccggccttgttcaactgctacagagtggcaaattgtccagtgtgtccgtggtgtgtgtcccctccctggtcccacttgtaccctctctctgccgctcccccttgtcacaaaaaagctgtcttctgagggagcataacagaagcagaagcagcatctctcagtctggggtcggctcagagctttgtgtgtgccagccccttaacataccatttctcctgcctggggctcagtcctcggcagccatgtctctgaaccagggcaaagggatactcttctaatagacagactctggatctgatggtctttctccatggggctttctttgcaccttcctcttgggactctcttacttttttaactttttatcttgttactcatgtatgactcctctgctcagggacaaccatgcagactgggtatctttcaagtggcccttggaggcagccgcctgcgagacacatctctgtggctcccacagaactgtcatcctcatcctaatgcctgctgtttattgagcacttagcatgtgccaggcagcacgtaaagtcctttatcactgaatcatagtgtcctgcagcagtcttaggagatgtggcactgttaagatgtctgctaatcagatgaggacactgaagctcatccaggttgaataattccccaaaagtctcacagctggcacattgaggggactggaagtcccacccaagtctgtcccccaagtccatgcgtttgattttaatactgcattgctctactaatatttgaatgaataatttgggggaaagtaaagaaagataaaaggagtaaaataaatgaagataaaaggagtgaatgaatgaaggaacgagtgagggaatgaacgaaagggaagaataacccttccaacctatccccagcttcaggaagctcagctggccctgcctccttcttatggccccatcgtcttgctgtattccaccaccaccccccgctgggttacaaatgggcactaccctattgcggggcatgcagctgcctgccagcagccaccaaggactcccccaagtagcccacttctgctccacccgccaacgcacactctccacagggcgaggcggctgcagcaggaccacagccagctgcgctttcagcttgctgggtttgtgccttcatcgctgagtttctcaccaagggaagggcagctgttctgggattgaaacatgaagaaagatgggcctagatcagataagcatcccttcccaagcagacgtacctcccaatttgcagacctttgttatattaccagcagttaaggaatgttgaaatggagctctagccttgatctgaattataatctctgaagctatatttaagtctacgtaaagatatttcaatgtgctatctctgtctctctctctctctttttttaattttccttggctcagagcacacttgtatccctgcagaacacagaaagccagggtatatttcttaatgttttacattacagttgtaagtctttcttatcctttgataatcatattttaactttcagtcaacgtatttgtgggtgcgcctgtgtgtgttatgtagaagttcacatttatacgaacagcattagctcattttatcttcctttcctttcctccaaagctgtacttgtaagactacatgcagcggcggattaatccccaaagaacttagttcggctttcacagctgctgccaaacagcctgtctcccaggcgagtgtagactttgtagtagttataattaacagttcatcgggaggcggggattgtagtgcaggaaacgagaactgggcaggggaggtcactaaatactaatgaagactgccagcagaggaacctacagaggatttttgttcaaagaggacagtttgaggaggaggatgggtaacaaaaatgtgtccttcagcagtcggcctgtggtgagctgaagaagcaggtgaactgggcaggcttctttgtgcatgcgtctgagagtggttgtgcacctgtgtgtgtttgtgtgtgtgtgttggatggaaaaagggagcatatcttttaggactgtaggttttttgctagtaaatattgttcgaaatctgatttttcacttattaccgttgtgaccttatgtaaattgtatataactggcctctctgtgccttagctttcctatctgtaaaatggggattcatttattattcagaaaatatttgttgagtatctagtctattccgggcactgttctagacaccagggttgtagcaataaataaaaagacaaaaatccttgtctacatggagcttacattccactgggggaaaaagccttacagggacagtaataagtagggttaaaatagattgtgcatacaaaatgcctagcacagtgtctagcacacataataagattttcggtgaaaaaggaacaaatattagcattattattctttaggttatatttactaagtgacaaccctctaacactctcccaaaaagacaatcattcatctaaattccaccattttattctacaaacagattttttcttgggaagtaacacaagagtataatactttggaaaaagatgctctgtaaatgttttgctacatcagtcaaaacagtgtatctttccaccagacatcttgaagggtaaagatgcttcttgaatggattttagcaaaggaagatcagctctcaggtgacagctcagacatgacgaacaagaacaatgcagaaaggaatgcgtgaacaggttggattaagaattgcagggcaattactttctgcaaaccgatatgcaagaaagaaacacaggcacaccttgttatccagaaacacaataagcaaaaattcactattacagaattgcagaataggcaaccccctatgtaaaaatgggctgttattaaaaagggggatgggggcgttgtgaaattggtttggaatgtgggcctcattttccactagagtagagttcatagactaattctcaagggcttatttaacctacacttgcctgaaatgtattatttccccctcaccagccactatgtgcaacatggcttttttggaagaatgcactgaaagggccctcttctccttgcgccaagctggtaccagtttgtactaaccgtagagggattcaccttggttttcccttatccgaaaattcattatccaacgttgatggttaaaaggtagcaggaaagccaaagttgtcataacattgaaacattcatgaattaatggaccacttatcaaattagccccactcagacatccttcccgttttaacggtgggccccccactgtgtcgagagtcaactctatgtacatctgtctttcctggatcatccagatgtttccagcatcaagaaacacagtgaaaatagattgcacaacacttgccaattgaagcagcacatttttcaaaagatgcaaggctttatcaagctgatgaaagggattttggaagccagctttgtgtcacatacaaattccttaacaaaagaagataacttgttatcaattaaaaagaaaagccaataagcatgatgacagcccaagggcttcaaagtgagggattggatgttagaggcttatgacaggttcttgggaaagtggcacatgtctcaaatatttttttgcagactcttaaaaaaataagactgttaacaactgtactgatgaaagtaaaggaggtcacgtggtgccctcacacaacctgattgggaagacatgggccaaataaatcaacccatattttattctttgttctttataaaactggcaagttgttgaaattacagtttaaaatttattaaaaataatatacatatactcatttccaaaaattttggtctcatttttaaagataaagtcccagatctctttcccactatttactttgaaattttggtccctgtcaaagacaagtaccctcttccaggttccagtttttctccggtaaggagaaccttgtgtatttaaacgggggaagttctcacgctagatgaccactgcatagatatgctgaattatgggtagtgagcaatatggaagcaaagctacccatcactctcaccatctctctgtctacactggtgatgcttaatctttttcaaggtcatgggctccttggatggaaaacatgatgataacagaggactctctccccagaaaatgcacaagcataaagtaaatttcaagggattcacataccctcttgatatctatccaaggggatcacagatactagatcatagatataaataaccccaaatctacaccaaactccaaattatatattatttattcatcatatagatcatatatacatacacactcatacatacacttatgcacatacatttaagtacctattaattgccagatgactttatatattttcagccttttttgtccctgacagtgaccatatggggcatgtaatattgtcctaattttactaatagaggaactgagcttgagtaaagttaggtgacttgcccaaggttaataagtgcttggtcctacttttcagacacttgggttttctaaggcttacgtccacactttttctatgacatcaggtcaactttatatgtccatataccatgccacatttttttcttaataaataactttcacaaagtctttctttattcccatagaaatgcttgtttgtggtagaagaattacatgttctaacccttaacttttgacgtgttttctattctctctcccttgttttctttttaagttgaagagagtgcgactattattattattctcattttacagatggtaaaagggaggtactgggacttcagtgacttgctgagatcaaccaactagttgacagctcattgatgctctaacttgggtggactggccggccactgggcctgcggatagagccaggctgccctctcacaccctgccctcctcagcatctgcttgacccctttcatcctgtccgtaaagacccccaaatcattatgcatccacagtcatattttaactagccctagcatccccatgtctggagggcatttgtgagtttggttttcattattttttccatttatcttgaaactcagagaccaaatatttatagtgaaagctgctttgcattaataattcagagtctgaatagtatttaaattttaatattttttctctaaatattttatcttcaacattagatgccaacttacatctgattttactacaaatggaaaccataaatttctccaaaggtatgcttgttcagtaatacatatgtttaaaaataatgagaaaataataatagctaaagttttctctgtgccagaaactctattgaatgttttatgtgcattaactcatttaatcttcatgataaccctatgaggtaggaattatcattatctccatcttacagacgaggaaagtgacgtacagacagattgagtggcttgcccaagattgtaaccctaataaggaatttgcatgcaaatttttttcaagtccagtaaaattcagttcaaggatgtaatggcaagtcccttgaaaacagaaccacaccctagaggaggcattagaaactctcttttatctaacattggccttgccagtgctctatatccacatgatgatgattgatgctcataatgattacctcaaggcagaataagattttgaaaaatcttccccacaatcaaggaaatatcagtatcaaagaagtattcaaggaaaggtgagcctagatttttaaaaaaaattttaagttgcattctaaatctatgatgattgccaatcccatttttaaatttacattataattctctgaaaatattcctttaaacaaaacactttgatcctaccaagcagtgtcaggaagactggctcccagagccccatccacagctgggtcctgcagaaaagtttctccagactgggtagccactgcctctaaaatactcaagagtaaatttagtaaatttccgtgctatatttgcccatgaaaatataaaaccaggtaaataaagtggtaacaagatttcataatgatttcctctttaggcagatagatgcatacatacacttgtatatatgtgactttcagtgtaaaaatattttttttccagtaaaggaaaatattgcccctcatctatttctgaactgcttagtcttgagagtaaaacacttctaaatccatatacaatgtgaatttaacaagcaaactcctccattcctctcccttcaccccacctgatgagatatttggcacactttgggatgacataggaatggcacagtatcattatgtggagagagcaaatcagtgtagaaaacaaaattggtcaattaaagctgcgatctggttgggcacagtggatcacacctgtaatcccagcactttggtaggcaggcagatcacttgaggccaggagttcgagaccagactggccaacatgacgaaaccccatctctactaaaaatacaaaaaattagctgggtatgatggtgcatgctgtagtcccagctacttgggaggctgaggcacaagaattgcttgaaccccaggggcagaggttgcagtgagctgagatcatgccactgtactccagcctgggcgacagagcaagactctgtcaaaaaagaaaaaaaaaaagaaaagaaaaaaaaaaaagctgtgatctgtggaaagcgtaggagccagagagaaaatctgggcgaatgtgcagagagactgaacttagcctatttccctggggagagagaacatgctcactcatgaatgacagtgggatatggcttttcctctttgcctgatagtgtaaggaggaatctctgaattacttacaatccccaactctatacattcctcattgtttattcattcagcaaatattgagtgcctatcttgggccagtactatgttagtgcagcacacagtgtctactcactagggttcctccttcctgggagtaagggaacattgcatgtctccaccatgcaaatgatttctggccaatagaatttgagtggaagtaatgggctactcttcaccttaaaatagtctttgtaatcttccttgtgccctctgaagacatttaagactacttggatcaaactgagaaacgtaatgggctagtaagatggatggaaaagatggctagatggttgagtatgcagtttacaaaggcactaaggcacctaaagttgaaatttctgctcttcttttaacaccttattcatgataaccaaaacagtagaaggaaaaggagagaggcatcagtagggaaggttcctgtgctgcaagaaataggaacctatacaggctatctggatcctaaaaggatacataatagtcaagagtcttgcatcaattcaaactattttttaaaagggaaggagtgtatattggcttttttttttttttttttttttttttttttgagatagaatcttgctctgtcacccaggctatagtgcaatggcgggatcctggctcactgcaacctctgcctccgaggttcaagcaattttcctgcctcagcctactgagtagcttggattacaggtgcacgccaccatgcccagctaattttattatttttagtagagatgaggttttgccacattggcatggctggtctcgaactccttacctcaggaggtctgcctgccttggcctcccaaagtgctggcattacagacgtgagccaccatgcctggcctatattggctcttatatctgaaaagtcagggtataatgacttcaggtatggctgcatctaggggctaaaaacaatggcattgggtctctgtctttcaccatcttttggctttgttttcccccaaggggatttcattctctagcagacttctattgtaagattccccataaaatagaaaaacagctgctgacagccccagatgcttatatagcagtatggacaccccagatgtatggaagcctctttctcccctccgatggattgtcattgtatcaacttttgtcgcgttcctatccatgaaccaattactatatggctaagaaataagttattttaattgactagtcctatgtcgtgttcgctccccacagtctgagaatgagagaagtgtgagtccccaaaagaaaaatcaaagtactgttacaaaaataaattgtactgagtaatgaacaggcaaaaagaacgtctcctacagggcttgttgaagacctgcagggactgttgtggagttgaagggctagaggggtagctgagctacacaggactccatctggggagtggaaaatcaggatgtttgtcttctactttctcatatggtcttctgtcccctctcattcaatgttctttaccttcctcatgcccttaccacagcctccgtgttcccacaaccttatcatggactggttcagtctcttggaatccctctttctcaatctctaggggaggaagctcattaatccatctcagaaccaggtcacctgctacatggcactggccagccttatagatgtatttgcctgaagcaggagtcctaacttggtacagtcaactctgtacaagttagggcagatcaagctgtctgtggggtttctctttccagggctgtgcataaggtaggatcgttagaaaggtgtggcagagaaggcaataatatatgtcaagaacaggcaaaaacttgggcagaatcaggctacaaggccattcttggaatgtgagccttgtagaaaaacctggaatctcattccttgacaaagacagatggaccaagaatgggctatcaaggaagcaggaagtccaagttagttaccaaagaggatgacagaaaatcaaggcaagggtgtggctgcactaacacagccacagacttctctgcgggggaggtgaagtgcagccacaggacgtgtgaattgtggcatctttcaatatcatgcagagcaagcttccccaggcagcgctcgttaagctgctccctccgacattgacatagctttccctggggctcctgccctgtgtggatctgcctccttcttattagaggcaacggtgagactttgagtgtcgcaccacctcttctccctcagccttggtccaagtgtgaaaacatctgcttcctgcccttgataaactcatcggcaacacaggggtttaagttaattttattagaaatgaaaattaaacatgtgtgcatgcacatgtgcgtgtgcccacacgcacacataccccacaaaaaccaaagtatcacacattcaggcaagtagattgaattaggtttggttgggttaaaagcaagagacaggttttctaaatataaggatcgaaatcagccaaggtatttacacaggaaatctttcctgactgacgtagatttaagcaacagagctttcaggccaagctaggatgttagatctcccccagttattcacttgtttgttcattgattcaacaactatttctgtgtctattttgtgccagacagtgtgtcccagactcttcttcctctttgtctccagcctatactttctctccctcctgtaggctccccaggcttctctgtggctcatgtcctggtccccagtctcctgattgtgaatacattgtcttcgctggcctcagatattcctcccctgcagttcagcacctggatttccaagacgcatcaccacacccttgagatagttctctctctgtccatttggggttgggacatgctagcactactttccctgtggatgaaggtagtgctcttctcctacctggtctccctagaagtggtgacacattttcatactgtctgagtatcagattctggacacagccaaagtcctctttgacccagcctacacacttctttcaactctttgtttgagaacttcctccacctctatgcacatatgcagagttagatagctcaccgaccctgaatccaatgagcaatttgcctggttttgaagccatttctatagggtgttctcaacgctcaggtattgtcaagggagatgtcataggtagtgcttttaccaggtaccattcatcttattgtctttgaaaccaaaccctgtgctgtccaccatctccactaagataagatggaggtcattctgtgaaggttgtagctgtaccaataatactattctaatgtagtttggtgagtagaaataaagaacaatgcgtaaagttttcctgatttccttttagtttttagaacaaagtggtagtgattagccagccctatccacccttaaggaagtcaatttaaaacctggtaaccagccaacaacataaaagtatttgaatgctgtgtatttattaattaatgtatttacttgggggatgggcaaggactctggttcctgttcttatggtgccctttagcagaaagactacagactctaacgtgactctttggggaatctctctgaagtagtaagtcattcatggccaacattttaattgaaggtaataataattccaataatattattaagaaccaccattagctcaggaaggactaaattcactgacgtaatgccaaagctatgcacaacgatgactgctttgccgagcccctcggggaataactttcataatccattgaaaagttatgagctccttgtgcttgcaccaagaaagaactcgacattaaccatttgagaagccatgtaaaaatggagaaaaagctacttgtgcttttaacagcttaattaatggctgcaaatggggttaattctcacaaaaaccccatggaggaggttgggatgtgtgttgacaatggaaaattatcctgattttataggtgagggcagtttccagacactaggaatgaacatggtcagggggaaagagaaaagatgactttttgttgtgggaggaatggggccctgggccagcgggctcactgtctggtttgggacaagggaaatcattgtgtggggagaaatgaatggagtaagaggaatctggcttaagagcctaacagaattgggttcaattattgcttttgccatttgttagctttctgaccttgggctaaaagtgttaacctttcagatccttagttttatcatcaataaaatgggaaaaataacagtagctaacttgagtcagaggggtcagtgagaaaatgcatgtcaaattcttagcccatgtagatagctactactatctagtattcacattatttttctttattaacaaattctacaaatatgtaataaacacctacagtgtgccagtgacgatgctcgatagagagagcaggttcttttgacttgattgtctagtagggagttaacaaaaaaaactaaacatatcaataagtaaaatgcttgcaaattgtactgcatttgaaagctggctccagtgagtactcaatgcattcaagctgccatttgcacccaggggcagagacttggattttagagtttgcagtaacttgggttttagagttgaggagaccccggtcagcccagcctggatgccagtctctgctcccagtctgtgccttcacacaagcccctcatgccttctgaactccacttctccctctgcacatgggcctggtccctggcagtgcttggaacctgatgagtcctcagcaggtagagatgctacctaagcgcactcccacccatcctttgagcagctctggttcatgcctttccatattccacagtgtgtttctgtactctccaggtgaaagggagaatgagaaggaattacatttctatttttctgcctagacatagatgagaaagtttctatccccaactctgaggatttggacaaaggagtgctatcattggtttgagaaagaaaagaaggggagcattccaggaggacctttgtcctgtcagggcctcagccacaggcctgatcccaggaggaactgggtgcaacaggctgttatactggatgggccagtccccaggagagggacaggaagacaggagtgaacgggcacacctgtgagaccacaacaggtcctggcaatggtcgggaagtgtgtgacagggcacagtgaatgattggagagaagctaggagggactgacttctcatggcctcctagcttcccttggagtgatttggtctaacactaggcttataagtcatgactgagcacttattttgcaaatcaggtctggtttgtcattagcaaggtaggcctttagaacagaggtctgcaaaccgtagggctgcgggccagattcagtgccctgcctgtttttgtaaataaagttttgttggagcacagccacacctcttcgtttattttctgtggctggtttcatgtcacaacacaggtaaatagttgcgacagaaaccatattgcctgcaaagcttaagatatttacttgctggctccttacaggaaaagtttgctgacccctgatttagtgtattatagtttgggtaggaagagattcagtcatcgatgcactcatttgttcattgaacacatgtaattattgatcatctaaggtgctctatgcactgtgccaagcccacaaagtgtcccaggtgctgtgctcaatcttataacagctgtgtgaggcgatgatgttattaccccattttgcaggtggggaaatggaggctgagggaacgtgaatgatttccccaaggttacaacagcaaggagcagaacaaggactggaaccaggcttgttagtctccagactctgcactgtcagccttactctttgacagtgtgttccatgtttgtccttattctgccctgtgaatatggattactgtgagaaaggaagaaagattaaaatgttgaaaatacatttttataaatctctgatggaggctgggtgcagtggctcatgcctgtaatcccagcactttgggaggccgaggtgggcggatcacctgaggtcaggagttcaagaccagccttgccagtatggtgaaaccccgcctctactaaagatataaaaattagccgggcatggtggcacagtcctgtaatcccagctacttgggaggctgaggcaggagaatagcttgaacccagaggcggaggttgcagtgagccgatcacaccactgtactccagcctaggagacagagagactccatctcaaaaaataaaacaaaataaaataaaataaaataaaataaaaataaaaattaaaaaatctctgatgggaacgattgctatttaaagtgatggatgagtgaagttgccacttatttgggagagcctctgctgggttgagatgattcttcattatgcgtgtttctaaacttgaactctagttgctttaaatgatatcagaaaatcatctgaggctgggcgcagtggctcacacctgtaatcccagcactttgggaggccaagacagatggatcacttgaggccaagagttcaagaccagcttggccaacatgataaaaccccgtctctattacaaatgcaaaaattagccaggagtggtggcggacgtctatagtcccagctacttgggaggctgaggtacaagaattgcttgaacctaggaggcagaggttgcagtgagctgagatcgagccactgcactccagcctgggtgacagagcgagacaaagagacaaaaaaaaaagaaagaaaaaaaatcatctgaaaatgttttccctcataatgatatgatttcaccactaatgtttataaacattaaaatgacaggaagcatttcctgttccaacctgacagagatcttggaggatttgtctaaatattcgcatacctttaaaataatcagcagatgactgtctggataagaggtcaaaaaaaggatttgtagaaaaaagaaataataggccgggcacggtggctcacgcctgtaatcccagcactttggtaggctgaggcaggcaggcagatcacgaggtcacgagatcaagaccatcctggccaacaaggtgaaaccccgtctctactaaaaataaaaaattagctgggtgtggtggcatgcacctgtagtcccagctactcaagaggctgaggcaggataattgcttgaacccagtaggcggaggttgcagtaagccgagatcgtgccaccatactccagcctggctagagagtgagactcgtcaaaaaaaaaaaagaaataataaagtgagacaggttttccctttgagaactctgaagtgctatgggaaagggaagagttgccctcctgctttaacaggttaaaaatgaaccactattagtgagcaaaagtgagattgcgttatccttttaatgctcattctagacacagcttttgccagcatctccatgtgataaatgcaaaccagagtttctaattggaaataggagaagaccatcttagccgaatggaccacacttccttctaatgactatgaagatggtttaatcttacagtctaagtagaggttctactgacaggttctcgtatgaactgattaggcttcccccgtagacatttttatcagactgattcattcctctggaagaatgctggcttttacgtttttttagaagagattctaaatggcttgtcaagattacatctttcatgtgaatctcagccaggattatgttacagccgggactgacaatattcaataggtagaatttggccaagatcgtagaaatagagcaggctggtcccaataaatagtaggagcatgaatgtatggtttacatacatcccaagtagcttcaaggcagtctgtgcattggatatcctgggggaatgcatggatacataaagtgtaatattcaaggaaaataaactcaacttttgtctagtacttatggcatgggcagattcttataaactgtcttcgtgtctggggcattctgtgacctgcattcctcaccaccccttcagagctgcctgaaaaccacatacataggaagaggagggaaccagacccttttgtgctaagctgccctaatgcagaggtctctgctgcatttgatatgtgctgacaaactgaccacatctgaaggggctgctttggagtggcaagtcccctgatcttggaacacaaatgaagtctctatagaggccatgtgggaggtgggcagaatatgtggcatttcccacccgggacccttgactcccaggcatggtgtgttttgtgatgagaaacgaaggggactggagggatgtgcatcagtcagctttgtgttgattaaaaagaatgaaggatgaaatcatttaaggtttagttttgctttgaatgaaatatgaaaggagaaatatattcactcttcctggactcagcagaatgtaagctccataaaggcaaacatttcacccattatcctcactgctgcagctccagagtctaggccagtgtttgcaaatagcaggcactctataagtatttgctgaattaatgaaaggccattgagtgttcatgtatgtatctgctttctcaatacctgttaaataaacatctattatatgccaggcccttgaaataaggagcagtccccgagaagcttacagcccagtagagggagacagatatgccactcagtgtttttccaccttttcagaaccttcgtggggaagggatatagagttattttataaaatcctagaccccctagaaaaggtcatgtgagggagtcatccctccagagaccctactgcctagtgttcttaaagcccacagtgcaggttttgctggactcaattctgtttgttcattcactcactcattcattcagcagacattatggaatgcattctctatgtcaggtactctttcagttgctgggggtgttcctaggtccttatgttctaccctggattatgttatctgggtgctttcttgcatcttttcagcaaatatttattgtgtgctgatatcggtcaggcacagtactagacattggttacttatcctagagctcacaaaagcccaccaaagagggaggttactcatgtgtgcacttccctatgcctaggagataataggcaataaggcttctcttgattagatggataaatagacaggtggacaatgggtactctggaaaaaatagtgacaaggtcataaaatgggaagatcacatactaggaatttgaacacttgtggtttagtcctggcgaaactaatttgggaccctttagcctctcagaaacagctagctgactaaccaacttcctttctttcttctttcttctcttcactccttctatcttctcttcctttctttcacagaattatattgaggatcttggtgttaattggggtgagagatgatattggtctaaattatccccaagaatcctaccagctctaaatattatgatgtaatgatggtttaggtgagttacatcttcttttgagtcatcccaaagttctagattaggactgcaatcatctcaggctgctaaagatcctataggatggagtgggggtgggacataacacatggccaagccagatgtctttgggccaccccttgggcttccactgaaaccaaacttaagagaatagagagctggatattgggggcaaaagtccttgcctccttgtctccatctcacctggtttcccagagcctgacagccttccagcagtgaattaagaccagattcctggaaaaaaaaatatgagcttgaacctcatggtcatccataccctggtaccctgggcctccttgcttctcttctccaatcagttagttctcaggtacaactggaccaagatgagaagctgatgttctatagggatccacagtgttaattgccacttggcagctctgcaggttggtatgtatatgggcacacatcacatatttcctgtttggccaaaggatcaagacttcccctgctggtgtgcatagagggaaccagctgtttggcagttcctccagctcatctgcccagtgggagttcattcagagagtaactcagcacagtatcaggtgtgagcaagactcagtgcagactccaaggtcaagcatccttggttgcaatcgcagttcctccatttattagctatgagaccttgggcaaaggacttaatatctcaaagcatcagtttctgcatatgttccaggggagatgataagagggctgaccactcaatattgttgtgaaagttgaatgagataatagaagtggaatgccacacacagggctgatagaatagatacatggtaaacaaatggaagcactttttaattgttattgttgctctttgtggaattctcttagaagccaacagtgtggatttgagagtgataaaaatccccacatctttatccagccacctgtcaggtgatggttggtggctggccaaaagctgtccatttggtcacagtattctggaaagagcattccaatgactcttcccacctcctaaattttctcaaccttcttttcactgctgagagcccctgactccacaataggaagaaaccaagtgggagtttagttgagtgtacactgtaaagatggtccatttagttggcagagctagagttttggaggaggagtttgaaactagcttgtaactttcagtgccaacctggaggtgtcaggcaatatttttcctttcttcctggaaggtccacaacctcctccaagggcaatctcctggatttcactgaattggctgttatgtttggaaaccaacttgtgcatctgagcatttaggggaaagctattgactaacccttgctctttttcagcctttcttccttttcccaatatttaggagcttggccaaaacaaagagcccattgtgtccctggtacaagcaccagaactcaattaaacattcattgagtcttaattaattgtattaaggttgggcaattcccattgcttggggaaaaaaaaaaccccaaatacttaatttactcgcaatgtggtgtgtgtcccctagtattgaactaaaccaccatgagacaatcacttacttaacagaaactagggcctcagcctgggaactaattagcctctctttctctatatatagctatcttcaccaccaggaccatctggaagttgttaccttccaaattctttccatctatttttttttttccaaactgatcattactgccatgattccttctttcttatttttatgttacgtgacttcccactcttagattctccagtgttatctagatcacagcccggatactctgggtatttactctctgtttaattttcaagtggcacacctatttttatgtacttttcccagtggcaggaaaaaaagaaaaaaatctttgtgtaaaacctagaggcggaagcagggatgactgccaaggaatttgggcctatccaagttgacggtgtgtccaccagggaggcccgtgagctctgtgaagcccctacagtagtgtctttgatggctgcagacacatgaggaggtctcagaaggacctggtttcttgcccaactcattgagcaaaaagtaccagtataatctgcaaaaagtaccagtgtaatctcccctttctccccacagtcagggtctactttgctttgagagtcagtaaggaagtataaaaactgtcttattggccgggcgtggtggctcacacctgtaatcccagcactttggaaggtcgaggcgggtgaatcacctgaggttgggagttcgagaccagcctgaccaacatggagaaaccccgtctctactaaaaatacaaaattagcctggtgtggtggtgcacgcctgtaattccagctactcaggcggcggaggcaggagaatcacttgaacctgggaggcagaggttgccgtgagccaagatcgcgccatcgcactccagtctgggcgacaagagcgaaactccgtctcaaaaaaacagaacaaaacaaaacaaaaagtgtcttgtctgatagtatgctttaggagagtagctgcaaatatttcatgagcctttaattaatgtgaagtccttactggctcacaagggctcccccagtctggctcccgtcttctcttccgtcctgttacagagccttgcactgatttaccaaattcatggtaccccactttctttctacccctccccaccagtacgactagcttattgccacgcaggacctctgagactgctgtctcatatgcttggagcccacccgctctatggttagaaggctggctccttctcatcatgtggggctcagcttatctgtaacctcctgaagaggactcccacaccctccaggtcctgtctgtcacattcccctgttttatactgttgataatacttgtcaccatatgaattaagttatttatttgttaacatgtttgcctgtcttcagtagaacatctattcatgagaagtaccttatctatgtggtttaccatcgcaagcccagccctggcagagtgcccagctctgcaactggttgtttaaggaaatacatgatcagggaacagctagtctctttctgagtatacaggtaattatgcaatgtaggtgtttaggatactttggtcatttagaatacaattcaaaagtaacaagaagcaaggaatattatgagaaaccttgaattactgtaataaaatcaccaggaaaactggaagtcataagctaactttacctaacatgctctccaagtcactgtaagtttcaatgtgttttatttctagtgtttgagagtccttttgggataagccttttggcttcctcccaaccccaggcatcaaagcagaagcagcttaagccttctagagttcatcgtgtactggcttccgatcatctctgggagccatggcatctctgccaccccactccctaggcatccctatgatagtgagcttcatggtatttattgctcagtggctccaagtgagccgcgaggcccaggagactgcaagtgtaatgaatccttgctttatggagggtgggtctcatcttcaagtctgaagacagactccctccaggcaaagggagatttcttcttgtccctttacagtagttcatctgcatctgtttccttccatctctgcttcttagtcccaaatggtgaaatccctggatagcaaagctcctggttctcaacttcattcatataagaaaggttcttggtgtccagatttcggcatggctagcaggacactctctacaaagtatcatatgtcagaggcttcagtcccaaggaggaattcaggtacttgagaattcaaatctacaacttgttcttcaggcattttgatttccctttcagtgtcacattggattcaaccagctcattttggggaggagagaaaatattcttaatagccaggttcctggcttggccttcatctagaagccttccgcttttcatcttcttttttcaatgacattttcccaggcctttcctactgagcctttaggactggaatccaaggaagaagggatttgggcctcgatggaaccctgtgccagtctatttcttggctactgattgatcttcataaaaacagtcagagtaaacagaaagaagtagaaggaaggaaaaatgtttaaggcaaaggcataagtaaatagaaaatagcaacaacaaaaataatatgagatggttttcaaaataaaagctgaatctttgaaaagaccctatgtatatcatagacctgcatgacacaatatggtaacatgacaatttacattcaaattagttaaaatgcaacaaaatgtttaactcagtttctcagtcacactagtcatatttcaaggagctcaacagccacactgagctagtggctagtgctacagtattggacaatgcaggtctgttcatatcatacactgtagataatagatttccattgttgcagaaaattctgttgacatctcctctgtagtctaatcattgtccaggttaaacaagaaaaaggaaggagaaaagatacaaaatgcttccttgggaagaaaaatgggggtataactatagatacaaagagactttttacaataaaagatattatgagtaactttgtgccaatatatttaaaaattagatacaattttctgaaaaaaattctaaacttactcaaaattaaatagaaagccaacctaaatatatcagtaaccactaaaaggactaaatcagtagctaaaatatgacccccgccccctttcttcaaaaaaaaaaaaaaaaaaaaaagcaccaagtcccagtccagatgattttacatccaagttctattaaaattccaaggaacatctaatattttaaattaaaaatggaaggtcacagaaagtcccttgattgatgatttcagtcctgcttctgtctctttcatgacctgtggcccatggaaagacactttcttttgtgatgtctctatcaagaaagagttaaactaaaaggttctcaagggcctgagcagctctatggtcctgtgtttctgtggctttaagacactcatcttctcattaatcttgcctagcttctaaatattaaggtgacgatattggctcacccatatggccaatctgatctgctctgctaaaaatgattgttaaacagacccagagaaaaaagaaatttctttttttcttttttcttttttttcttttttgagatggagtctcgctctgtcgcccaggctagggtacaatggcgtgatctcagctcactgcaacctctgcctcctgggttcaagcgattctcctgcctcagcctcccgagtagctgggattacagtcacccaccatcatgcctgactaattttgtatttttgtagagatggggtttcaccatgttggccaggctggtcttgaactcctgacctcaggtgatctgcccgccttggcctcctaaattgctgggattacaggcgtgagccaccacacccggccaaaagaagaaatttctgaagaaagagtggacccaacagttttgtggagctgaagccaagtttcagtttgttcctgtctcattcagagatgatttatccactgaaaataatttactcagagccctgaatgacaacactgttcagtgggatagaggttgtgcttttttgattttacattaatagcaatagcagatatttctgggatgattcccacaggccaggcataatcctaaagactttatatgcactaatccatttgacctgtacaatgtcctgtgaagtgagtagatattggttccattttaaaggctagaaactgagactcagaaatgttacttgtccagggtcacctggctctgaacgtgttgaaggaactccaggtctgagaggacctatgacctgtgctgttatacacagatgacaagttgtgagtactgtggagcttctatggtgggtaaagtcatttccttttggattttatatctctggtgagcagtagcaattcttctgtaccatgtgtctggttagaggttacttttccaatgccaccttatccaaaggattggtgagaagccatgaatttccttctgtaataaaagcaatcactggcttgggctttattcagtaaataagcagacctggctagtaaaactcatttatgctgtaatgctaatgagttgcatgtgtaaagaatggaaaaaatgataattgctcagggattccagagcctaggctgactggagagcatattctcagcaaatatgctttagcggacttagggaagttactccatcatttctctccttctggtttcttaaaggatccggggtccttacatcagtaaccaccagggctaatcattggtgctgatcagtaccaagtcatttgcctgacctcctttgattgtgtggcttttttcaaaacttgttttccaaatacctcaagcttaactgggaggtaaaggctggcatgctcagggccatcaaggacagttctgcaaaggtcaaaaaggcatgctaaagaaacatttccctgtgttaccacttccttagctgctcattccagacttactaggtaaaatgcaactcacttctgtaatttgtattgtgcaagatggactctgggaagcgaaagtagctgagaaacatttttcaggaaccaaaacagacgtacattcagtttagattctttggaacacacctacctgagataatagggtacttctttaaatgttttctgaacccaccacaaacctcctgtagaaatacagacatgcctttcagtccccttgagttaactcaagggcttaaagggataatgcgccctgtatttcacttcggtttaagtctttgtgttgctgacagggcttaaaatgggcaggtaatcactggtacaatgtgtcatcttttttcctccctcttcttttttttctttttgagacggagtctcgctctgtcgcccaggctggagtgcagtggcgcgatctcggctcactgcaaactccgcctcccaggttcacgccattctcctgcctcagcctcccgagtagctgggactacaggcgcccgccaccacgcccggctaattttttgtatttttagtagagacggggtttcaccatgttagccaagaaggtctcgatctcctgacctcatgatccatcagcctcggcctcccaaagtgctgggattacaggcgtgagctaccacgcccagcctcctcctccctcttcttatgaaataaagtgaaaagcacttacttttttttttttaacttagctatttctttctcttttcttttttttttttttttctttttttgagtcggagtctcactgtgccacccatacttgagtgcagtggtccgatctgggctcacagcaacctctgcctctcagattcaagcgattctcttgcctcagccttccaagtagctgggattacaggcatgcatcaccacccctggctaatttttgtatttttagtagagatggggtttcaccatgttgccaggctgatctcgaactcctgacctcaagtgatccgcctacctcggcctccctaagtgttgggattacaggcgtgagccaccgtgcctggcctaagctatttcttttaaataaaacaaggttatcaccattttcctttttggaaagacttggtttccatggagagatggaaatggatggggtatgtaataaaagggacataataaacaagcctccatttacactgacatcttaatttatcaggcattaagtggctgatattaaatgttaatgaggtctctggaagagggaactagggaccagccaggactgtgtctcattcagtggcttcaggaccaggtagaaacctcagttttctcattttttttcttcctttttctttatcataccgacaccacagacatggttaccatttattgaccactttgggatgagcagaccttgtgctaagtgctttccatccaggtgaagtcagcacacttattcccattttgcagaggaaaaagctgggtttccactgagtcagtgccccgagccaaggctgctgagtggcagagctgagcctcagacccatgccgtcagactccagaccctgagcattaacacctcatgtctagtcactggccaaggccagcctgttcttcccacagggcacctctcccatccaccacttcctctctgtcctctcagcaccagtctggggtggtttccctgactcagaactttcccatcccatccaccctgcatgccccagccatgttcaccttcctgaaacaccacgttctctgtgtccctcccgtggcgacacattgtcagttcctctttatttccaaccatattaggttcaactacctcagactcgtcctcacattcctcccgcatgggcccccctgcgcagttttatgaattttccaccattcccagataatgaggtatcatttttcctcttctaaaaatagtgttcattccttttttcacatctctgtgcttattgcttgccattatctaaaatgcccaatatctgcctacatcctacctgttggattcagcccagatatgctcctttaggaaacctcctctgaaattctgaatatgccataaacccctctctcttgagctgttggagtcctaacccaattttctttggaattcccttctcttgatcaccgttggcagattctcctttggcaatcatacatgaagcaagactggaaattccctatagactgttagaaatgcaaaatgcttgttacccagtgctgcaaagaaatagcacttgaacataaatttaattctctcagcaagtcaatttttactttctgcagaaagggtgccccttgcagatggaacaatggcgagagcacacctggacaggggaggggaagtagttcttattcctgatgcaggaccctactgctgtgtcgttcctctattggctagggttggactgctcagtctaagctaattctgattggctattttaaacagagcaggggtatgaaccagagtggcagggtgaatagtttggtgggaaggacagttaggaatagataactaaaggggacttaggtcagagcaggtgaccaggcatgactgaggtcaaagcaggtgaccaggggaacagatgtgaactactgattaaaactggtggaaaaatgttgtttactgaaactagaagcaagagggcgaagagaaccaggaagttaaactttaaaatggaaaatcaaagaataagagagctgaacatactgacatactgattctttgaagagaaacttggggttcactatacttaacatgacaaagtaggggtctttacttctgtagttctctctgtgcttaacagaggaatagaaaatcataattacagctaacatttattgagcacttcatatgtgccaggcactgtcttcatgtattaattctttcagtctttacagtaatcctctgtggtaatgaggaaactgagggaatgaaagctcaggtgacttgcccaagtggtgaaactgaaatgcaaaccaggcagtggggcttgtgcctcccactgcactgtgccactttataccatcctcaggtcagaaacaagtcacatgtgggcatggagaacaaatcagagaacatgaattctttatctggaattttgctcagctgataaagctcattggttcccagccttcctctagaagtggattcacagttcttcccttgttgctccacagctggggaattttgtgttgaatcagaatgttctggtttagaaacattttctgggtttgaatcagcatggtccaagtctcggtcggaaccaacttgacgtttgcatggcagatggaactggagccctcactcctcctctaatatgaggaggaggaactcaagcactcactcttccagtaatatgaccctcttctgtttggtattagatgctttaatcctttctggaccaaggcagagtataaacaaacaaagtcaaatatttaaaatttttaacagcagcaaaaacttccataagattcttgaaaatgaactccaatttgatcattttgaggactgcctaggttagcactgctactctgattcctgtgtctctgtagcacatttaagctgctaatttgaagaaattgctggtagcttgcatttgcccatactgcagaatttcaaatgctatgatatattttccacacttttatcttcctttggccaagtagatgttgtactttttattttttttcctttggtcaaattcaatcaaattgtcatcattagaaacacaaggaaaaaatcacattgataaaagaccattacattttaagatccatgatgtgtcactgtctacttgagaatccactggctgctgaggtggtgccttctccaccacatttctgactcattcccagaataggactttgtatggagtcagcacttcatatttgttatatcaggtggaattttgggtgctttacctggcttctacaaatagtgttgttttggtcatcgaaagcaaagcgttctttaccaagggaagtgtggccggattttcaaacagttatgtctgtcaagttagtctggggaatttgacagtgccagctatggatggcggtacgaagcaaacagattcggatggaaaaattcttacccaactatgtccagttaggtttatgaaaagagcaccattataccaggcctcctttgaacaagaaaggaaatagcttatgtcatgtgaatacaaagtcccacaggagtgtgccctgactttcctttccagcctcaattttcactgctgcttggcagggatgtgatgctctggaacactcacctgcctggcattttccacgtatcccatgtcctcctccaatccacgcctttgttctttctctccctcctggaactacttttctcccccaattggcctagctgtctcctggcattttctaaggcccagactaggaattctttttcccaaggaatctcccctgaccacctcccttccaaaagtgaaatgccacttttcagtgcttccagaatttgctgtgcatgactgtcctgttacctgttaacactttgcattataattatcaaggtgtctgtgtctccagccagcctgagtgtttcttgatccctgtatccctagcctagtacagtgcctgaaatcagtgcttgggggccttgttaaaagaagaaacggcaggaggggaacagtagtagataagcgatatttcacaaaggaaaaggagaagctataacctgtctgtatgaactccccaaatatgtcccgttctttctttgttgtcacccaccctcttttgcttttcatgagggagtgtttgccctaagtgaaaaggaaaacccacttgtctttagggacatgttatgcatgtggaagtctggcattcccagctgggcgtttaaccagcccaccacttgggtgttttatagtagtgtctcaagaggtgttatctccctcttttaggtctttggagaaaaaaaaggtgatcaaagaaaccaactctggctggagggggggcagttagagtcaaatcggggttttagtggataagaaaggggacagaatggaaatggggtatggatgatgctaatatgaagaatgtgcttcaaggcctcctggctatttttgcatgcaaccatctttcatatccctataagataaaatcactgtgaagggtcataaaccactgtcagagtatttgacaagccccataggtagttgttccgagctagtaaaagcatcttaattggcctaaatgacaacagttatgttataaatatctagaatttatgacctgagaaggcgtaatcacatcttccatcagttaagtttgcataggagcagcttgaggatttaagatagggctgcaagttggggaaaatctgattagccttaactttatgacaaacacagagctaagtgaatcggagtgctttcaagttcctgatccctgggagttaaaggcagtggtgtttcagagtcggtaaaagccacccagttccctctgtgcagctgtcattttattggccttgtaaagtctcccgtacactgtgacaaatccaagaccatatacctgcgaagaagagatgttttagattatggggcacagaggaagcagacggtggggttagagggtgaaaacctatgtgtttatgccgatccttctccggaatgtgcagagtcattgtgaaaagcaagtccgtgctgctttagggctcgctccagggtctgatgagacacctcattttctgtggtaattgaggaagcgaaattcaaagcagggtttaaaagttgagtttatacatctaaaaaccccacacatctttcaagttagctggaaattacacttggatttttaaaatatgattcatttcctgaatttttattatggggatggcattattatcaagagtactactacatctaaagcaaaaatcataacaaagccaatctgttgaaaggatgggtgttttaagagacacattgtagagataaatttgatgtcattgatcaaccaggtcattgcctggggactcgctggtcaatggagtggagtcatctttgaggtaaaaggcaaacagccaacttaatcccaatttgcagagcttcaaaggtgaacagtcattttgccaggcaatgaagagctcaggttatctatttaatgccaaagtctgtgaagtcagtgaaatttctttaatgaatttgagagcaatccttcaaagaacccttgattgaaacccctagagaggccagttgtctttgaactcaagagatgaagtttatcctagattaacctgatctttcagtttgctctgtcttgtaatgtagagacagagttctgaattttgagagaagcgttatggtgctttggcaggcatatccaaatccgatgtgtttattatagcaatgtaggaacacttttagctttgttggtaaggaggtctaccaaccaaaggatccactttacatatgaaatttttgtacatgtctaccatgttccaacagtttctgaagatcagatgggtcccaaggtatatactcagtttgttacttctcagtgggtatgaaacaaaacttcagttttggttttattattatcgtacgtttcactgcactttcatacccttaaaccttgcatctctcaaatctggaactctgtgccttacgatgtggaagaaataggaaatctggaactgattatgaaattatgaagcagggagatgcagaaatgtgcgaggatcagtgtacaaatgcataaaccctgatgcacacaaagcctggtgtgaaggacacatcactttggattggaaccctgcttttacatttgagcgtaacgcaacctagcatttgccttgtgtagtgcttgggagcttttggtgttaacagaattcttttctaaagaaattccttcggatttcttcagaatttgtccagtttccaggttccaataggaaaaacatggacaaggttttaatagaaaaatagtgctccagatttttcagttggcaagtgccgtacttaagaactgttcctgttttattaagtggtacaggttagcttaataggggagtcctcgacatttgtaccatgattccaggaaagagagacacctgggtcccctggagaagacacctgttgggattttgagcccacttgtggttttaccattccattcgcatctcactggagactacgcttgaacaacagttatatgtgctgataaggcaagaccaaatccatcagcgttctctactcctgcctcctcgagaaaggatagctgggtcttcccatgatgttgtttcagcttttcctgttgatcaggacagtaatgatggtggtgggaatgttttgtttttattcaattttattgttctgctttagtgttttaacatttctaaaggcaatgcatttttctcattaaacatttcaaataattcaaaaatctttgccaaagaaaataaaagtcccctctaatccaccatccagaaatactaacattttggtgaactatgtatctttctaattttactatatatagactcttaaaaagaatgggattatattataaatgtttttataatctgctttttgaacttaacattgtatgttggacactttccacattaataaatatacacctatggaatcatttttatagtaacggagtatggaattttgcattctttagccagttattaatggtgaactttagatgttttaaaatgttccctagtagaattccctaaagccttttgggcttaacctttattcacttagccaataatttctttggaataaattcctaaaagggaagttgcacattaatattgataaagattgtgaaatggcctcccagaggtgatgcccattcaccctgctttaatgccttgaatggcaccacctctctgtacttaccccaagtctctttgtttggtgttgctttgcttttccaatttaactccaataggtaaagagctctcagtatttttcttctgggtggtagggtacaaaccaacaaaaacaaccaacatgcttaatttgcaagttggttcagggagagatgaaaaatatctttacagaagtaaacaccaatcttatgactgcccatatgatatactccatttctcccaccaccgagatttgtatagtttctctcctgtcagtataatgctctatctaaaattttagaggtttcagaatgggttgcctatcccagtttccttgtgaaaacaattttctttattgtaagtaaagatttctaggccttggtcaataaaagagaaatggccagtgctagaaagagtcaagtggccccacttcccttgctccagatcttaaaaacacctaaaatgaagctcaattaactggttaatttttgctggtcatacgttttgaatgtggaacttcttggtcatttgaggggtctgacattctgggcccttttatccttttattggtgaattcactgaagtgtaggcagacagaaaatgttcaagtggcaggcagataaacttgttaaatccctggaagtctttccttctttgctctgggagtttatcatcttggcagagttaaaaggcaattaggcctgcaggtctttcctggcttgtttattggtggtttacacatgggtgttgaagagacagggccatattaaacattctgatcctgctggccggaggggaatgagacctcagcccaacttggtaagtctccttgagagacagccttgccaaaacgctggaggaaaattgtttaaatatagtacctgtgccccacgatgctcattgttggtggaaaattgcagtcggcttgcttcatgctgtgttccatttcctgggaaatggttttatggaaggacatttgatgaaaaagttcattccttctgtaattgttagctgcccctgtggtgtgagttaaggtagaggcgcactggaaatatttcttgccccaaatctctagggcaagccccttgcatgagaagggaaggctatcagtttgaaactgggtgagggacagatttccattaagtcctctggtccctctgagttctcagagtctccccagccaggctgatcttgggcaaaatttgtaaaggaggtgggtcttgggtttttgcaatcacttcttccttttctcacaccctgccttccatcggcaaagcctgcaggctgcctccctgggatgaagatacagggttggagtaacgcctaactccttcacacctatgtgttagtgaagtgaaatggctcatcacttcacctcctcccctgtttttcacagtcagcttgggcactcatcttaatggaacaagtgagaattgctagggttcaatttgctgggctcgggggtcaggcactcctgggttccacttctggctctgtgtctaactgtgtgccttgaatttcctctctaatctcaagttttttctatttgtaaaatagggacaaagctagtccctaccatgctagtttgttgagagactaaataatgcatggaaagtgcttaacatagtgcctggcacttaaaaaaaaaaaaaagcacaataactggtagcttttacgattaaaatgtgctttatttgtctaacacatatatgtaaaatatatattatgtatatgtgtatatctaacacacatatatgtagtgtatatatatatatgtgtgtatatttacacagtccagtgacaattatattttttgacaagatgtagctatttttgttttaccagtctagggtgttactgaaatataaaaacgtatctgtataaaatgagaaaatccttgctcaggtccagaatacttggaatttaaggactttccatttccacaactggccattgtactcagcggccaatggaactcctttcctaagtggctgctacttatccaaatcttggttcctcaggagttaggcaccctgcctttattttctcaactaaagaaaacacaacagataactgcagcttttattctcaatctgacctttcatgttgtgaaactcttttgccatagtgtcttgccagcgtctgcacaaggacttcctctagctgagtaatgtggttctgattaaggacatcctataagacccaggaggatggcctgggaaggaaaccagcctgagacactagagtgaatttccatccctcagtcagatatatgatattaaagaccagaaggtatatggagtttgtcgttggaagactcagaaacaaaattaaagcaaatggctgacaaattggctgtcttttatgcaaagttgacaagtaagctgcctcttacccgaaagaggatatgcagagccctccggccaaatggctcggcaggcagtcagcaggtcttttgaagttcctgctcgcatgccacttttaacaacaaggcctctgctgaattgcttcctcgtaaagacatggaaacttaattttcaccgaaaatatcatagttccaacaatgatcattcattcctctccttagtgcatgtaatattgggtaaaatacctgtgttatgtacaaatgaggtattttttttctccttacagttttatgaattaggctataaatattaaaccttactttatttcgcggatgctaagacctttccctggggcccactaggcactggctcactcctgccatagtcaggaggtgaggtgattgtgaccaacaatggaagatcccatttgctctccctggattcatggaggctctatccacaggaggaaggacaagagggctgtgcagtgggcaatggcgtttggagagcttggagtttctctatcaaatatctaagaatctactaatagttgtaattctaatatgattttcttgttaatctctgtcaagccatgaaatctgatatgttaaccatgactaagccatgaaatttgtcaactttgtctgtgatttacacaggctctgggtattttattttttaactcttaatacaaagtgtagaacagtacttcccagtatgcttttcccagcaggcagctggtatcctatgacaacaagtaagaacagagtgtacgtgtttctcttgctgtttcaaggaccaaggacagataagataaaacctaaaaactaaataatatatttttctttggggtgataactgtgaacatagtaggcttgcttaaacatcaataagtatcaaataaacatccaaaatagttttatggttcctatcattgggtgtgataacacacttccttaaagtggtaggttgtttttgagagaaaatgagtgaataaaacctgtttgtttgtttgttttagtggtaagtgatataatttctctcttcaacatagtatgagcataggctctgtgacctgaaatcccattttgctgttggctaggtgggtgaatttgtgtaagtcactcaacgttttttccccgctcagtcttttcttctaaaaaatgaggatgataatactggagcctactttgtaggggcctctaaggcactaaagagaggccatctataaaactcagagtgagcacatttgtcttttatccacgtggtctactagtatcattggcatagtagtatataatgatataatagatcattgggtatctttgtcacccaaaggaaaattcatataattgggaaaggatttttttttaattttatcagaaaaaatatgggtagtttttgaccaaccattaccatacctgtagacagtttttcatatgaaggaaggagaacagctcaaaggaagaaagaaatgttgcagaactggagagtagtgagggctgggatgtctttctctcctgtccctaccaaatgccttttttccttgtactcagagaaaaagaatacccagatcctccccaactgatacctggcttccactctttagaatctagaatcagataatcagatggcttaaaactcagagtattttggtgactttgaggaccatgtagtctagtgattttaaaacttttgtttttcctacaaaatcttgtgcagtgcttcagatcctaaaagagccctttccagatacctttccagtagatccgtaggatataacttgtgaaaacagagtcaggctgatctgttcattttatcaacagtgaacagaagtctatgaagtgtgggcagattcctccaggtcttaccactgatggccaaaagtagcccagccatgtcttctttttttttttttttttttttttttttttttgagaggaagtctcactctgtctcccaggctggagtgtagtggcacgatcctggcttactgcaacctctgcctcctgagttcaagcaattctccttgcctcagcctcccaagtagctgggattacgttgcccaccaccacacccagctgattttttgtattttttagtagagatggggttttcaccatgttggccaagctggtcttgaactcctgaccctcaggtgatccacccaccttggcctcccaaaatgctgggattataggcatgagccaccacgcccggccacagccacgtcttgagttagtcagttcccttgccattatcccgacttcttcacttcccacacaaacaggaggaagagaaaagcaaggcataagaatccaggatggttttaatcaacttgcccaggctcttgcacccttgaattttccatgaacaatgtcatggaatctgtgaaacctctcccacctaaaagaaaattacctggaaaatgttgtgaatgtgtatacacgcattttcctatggtgaaggtccatagcttttatcagattctcccaaaggagtttgtgacaccgccccccaaaaaggttaagaatgatttccctataatttgtgcccctaaaagtcacatttccagttctgattgtgagctgcaaggttaacaattacatccactttaacctttcaagggaaatgtagcatataatcctatgagtgtctgaggtcccaggcttgcttgtaaaacagcaattgggttgtgaattattcaggctgtctctgtagcttagttctcagctggtattctaactggaactaggttctgaccatcttagaactcaaatggttcaaaactaggaaaataattcatgtttatttacaatgctccagaaaagtacatttatttctagacatgcactttcatttatttggttaattctgctttggtcctggattagggttgccggaatttcacaaatacaggacatccagttacatttgcatttcagataagcaacaaataatttttttagtagagttcttggaagggagaaaaatgaatcagccttgcagatgtagaaagagctttcttttcaactctagaacatttgctgcaaaaattaagggaagtttactgtaacagttgcagggtcttttggagatagtagatacattctaaaactggtttgtggtgctgatcgcacaattctataagtttacttaaaatcgttgaactttacacttaccatggatgaccttgatggtatgtaaattttgcctcggaaaaactggtaaaaaaaaaattaagggattgctttatgccaactgttgcttaatttttaattctgagcttcaaactactttaagaatatggttaccataattctgctcctcagaataaagtatataagcatgaacaccaaattttgcataacatttctggacctgctgaataagtacttgataaataaggaatgacatctctggataccaacttctacctgaaccaggagtccacacaccattaaaatccttttcttgatgctgggaataaggcttacctggggcaaaagcaaggagttgctgttttgggaagtcttcagttgttgattatgagagtgacctcttgtgacacctgccactttgagactgcccctctctcagttcatgctgaaaggacatgggaaggacagtacttgtctatggtgtaagtggagccacctttttgggataagttcttcagtacagacaacatgttcacaagccagtgtgtagactcgatcaggaggcacctccaccaaaaaacgcacaactcattctcttgttttagtgccagctgaaactaggaagtgtgctgcacttctcttttatctctgttgacatacccaggtattctgagaaacacacttgaccaggatgaatgatttcagtagagaggggctgggatgggattgcttagccaggaagagtgtaccctgagaacttcattctctaacaagatttgaggactactcctccagatttgattactagactccagaagggacagtcctttatacagctcataagagtcactgtggacctctgctagaccctccagacaagtacttctattttctattattgttctaaatgttagctcttatccaaatgaaacaaaacaaaatgcctaaaagaactaggggaagagaagcaaggcccctcagagacacctttattcttgctctttctcctttcaagacatggttgctccctaggcagtcacatttctctggtgatggagagaaaggagggcagttggagattgaggggacagcatgggatagccgagacatgctgatagctggaggggaggctgcctgggacctgaagaagcagtgatgtcccagctccagtcatctgaactcccctaataggcctctccatctctccagacattagatcttgtagagaaagaaactgctagaatccaaatcttttcacacagtgaggcccccaaacagcccagccttcacacacaagccagcctgcttctcctgactgacttgatcaatacctcaaggtgcacagatgtctgtgcctggaagcaaagcctcattggaaccccactattctggaattcctgggctggtctcagccagctgcctgtgtgtagatacaactaattagctcacggagaggacaatctaactcaaagccctccttcccagcctaacaatgcttaaattagttcaataaattctgtcttctcattcaaaccaatcctgaaggagggacctctgccagctcactcttaattactgctggcatttgaaagcaagtaaatgccttcccttgaaaaatattctataaatccatcaattttgcttattttaaatgacttctcccacatttgtccaaataagtgaagctttaccatttttggctttttctgcagagtgagtgagttttaggcgtttactggaaagatcatttctgataacaccaacctcttccacatttttagctttgggttttgaatcccggaaacccagcaataaccttaaagttccattttcttacttgtgaaagtgagaagctgagcacccatgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacaggttcgtgccaccatgcctggctactttgtgtgtgtgtgtgtgtgtgtgtgtgtgtgtgtgtgtgtgtgtttttccgtagagatgggatttcactatgttgcgcaggctgctatcttgaagtttctttaagtcagttctcctcaggggatattttatatggcttttgtaaagttctaaggagggtggtggttctctcagtctcacaacataatactacaaggaattatgtttttaaagatgctgtcagcagtggtttttaaccaggaaatggggagctggggaatgaggggggatcttggcccccatccctggttatttgtcaatgtccacggacatttttggttgtcccaaatgaggggtgctaatgggtcatctagtgggtagaggccaggaatatcctacattgcacaaagcagtcctgatgacaaataattgtctggcccaaaacttcaagtgtcaaggttaaaaaccttaaattagaggaattcttgttttttttttttttttttttgtttgtgtttgtttgttttttgctttctctcaagtcctgggataaagagaaagaaaatgccccattttgatgcgtgcaggcgtcctgatcctgagttcttacatcccacatggatccaggaattggagagcaccagagtaccagcgagcagggcaaagtgcagggtggaggcagatcttctgagctccaacagctgtctgagctccaaggagagacaactttgaccaaagcagaggaccaaaaagttacaaggatgtttagtttgtgataaaaatcattttgcagattaaagtgcttcctcctgcccataaaatggtatgttctttaaataactcaaaaaccgaaggcatttaactgtcgcaagcaggaggcaggcctcggagccacagtggattgattccatcctcgaaatggagcctacccaagctgtaggtggcgctcttcctgctttctccagtgtgcttttgaataacccctgtaactcgcagcatgaagcgacagggaatagagggtgtttcctggaaccagtttctccctccacatctcttggctccagtcaccctcacttcctcagtggagcatgatggctgcttaacttccagtcttccctccggtcactccaagcacagttaggcagagatcgcacaggccctgcaaaaagtgtcagtgtctctcattggctttgatgggatcatgtgctcatcctgaaccaatgctgtggctaggggaggaatgctggaagctaattggctggggcctaatttaggacacaccccctgagttgcagtggaaccttgtgccgtgcaggtgaattaaataaaagtgggggcaaatgtgttgcctcaaagggaaattggggtaagagaggcacccacacaccactcgctacatggagactttgaattctgtggtggaagacttaggtcttgccctagcgttgctgttaacactagctgcttgacttcagataactttaggactctccctgcctcctttttctgtctgcaacatggaagtaatcgttccatcagagtggttataaaaaaatcaagcaattatcttgggatatgggaaggattgtgcaaacaagtagtgatggtgtagatgggaatgaattcagtttagcttctaaagtctcaaagaatctagaccagttacaacccaccctgctagtccatgccagccttcggaagccagtgtctaaatttatcccaattctcactgtttcaggtcagtgtgggaaatcctctgaggtcaatgattgaggtaattggcttgccgtatcttgacaaagtctctgttaaatgacataattggttttaattatgtaattacggcacttaaaatgtgggggtgaaaggttactattatatttagaagtgagatccccaaatgaagcaagggtgtttaagccaaggtgtcttcgaatttctcattttattttttcagaaggaagccagaggaggctggccttggccctggtgatttggggatgattatcttgcatgaggtagtgccggggctgatcgcggcatcataggaacctttgtaaagagaaggaaagggcttccttaaagacctctttgtgatctgaagttaatgagcagtgggaactcaactgtcagcaattgaatctgattgggcagggtaattatatgattgcctctggtgtttgcacatgcacggggatatttttattgtaaaaaacctaattgcttacttacttggtggagggaaaacctaaacaaatttgtgttgtcataggttaagaagctatcctttctttgtctctaaaaacgccgcttgctctgcttcttagaagtgagggttttgtttcttttcgatttcagtcaaggatgttgtttgtaggacttggatcatatgataatattaaaacagaaagctactttggactacgtgtctttggtcaaatgaccacatgcttactacccagtcttaagccatcctctccagtggtctctttcgtaatgcaaaggtagctagagtcctgggcaatattcaagctgctgggactttcccagcctttagggggttttttgttttgtttttttttcccccacatggaggctcctgacaagattggcttcataagctatctggtttcccctagttgcatcaggcaagtgggaggtatcatgtctgcgatagccttttagacgtcaacaccaagggtaagaagaacaaagcgctccctctgcaatttctcagggacttggaggaaaggaaggggcaaagtgggctcccgtattgtgataccaaactgtgatccaccttcttgtctgtttcaacagtctccatgaggatggcatctcccttaccccgatgctggtgtgcagaaaggattgctgcaattgggtctattccgtagcagttcaactctgcattattgttttttttttctctcttcttatagaaaaaaaaaaaaaaaacacactattttctaagttctttagtttcctgagatcccactggcagaagtcaaaatgcaactggattgtgggcattggaggagcaccagttcctcctgtaatcagggctgcagactccaaatctgggtgctctggttggatgtaggattacaggctgcagaatggctgagaacaaaggactttcagcccttcggaccagccaaagattctcaggaatctcgcacgtgctgacccaccccagtcttggctggctaactccatgggttctccaggctcagcgttacatgtcacttcttcccaggaagccttccctgaccactcacccccagtctgggttggctgcctttgctttgtgctccatggcaccctctaggtttccttacccgctgtcctgtaactgcctgtctggtctttctcccacataccccataagctccatgggggcagggtctgtgttcctatttgtcactacgatatctccagagcctggcaccatgcttaatgaatgtgtgtagaatgactgaatgaggagaggaatggttgctgggtgtcctaggaactgtggtatgtgctgtcctggtttccctgcccttgctgttaatactgctttcttgttgcttataattttcataattttcattgtcccagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcaggtccaatgtttacttttacccttttggaggtgggtaacggcaaatgctgggtgctgggtttcagagagactctgcataatgagcttggatttgggggctcacatgtactttacattttgctagagtgtaggagttgctatttttgtatttaattcacagccagactgttccatgattcccaccagtgtagaacaataatctaggtccatcatccacatgatgtaaattgttgtgtcagcctcatggtggccacacagtgttgtttggatcttgctacatggacagagaggaaggttggtcattggttgctacttaatgactattacatttactatttgctttccaaggcctatgattttcaacactttttcttgttttgattttgtggcttttgatgttttgaatcttcctctaccccctagcccagcccagttgacttcttagaccatgagatccagagtaactactgaatgaatagatgagatttcactagccctatatgattttggatatacctaaccagctccttccctaagcagaatatgaacctgtgacttttcaggcttcaggccagagagcttcctactgaacccctaaaccccaagccatcacggagtttggactatctgttgttgattggcctgcaatcatgatttctgagtagatggacattggtacatggaaaccgaagcctcacatgtggcagaaaagaataaacccacagagaccatagggcattggccttatgcttcttgtgcaaccgtctgtactcaactctcctgggtctgacttttattctcatctgttggctctgagtctgtatttactctgcattcttgagttgcatttttgctttggcataataagtacctaagttggaatctttgggggttcctcctaggaagagagtttgaatctacttgcttttacagtagatatgttcatcaatgttgtacactttgaaccaaacagaatgagccatgatgagttttattcctgagttctaaggaaattgtagtttaattttcagttttggaattgaaccaagagatgcctcaccatctcatattccttctggattgaggcagtattgtaataactgcctacagaagtaaatcacatacttttgcaataaaaatttctttgaatgacacttaattttataattaaacttggcagtacagcctctgaagtgtctcatcttgcctaatcacaatgatctatttcctttcagagtacttccgtatgcaatgattagtccttttgttatcatcacattatagattgaaaagaataattcttaaaaagaaaaagaatgaatgattgtattttacataaaattcaaaccactgattatttctgttgtttgttttaaaaatattttcaccagtcatggtggctgatgtctgtaatcccagtgactggggaggctgaggtgggaggatcacttgaggccaggagttggagaccagcctgggcaacaaaagaataaaataattggctaggcatggtggtgcatgcctgtagttccagctaattaggaggctgagtctgtaggatcccttgagcccagaagttcaaggctgcactgagccatgatcatgccactgcagcccagcatgggcgacagagtgagaccgtctcaaaaacaaataaccaactaaaaaaaaaaaaaaatttgcatgtttcttcactgattgatttattctgcaaacagatttaaacaggttctctaagtgcagtgccttgaagagccactggcatcctcgcatcacctggggacttcttagtaatgtaaattctcaggttttgcccagacctaccgaatcagaatctctgtagatggagtccaacaagatgtgtttaaatgggcctctggatgatcctgatacacaggaaagtttgagagccactggtttaacattctaccagtccatgatgtgggggtattaaagggagagtaactacgtatggccctaccatccagctccttgtgatctgatcaagggcataaggcataaattcatcaggcaagttggcagagtgatctttacaaaatgtagattacatcatacactcccttcttaaatccctccaggcagtcccctttgtacttgtaataaacgtaaatgcttagctcaagcctacaaggcctggcatgctctgtcccctgactaccttcccaacctcatctgttgctgttctctccctcccccagtgccgtgccatgctgcactggccttctttctcatcctcagacatgcctgctgagtgtagtgtcagcaggaacatagagaaaagggaagtagggtagagagaattgtaaaggttaaataagagacttggacactgaagtatttttttcacattataaaatattcctaagctactctctccactggttaatattattgatatttatatatatagatgtgtaatatattaatagcataatcaatattaatggcctcacctttaagcctttcacacgtctcaggtgtccttctgcctaggacacagtttgaggggagggtctcggttgttttcttcatccctcacacactgacttcacacagatctggccctcaaaaatcgtggacaaatgaaagaagagattctgcaaatccaaatgccctcacaatgctagcaaagtctgaaaggatttgttgaatcattaaggaaatattaaagtcgtttagtttcatcttagtgtaatatattttcattgctttctctctctgagagtcagcctggcaggcacagtgggaactgaataaacgtggccggagagacatgctggggggggtgaaatcatctgttttgcacaagaatattgatggagtcagtgaattatttttactgtctttattcaagttttagaaaggatggtgaccatattcattggattttgtctttttaaaagattatctatgaatgccagttttgatctttgggatatcatgtataccgtgtgatttgtgtataaagcagctgttcagatttttatggaatgtgaaaatactgtatctcaggattttcttcataatgagacagggagaaacacacatttcaaatatgatttgtttcaaaaaatgaattggatttgaggcaaagggctttttttttttttttttttgagacagagtctcactccgtcacccaggctggagtgcagtggcactatctcagctcactgcaagctccacctgcttgcagtaagatggggttcacgcagttctcctgcctcagcctcccgagtagctgggactacaggcgtccaccaccacgcctggctaattttttgtatttttagtacagatgggttttcaccatgttagccaggatggtctcaatctcctgaccttgtgatccgcctgcctcggcctcccaaagtgctgggattacaggcgtgagccaccgcacccggctgcggcttcttaaaaatttaggacttctggatccaagaacaagggcaatggtttttggactttttgtcttatttttgttttgactatctctagctctaagtttcacaataacaggctattattttataaacatagtatctctggttttagacattatttgctcattaggaagcctttcatttgagatctgtagaacagagaagtcatggaggtagggaagggggaaatgcttcttaaggtctcccagcttctccttacctggtaaagatatcccagcatgaggagtaagaatatccttactaccttaagctctgtggatatatgagggagcccttcttattgttaaggagatgctcggtcttctcttgtgagtagggacaagacaggcatgccctgtcccaccctctgagaacccacagccagaggctgggcaggatttagcaaatagctacattttcacactttgaaacacactctgaaggatgagtacagaaactagcacagcatagaagaggtaaacaagtcctctctggagctggcaaggagagacatgaggttaagaccatgaaatgaaagatgatcaggcgttcattgggggggtgaatgaacatctgatggcttaggtgttaggttgtgttaggttgtggtagcatgggaaggggggcaagggaaaatgtccccggggagctggcatcatgtcccacaatagctagggttctgcccacagaggctacacagcagagaacctcctgagcaacactgccacagagtgaaccccagcggcagagcgcttctcctgcagagactgagatttccaagtgtccactaatagtagatgcactgtcctagcatgacatcagcaccgtggtacctgtttttggttgttttcctggttcctccaactcttatggtgcctctgtctgagatacctccttttcagggcagcctctgctggtctcctccttgagagcaaagctgcctgcagtggacattcactattccatggagggatttgtatggcttttagggaagggttgtgagcatcttcaggaatcttcccagagaactgccttctctcactgccctctggatccagaggcatctttcacaggtctcacatgtccttctgtccaggacgcagtttgacggcagattctttgttgttttctcagtctctcacacactgactttgcacagatctggctcttgaaaattgttgacaaaggaaggaagagattttgcaaatctaagtgccctcacaatgctaaggttcaatttcaggaatgtgaaatagaagagatacctgattcattcatttatccatccacccattcagaaatagttattgaggacttactgtttcactgtgcagccaaaacacaaagcccggctcatgggaagttcccagtggatgctggttattaaaaaggaagtggagtacttactctggcatctggatccctttgtgttcctgtccgatggacttttccagaggcccgaatatttgtttgtttgttgtttgagataggatctgactcactgtgtagcccagtctagagtgcagtggtgtgaacatggctcactgcagcctcgacctcctgtgttcaagggattctcttgcctcagcctcccaaagtgcttacagacataaaccaccgcacccggctccccggctctttatccttctcttatttaggagtgatagtccaggctaccagctctgaatgtgtctgcttctcttcagaggggcagagctctcccataggcaggaagcacttgtttcctggactcgtggcattttacagtgccgaaggacagctcgctggttgtttgcacacaaccagtgtgaatgtgaaatgacagggagcagctgaacttcagggcagtctgagtagctttttaaacaattaacaaattaatgaagatagtcatttggagcacctaggtttctacttgctgagaaaggcctgacctgtttctgaggaggacttttttgattaaaataaaagggcaatttctgtggacatgaagaatttaagcctggagtcacatatggagcttataagccagttctgcctagatggcattttgtttggctcagagtgttccaaaaaccggaaaatataatatacgattctggctttctgggtttttggaaaaaaacagatgatctggttatagcgagctatattcccacgagattgccccagcaatctcctttgtccagccagccctctccagtttactggtcaccaatgtggccttcctcacatctgcctcacttccttcgtttgtgttacccccagcccccgtccgcatggtgtgcgaacctgctttggcactgcagaagagggcctgtggcgagcttgccatggccagcagcaggtattaatgatgcccagatttgcctccccagctcctcatccagatgccacatggcagggccagtaggagcgacatcagcagctcatcacccaggctgccaataagaaccacgtgggtacttgcccaggcactgcattagggattctgacttaatggctctaggtgaggcgcagaggccgtgtccacacagacaacttccaaaggcctgcactgaagcttgtgcagagctcccctgctctctgggacaagtgttctgcccccaacagcactcttctaggcttctattcctcttcctgaattggtgttgagcatcacaagccactgtcatatactggaatcagtgaagagcacacatgtcaaaagaggcttttcaaaggggtataatgcaaaaaccagaaataatgtcttgatctgaaaatccaaataaatcaacaaaaaatgggacttgagtggtggggagaagatggcagacgtgaatgtttcccccatcttctgcacgatgacagagaggtacttctatgggtgggtacttcttgaggcccatcttgatgtgtgctcttaaagacagcctgttattttctttccagatccttatagattgttttttctttacatcaacaagtcaacaattgtgccagattatttctactgcttacctcttttacatttttctggtaagcccttttaacctgccatatatgtgtttcattgcattaatttattgctccctttcttagtttttggtctttttttctagagcatctattatcctcaggttctcactatgtaattcccatatctatcatgttgtcccttacagattacatctctatattctgggataacttcacaagattacagcctatttttctgatgatattttctagagcagtgattcagctccttgctacttctaatgctggctttgattccattactgcatttttgctgggtggtcaattcccttccattttctgtcctgtctatagtcttctgcctcggtgcctcacatgagctttttcactgataggaaactgaggcccagagagcgatatgatttgtcaaaggttatgttgttagttcctggtgaaaatgaaagtagaacttggatcttctaccagtccaaggcgttattcatccacaagactcaattttaaagatcaaccttgaggtgaaaataaataatttggtagaaaaaattgtcattatcttcaacctgatcaaaatgttacacatattgagcatgaatattccaactgagaatttcttactatagatgactgtagtcactcttccttttctatagcatagcactattgatttagtgctgaagtttaaaaactccagtttaaaaggaacaagttctacattttccatgacttatctccttatctgtggactaaggacctttgggagtcctcaaatctgcaaaaacacaaacacacacacataatgaaccatgatccagaatagaatgcctcataaatacatgtgtgataatttctctggtgtgtgcatagacactattatgagttctaaaatttaaaaacattacttaatttaaatacattagcatttcagaacattactgaattcctagtagctgtcgatcatcaggtatcaagttgtcttctctgtcttcctttgcagtctccatgcttcataggatgtgttgcaggggacgtggaggagcagagtagtgcttacagtcaggaatcaggctcagtccatagcaagatgtggctgtaagcaggcaacgtggcttcccaaggtgtcaggcttcttctggcacacaggggaggttatagttattagtcatttattcaacagccatttatttgaagagaaataaaattacacttaggtggaggagtctgcaaaagtttttgatgtttgaagggagtccttgccaaaattgtactgctcctgtcttccatgataaatttgaagcctacttgtgcccttcttcaagtagctgccaatccaagggaaaatctgtactgcctgatggctctcaccagtggctacagtgttgggacagatctggcaagcagatgtctgtggtggaaactttctattctagcatagctccttctgaggaagaagggttaggtcaaagaagaatgttccccagacaatctgcccctttgttaatcaatgctgtgatcttgactgcccctacagcagccccatcttcctgaaatcttcggtaaaaaggccatccaacaaatacatctggcattggccaggatttttctaggtccactgtaacagggaggaatggatttaatcagattcaaaggaacattaagattcattccataacagtggtgcatctctggaagggctatggaaggcaggtgatcaaaaaccagtttctcgagcaaagcttgcaaagcagtgcaaaagaatcaagttgactatgcaggtgtctgaaatgctagtgacatttatcgagctcattgggacacatgtactatgttcagtgctttaatggagtaatctaattagtcttcatagcagcctgcatagtcagcactaatgttatgagcatttcatggatgtggaaacttgagaattcagccattaagcaacttgtccaaggtcacacagtgattcctccttctttaactattgggctgataatatggccacacagctgattttgagtcaatgaactattattttctttgtttctttaattggacaatgcagtccttatgcagacatgcagttattataagaaatgataatttgagtcaattttaatagatttggcaaaagctagtatctatataatagtaacagaaacactgaatttgctgaaaaagacatttgcaagttgtcttctctgtccttgcagcctccacgcataataggttgtgttgcaggggacatggaggccatgtggaggagcagagtaatgctcgcagtcagaaatcaggctctgtcgttagcaagatgtggctgtaagcaggcgatgtggcttcccaaggtgtggcttcttttggtgcatggggaaggacatagtttagtcatttatttaccgtctattatgtaagtggatatgatgacaaactcactaactcttactgagattgtaacacaagtaatcctgatgtaatgtgatctattctaggggcaaggtctatatctctatgaagggctagggtcactgtagggtgccaagtcaggctttcatcagcacatgttcattgatgcctactctgttccaggctccattccaggagctagatgttgcaaatacattatatttcaaagggtggggccaggaaggcagtgaactagtaacaaataggatgacttcagaaactagtaagttgcatgaagaaaagtacagtagagttattaaggagtcactgggaatgagaagaactaccggacttaaggtgacccgagaagatttttctgaggaggtaacaccaagacaagcctcagaaaatgaggactattttctaggctgggtggaaactgggtggattggccttgatgtgtaaggttctaaaatcattttttttttttttttgagttggagtctcactctgtcacccaggctggagtgcagtggcgcggtctgggctcactgcaagctccacctcctgggttcatgccgttctcctgcctcagcctctcaagtggctggaactataggcacctgccaccacacccggctaattttttgtattttttgtagagatggggtttcaccatgttagtcaggatggtctcgatctcctgacctcgtgatccgcccacctcggcctcccaaagtgctgggattacaggcgtgagccaccgcgcccggccaaatcattcttcttttaacacagaagtgcagatatcaagtacataataatgcttcttgtattttattcagatttctaagtaaccaagcacatgttcaatttttttataaatatttcatatgtacttgaagagaattctctctttgggtgcatgttctttgtatattctttagatgaagcttataagttatctaataaatcttctaaatctctattaatgttttagctggtaactgctcagtttctgagagataagcattaaaatcctcataatcattatggattcagtcattttttgttttctctctatctaggatatacttttaattgtataaaatgtcatcatctaatgttatagctcctggtaggttgttcttatctttcattaataatcttcttcatctgtactaatgctcttgcctttacatttctgttcctgtgtgcaagtgcatatttcttccaaccttttatttttagcctttgtgtgtcactggtccattttccattttaaaagcaacataaaactagatttaatttttttactgactttattttattttcagagacaggatcttgctcaataaccctggctggagtgcatggcataatcacagctcgctgtaaccttgaactcctgggctcaagtgatcctctaacctcagcctcccaagttgctgggaccacaggcatatgtcaccatgccaagctaattttgttttctgtagagatggggtctcactatgttgcccaggctggtcttgaactcctgggctcaagcaatcctcctgcctctgcttcccaaagtgctgggattatagatgtgagcaatcacacccagcatctctgtcttttaatgggtgaatttaagctatttgtatttattgtaactaatctatttggacctactcttcttatttcgcatgttctcttattatggttcttttgttcccttctccttttttcccctcctctcctttaatgtcctatttgaattgactgtgctttctttatttctattttccccctactggtttgggagttacatattctatttctctgttcttagtggttttgatagtatctaaagcacaatttggcaagaactcagaagcttttaatggatcaccttaggttagtttaagggctttctctagtatcctcactccccagtggttgggtctttaatggggtgaggtgtaaatgaaagtgcagagcatggtcactatgatgattgtatcttggagtgtggatttccaactttcatttgctaagacctacactttattgcctgaggctgcctggtaatttataaactgccatactctcatggtttatagataacatggcggcttccaagcaaagatccacttggtttctttagttgcccttccctttgtctgcatttgagcccttgtaagtgatgataaacattaaatagctcctgtaaaactgttgaattgtcagtttttaaactgcataaaacactgacattttcattagatcctggctctgaggaatgtccggctttcatcataacagatttgtttacttctgcagagagccttaatgcgctgcctatgggagaaatctttctgtcacctgctcttaaatgggaaagtctttgttcagccaaagatttttggaaaaggatttgtaagagggattttacacctccctctctctccctgaccgtctcccaaaagggtaagggatgggaatagaatctttgaagagctttggtactggacaggaaaaatttcaacctaaaatagtcctgcaaagtccattaggagacagaatgctgaggagaagctattaaaccactatttagtttcagtgtctcctgttaaagataagcaagtcatatcaatgtcttttttacctcaatcttttggttgacatttaaacagatatcttgattttggattaataaactctcttgtgtatattagtagggaacacattttaaactgctgggtccttctaagcaagttaatgaacctttctgagttttggttttctcatctataaaactgaaattataaactgacttttcagagttgatatgaacatgaagagagagaatatatatgaagggctcagcacagaacctggttcttagtaggggaccattcaatggcatttgacagtgatgatgaaggtagtggtgggaattatggtggtgaagatgaggatgattatggtggggggagggtagtggtaagagtgttgatggtgatggtgatgaggataatgctggtggtggtgacagttggggttttgaaaaagactgagaaaggttatcatgtaatcaaagaactcaagaagaagcagagttatctgtaactacctgactggccaggcgcagtggctcatgcctgtaatcctagcactttaggaggccaaggtcagtggaacgcctgaggtaaggagtttgagaccagctcggccaaaatggtaaaaccccatctctactaaaaatgcaaaaaattaaccatgtgtggtggcacaatgcctgtagtcccagctacttgggaggctgagacaggagaatcacatgaacccagggtgcggaggttgcagtgagtcaaaatcgcgccactatactccatcctgggtgacagatcaagactccatctcaaataataataataataataacaataaaactacctgctctataatctcccagtttctatttgggcactttcagccactaggagattctttcttagcaaaattctgttataggcagcaaaccacaaaagcccagttcattcaggcaattgtgttttcaggcctagatttgtcttctaaaaagttaaacagtgttattctgagtcatgtaatcctgttgccatctatctccatcctaaagatactttaggacaccgcacactttgatgttcttctgtctttccttgaacatgtatctgccatctctttaccaactcttctttctgtagtcatttgcatatataagtaaggaactcaaagaagacaatacaggaggaaaaaaggtgccaacagcaagggtggggaaaaatctgagtgttgtgtcacagaagtaaaagagggagacagttccaggcacaggaggaaggtcactgctttgagcatgaaagtgagggtgaggatgaagaaggctgggcaggaccgtaacttctggcactgaagggtcaatgctggcatctgacacagtatcactgtgatggtaaaagatggagagtcgaggaatacttgagagaagaaggggtgaaggccacagacatggaggaatgagaaagaggtggctccagagtagaaagagtttttagacaggggagaatggggcctctttgtggaccaagaggagggagccagaagaggttgagtcttcagatacaaaagcaagaggattcagatatttggccctggaggaaatgggagaagtataaggaggaattcattggcccataaaagtacctgccccaccaccaagtggaaaagtggggagacagggatattactaggggaggaaaggtgtcatcagtgaggcacatgctaaatggacttgactttctcttaagggaaagtgagatctctaatgaaagtgagagatgttttgaagacataaggagcttgggagagagtttaacaagaagtaccatctgaaattggagaggaagtcagccagagatgattaaaatacttgctaagggacaccatgaaggaaagaaggtgtgtgtacattgtttcatcctattttcatcctgggtcctcctcctaggatctcccttatgcaccctggaatcccatggatgacccttcagtgctcccacacccccatgggacctccctctccatctccatgttcatccctgctctcagatggttatcacatagaaatgaaccagtggactgatttgcaccaaggcaaggatgatgctaaaacacagtgtcttctcccaccctaacattagtgtgacaggtagttggatgaaagcagcgctggatcaggagtcaagggcctagcgtgtagtcccaagtctagttagttaacctatcattgtgctctcacagcacaacatggcatatctttcttgcttgccattgtagcaccagcatattgctcagttctggcacacaataggtgctcatagaatttatttgaatgagtgaatagaaggacataggaaaaaaatttcaagcaccctgtcatcctatgcaaatgtaaagcactgttatacctatgtgcattttaacgggtacagtagttaagcaaatgactctctaagaatagaatatcagctaccaaaggtgggtaggtgaagggagatactttcagcagatctgcgtgggggctttctgctgttttaactacctagagctgctgtgatttaactacgtaggtgtctacacgtatttggtttggcttttagataaatgagctcctttcccttcagtaatctgatccaaggatccaagatgatttagtcatttctcattccagctgttgaaaaaaatacacttcgtcattgtagacaagaagctgaggacctggcaagacaaagagagatgaaaaacaggttccagataaagaagcagagcctccttctcacctttttctaccctctcctcccttccatcccctcctgaatgaggtctttgcctttccccatgactctaccagcatggagaaatcgattgtcagccaaatcccaaaagaatgaaagaaaaataccttcccagaaggagagggcagaggggagagatacaagcatcagtaaaggctgaagggattggcctagaaagggtggaatccaaaagggtgtttattttcaaaacagaagcttaccgatcaggtacttttcaacagatgagaaaaatggaatgaatgagcaaagcttgtgcccagatacggggatatgcccacagcggccccagccactgagttagcaagagctgcttttgttattgctctggaggcagactttgaggaagccggattcgttcatgagcaaccagaggctcaaggaaggctgagtctggcccagtcacccttcctagtcacgtagaatcctaagttcctcccctgcctacacactgaaacagccccagaatcctcaccagccattccttggcatcttttcaagcactactcttttctacaaatgctctagaaaaaggccttagagacagggaagtagcttttcttcagaagctatgtgtcagcattaaacatacataactggattcagaattgcctctgctatgtatatgctgtgtgaccttccccaacggggttacctactctgagcctcattttcctcattggtgaaatgggaaaaatagaatgtacctcacaggatagaagaaggacaagaataatggggatggggtgcctgatggcaaagaaaaggagttcagtgattggcagtgaacctggctggggagacccccgggacccactcaagacttgtgcttatttttcctcattgcggatgtttggttttggccttggtcagctgctgctttggtcaaaaccacacgcgcgcgcacacacacacacacacacacacacacgcacacaaacttctgaggggtcattctcctcgtaaatagctcctggcctgcttgaataacaacatcttccaagccctgccttcgccctgggtctcagtgtccgcatgtggaaaacaaaatgtgtgactcagttttcattcatttaaactagttgaggggttccattccacccataatgtccaaggattctctatgcttgctgtaccccagacttcacttcccagtcacagtgctgggtcccacaaaggtggagacatgaggttttacgtgacagaaggcaatcctaagagaagagacaaaagacaaaaatgagaaaaacacttctcacgatttcccagctgctctacaacaagcatatgctttcaaaatttgtttaaaaaaaaaaaaaaagctaaaagacacaagtgaaaatcaaccataattctaccccttaaagttatggagatatggctgggcacggtggctcacacctgtaatcctagcactttgggaggccaaggtgggtggaccacgaggtcaggagttcgagaccagcctggccaacgtggtgaaaccccatctctactaaaaatacaaaaattagctggacgtggtggcgggtgcatataatcccagctactcaggaagctgaggcatgagaatcgcttgaacccgggaggcagaggcagcagtgagctgagatagcaccattgcactccagcctgggcaagagagcaagactctgtctcaaagaaaaaaaaatgttatagagctataaaagaggacattaatgtcctccacaacctgtcttggcagtttgattacaacaccagatgctaccattgtggacaatttggtatatgtctttcccaatgttttcctgagtttaaaacacacatccacatttacatgcataagtgcatatgcaatttttacagaattgtggtgggcaattttcattgttggatcattgcagttggcttgatactgtatcaagttcctcctttcaggtcagttcgtgtagttttacctctggtctctaatgcagcatccattctatggaaaaatcatatttattcagttatgtccttttgatgggcattaggttgattccagtattttttaagaaggctgcagtgaacatcatttatgtttcactgtacattctggtgcttttatttctgcagaatcaattcccagaaggacaacttctgagtcagaggatgtgctctttttagatgttaatgaagacttccaaatttgtttctatgatgtttgaaagcaccttatgcacccaccaacgggatgagagagctcctgtttccctataacctcgccaaatttggatatcatcagtctttatgtttttcccaatgtgccacacagggcacgatctcacgctttttactttttacttcacttagatttcgcttattttcatttgttcattggccatcgttatcctacaattgcccacttgtatccttggtttatttttttgagtgacgttgccaccttcaaaaaaatgtattgtcttatttttataattagttttttataaaagaatatacatgattttttaaaaggttttttttgagaatgtgagacttttgaaggctgcagggaggagaaggttttcatggatgggacactggggagtgaaaggcagtaataatccttcagtgtgctgcacagggccttctctttcacacacatttttgcccccatgtgctcctcagtgcagccctgggaggtcagctgagctccaaatgccttcctggtggaagtcagaacttcaccttgcccctgactaatgaggcttgcctcttgggcttgacctgagaatcatgagccctgtctcctgctgggacttttgcctgacaactcttcctgccctcccctcactgcccctcccatgcctctgtccacgagttctgcttttcctggaggctgggaattcacgtataagctccttcaggaatccagtgccaccccaaggactcctcatggaggcctcaggtggtggtggtttttatccttactaatagaatatcagttaccatttattgagtatttactatgtgcaaggccagtactcatggttatgcaagttgtccactgcacagctccagcaggcaacattccccgtgtagtcatggtagatgtgcggaattatttctgccaaatgaccgtcacgtgtcttgaagaagggtgcctttttccaattctcacagagtcaccatcacagtaagctgctcgtttgcgcaccaaccactgggctgagtgctctaagcacatggtttttaaaatccttagaatagccagctgaagttgatgattttacctccttctctctctctctttttttttttttttttttggtagtgactgggtttcactgtgttgcccaggctggtctcaaactcctggctcaagcaatcctcctgccttggcctcccaaagcgctaggatgacaggtgtgagccactgcatccagccttacctcctctatagccaaggaaactgagtctcaagttagtcacttgcccacgttacacagctaataagtgaattcaaactcaggtccggctgactccaaagcctgtgtttaatgcttgccctaccctccctctgtattggaatatggttacccccaaaatggtcctccgaaatgccccaagccatgattatcggccttcctcgagtgttcccacacactcgaggcaggctggtgtagccagtgtgcaggattgctgtagctggtgtgaacttgaactcaaactaaaaactgaagcattggagcccagatccagtcaagcgccatcttatcagcatctctggatccctttgtgggaaggaagggggagccccacttttgtgatgtgctgtaatcctgagtcagggttttctggtctctgtctcgggatcagttttcttcgatcacactcagaggttaggtaactaacacagaggtgctaagagtgagagccaatgtttcccatcttctgactgtggtgctgatggatggggcacaggtgagagggtttttctggaattgattcatcaggccgagggggatttccctctcactctctgctttcacttctaaggttcgtgtgtctttttaacattccttcggcttaccggggcctaagtggaaagttgtctttaggatccctttgttctgattcagttgccgacgctttatgatgttgttccttctcttggaaaaatgctccaaatggctcgtgtaactgatgcactccacatcaccctgattgacagtggggaggccctggttggaaggaggggttggggctggaaggaggggttggggactgtgaacatcattacttctgggctctgaaagccagcatgcctgcccttgatgccacccagctgggagccttcagctggtttcttggggaaatccaaccaggaaacgaccctgatgtttgcactagccacaagttgggaggaaggaggcaggctctgggttcagcctagggatgtatacccaatttttaggcacttggataactttattttacttatggcttcaactcatgtgtctggtcaatgaaaaaggctgttttgcgtttggaaggcaataggcaatgatatttattttttaagagctctgccacagctggttaccattaccatcccaccactggctgtcaggttgaccctgtgtaagtggcttcccttctccaagcctcttacccctggctgtgaaatgggtttgataaggcctggtttaaaaggtcattactaggattaagtgggatagtacatgtgaatagcttagtccaaggtttggcacacaaaaaccgctgaatagtattatcaccagctcagcaggcaaggcagaaaatactctacacggcacagaaagtgcattgccctcactctactggtgtggatttcacaaccactttggagagtaattctgcagtaagtaggcaagtttaaattaaacattcactatgacatagcaatatgacctttaagtgtataccctagggaaatgcttgggtgaggcacaagaagatatgtgccattagggttattaaagctttgtaattgcaaaacaaaaaaggatacaatacaaatattcattgatagacgttctggtatgtttatgcaataggatatttcacagcatgaaaatgcactctgcattaatgcacctacattaacatagataaattgcaaaaacataatgttggatgaaagaagcaggctgggtgcagtgacactaaaaatacaaaattagccaagcatggtgatgtgtgcttgtaatctcaggtactcgggaggctgaggcaggagaatcgcttgaacctgagaggcagaggttgcagtgagccgagatcgtgccattgcacttcagcctgggcaacaagagcaaaacgaaagaaagaaagaaagaaaagaaaaaggaaggaaggagaggaaggggaaggggcaagttatataatgatacatgcagtatgataacatttgtttaaaattttaaaacttgcaaatttgtactacatttattagtgaatgaatacatagagtacaacagcattaaatgtatgttccctaacttcagtttagtgtttacttcaggactaggggagggaatagaatgaaaacagggatgagtgggaggaagatttcaattatatttcttttttgttcatagaaaaaaattttgaggaaaatatggcaaaatgttgagattgattttactggatggtggctacataagtgttttaaattttgttttcaattttgttctccatatttgaaatatttcagaataaaaatttttaataaatgaaattaaattgcctcatgcagagaaagaataataagatgatataaatactcctttcaaggcatttgcattttctttcctacggtaagaggagagggggttaaggagctttgtgttatgtcacaaatgtgaaaatgtttggatcattagatttttaagttaaaaggctagttttaaaaatatgattcttctttaaaagaacagttggaaatgacagttattttaaatgttcttatcaaaagaaattaataatggctaaataggtcaccaactcgatgactagtttagattgcgttcttatgtttgtgaatttagaatggggaaatatccggtaagatgctttcagtcatagtggcatttctgctatcatagtcaaatagactaatataaagttacactaaactattttcccaaagtaatatgggagttatgaataggattttctaagcatcatggctgggatctgcctttgtgctggcctaaggtggtttgaagttggcattgaaagtgaaggcaaagactcacagtccgagggccacctctctttgggaaaatacaaccccctcttggtttctccgtggtcctttccccaaccctctgcagtccccactccctccccaccccgccagtcacctcaggtgcaccagtgtgcctccaagtcaggcctatgggggcctctgtgtgaaccaggaggaagcccccggggctcccaggctcttctccaggaagccctgctctcaaacgctgccctttccagagcttcctggagccttccctcctgtggctgcaggctaagggaagaaaggattttctttactttatttcagtctggttttttgattttcgttctgcggttctgctctgcctcgctttgtttatcagcatcaaagccgaaaccagctgtgtttgtttgtggatctttcatttccatgaaacctgcagctttttctaggtcactctgtgttcttaataatcaaaaaggtagttcacatggctgcaaaggaaggactggggtcaaaaaatcctcaaacccacggagccccttcggtagccttacccttggcctggatgactgggaataacaattacatgattttgttatcttccagggtccccccaaagagctctctctaacaggggtaattcaaatagaaatcttgcttgtttttgagccacaccctatgcaaaagactttattttaaacatctagaaccccaacagttatagagaggggaagagaggggatgttgggagatttttctataactgattaactggactgttagttggattattatggaaccagcagccacttgaggtcacaactgacaggttgcttattggggggaacatttgtttgaatgaagctccagttcagcggtggtaaatctagccatttaatgggccacttgatgtccaagggcaattactggtataaaaaccctgagccctaaaacaggagaaacaggagaccagatggaggcccctttagagatttagtcctaaatctgttaacccatcttgcaaagtgctgcctagttgacagcacaaacagctgtggaggccaaaccgggtgctatttgtcttagatcaggccagagaatctggaccgaatggatggcactgtttgaattttacggtaaaccgaggaatgctaatcactgaatcttagggaccacagcggaagcagcagcctgcccgaaagagcctcgcttcctcctgagcttctccccaccaaatggattgacatacatcaggctcccgaaacagcaaagacaagaccgtatttggatttgtaactccccgggtattttgcaggcaggtctggttctcgttgtccattgactctgagataaaatcagggcctctgcttagcttgagacaagccatgcgcttggatatcttccttcttggggcgggaatgcccaagtactacatggtggattgcaatttgctggtggtgctcccctgtcaatcttctcagttcgggaggtgccactctctgtcttatgttatccttgcccacacacatctttctctccccaccgtatttggtgtgctcctgaaacaaggcagcctcagcagggagatgtgggttatggctgcttccacccatgagggtttacgtggcatatgcaggtgagaaagggaggagtctctggcctctccaagcagagttccccaatgcctcaccatctccacactaaatagggtaagtgggaaggtaggagaggtgtgattatagaacctcatctaagtggaaattctgccagggaaactgcctttcctctgagtctcggcgaggcaagggtagaggaaggaactgagcccagaacacctggcatggacaactagtagtcatagcagccattgttgaatgaacattgatgtaaaccaggcgtggctctaaggactgcatgcctgttaatactttaagtccttattaaagctccaggaggtaggagctgttattgaacccattttgcagatgggaaaactgagtctgcaagggaaagtaccttgcccaagaaggggcaggcccaggcttcaaatccagggcatctggctccagggcctaagctcttcaccaataggcttccctgtgggggtccctgaggctacattactgctaagaatagtaacagtggtcatcgactgagtgtgttccttgtgccaggtactattcaacaagcactttccatgtgttagctcttttaacgatgaatcaactctgagcttattaccgttttatgtgtaagaaaactgaggcttgagtgacttaaccagaatcacataataagtgaagaagccaaaattctatcccagaaagtcttgggagcttgactcctaaccctgtacctgttttgggaggggggctagcaagttggcatgtggttggacttgctggcaaaggtactttctaagccctctgctgccctttgaagcctgcaatgggaaaagcaactcagtgagctctcggatacttgggaagagggattttcccattacagacgtggctggttccatcacctatactgagcagatcccccagcttccacaagcccatgtcatcttataccagcctagcactaaccatagttgctagcatagacttgtactcagtaaattaatagggaagctgataccgtccagtgcatccttgcctttctaggaaggaaggaaggaaggaaggaaggaaggaaggaaggaaggaaggaagaaaggaaggaaggaaggaagggagggagggagggagggagggagggaaggagagagggatggaggggagggaggaagggagagaggggaaggagggagggaggaaggaaggaaggaaggaaggaaggaaggaaggaaggaaggaaagaaggaaggaaagaaagaaggaaagaaggcaggcaggcaggcaggcaggcaggcagacaggcaggcaagcttccacactggaaaccagccagtagctaacagatgcctgactttacattgtgatttctttagattgatattcactaatgcacagaacccaaaggccatcttttggtgggtaagaatgtgacattttgctttgactctgaagagtctgggtagctcgagtaaatgatccaagtcccctctctttggcttagctggtccacagagcataacaattggtgttaccactgtaaggatgatacaataatggcatgagtacattaactaattagtacttactatgtttagtttctgtgctaagcagccaatatttttgcaataaacctttattagtcccactttgtcagatgagaaaactgagactaacaaaggttaagtaacctgcataaagtcacttatctggcaagaattgtgtcattattcagactcagggcttcctctccaaagccccgtattcttcaccaccatgcagtacattgagttgatcatgtgctgagatactgaggctcagaaatgctagatgacctgccaagacttctcagctatttgtaataatgtcaggatttgaactcaggctacttcttatatgatcctgtctgttttaacaatcctttcaaagacagagtttactcctttaggcaagggagggctctggtcagagccctgcagaagaaaaacagtatgaagttgtgaagactgatatgatacaaaggcagtcggtagtctgagcttgcttacaaactaatttgaaataggaatcaattagctgtgcaaaattcagccattgagatagatcattcatttaaaaaagaagattccacttcaaaatattgatagccaacttctggatataactgctcatgagaacaagcagttgcagagtgtggtagaccacttcatagatacttgacactgtttgaggaggagagcaggtcggtgtccagaagttgccactctgagaagaataactgatcagtgcatccatccatctatccaactataaatacctattgtattgagtacctacttggagcagggatctgtgtcaagggagagaggccctcacagaggttaaattctagcagagaaagcttctgtgaaaccagagttcacaataaactctgatggggtatgatagagtacatgcaggatgttactggggcccatgatctagtctagccacgaggaattgcttcctatgggacatgttgttttagctgagacctgagcaatgtgtgagagttagctacaggaaaagtgaagagtgttccagacagggggaacagcttgtacagaggccaggaggttgatgagagcctgtgtataactgcaggactggataaagcccaggccagttggaatgtggggaggggacagcatgcatgtatatttcaaagttcttgggtattgattacaaatgatcggcctcatgactctagatgaagactcatgtgttatgagctggttatactctccctgatggcagagttctccccaggggtcatctgctaacccacctgtcctggaagagaagtgagaacagaggttgctccatgcgaagtcaatggttcttcattttggaagaggtcatggaaatttctgagaagctctggacccttttcccaagaaaaagcatgtggcacatttgaaacgttgcatatcatttcaagaggttcacaggcacctcttgaagcttgtccatgaattggaggtataaggaccactggttggaaaccttggcttctttccctttcaccagaggagcaccatttccacctggaaatagtgctggccacaaatggtgaattccctctccataaaccctgccactcttacctgtgcatgcagacttctccctacacatctaaagacctcacctctgggtaactcccctgagttaatcagccatcagtgtaattactgtaccatactcttaaaaaatctgcacagtatataaactcaccttgagggatgacccccagatgtctcaccttttttccccatgggccaggctaaatggtattattgcatgggtattttcagacacatggttttctttcccccttactttcctttttaaaggaagtggcgatgggagacttaggacttaagcatttgaaaagagaaagattgataataccatagtacctttgtttcccctctgagatgctcatcctaaaactgactccttcaagggccaaccaaatcagtgagagtcacccagcactgccccctagttagaggagcacatttgggctcctgaaacaggccaggcacctcctgcctcaaggcctctgcactggcttttcttgctgcctggaattctcttccctcagataactacttggctcactccctcacctcattcaagccttcgttcaagtattatctgctcaatgagacctcatctaaccaccctatttaaaaatagcccccatccctttccctggtttgtttagacctttatcatcatctagaatactatgtatttcaatgtcaattttgtttagaaccccatgtaggcaagcacataggctgttgtgttctctgtgcccagaaaagttattggcacacatgagtcatattcaatatgtatttaatgaattaacaaaccaataatgttcccagatgggtttgaaaaagataagcatctctaggaccatgtgtatatatgaagtcaatccagacacttaccttccaaactcaagcatcacacaagcccagagaaatgagaatatcacacttaccaagcccttgggttctgctctagccagcacccttatgaaagcaattagcacctgtgatttggagaaatgatttcagggctcttgtgggagttggtaacaacttgaggacccctgatccaggcagtgatttccaaaggaaatgcatttggtctctcttggtcccatcctctgtcttttcttccagagtttcctgacattgaaaagacatttgtatttttgtggctgaaataggtttcttgccctcaagattttcgcaaagtggtagcctttattctttcgcctctggcagcactaccccctccccaaattgaactcagtaggattcaagcttccccaagacaaaaaaaaaaaaaatatgcttcctattgctgtcaagtggtatttacattcagttttggcaatggtggcaaaacccactttggtgtttttgccacttcttaaatatattaggttggtgcaaaactaccattacttttaatggcaaaaactgcaattacttttgcaccaacctaaatacaatcatcccaaactatcatatcaccttttgaattctcttcctatgtccctgaggctgtggactctatttgaaaccctcaccactgccgtggagatattaaattaagcattgcagcttagcatggaatgtgtagatacttgaagcaggatttaaaagacattctgatttcctagaaatgtaacagtatattgccttggagcagacagcaatgcaggaaggagcattcttttccagcactgagcctgtggctcttcaacgcaaaggaggttaaatcatgagccgagtgcgcagcatgtgaaaggttgaggatgtgttctgtttaggagatcctgtaaacggacttgttttgctgggtggaagaatgaatcatttctgccgtgcacaccagctgcagcctgtggaagtaaaccgagggctttcccacagcatgcgctgtatatttcattgttagagctttgcattttgacaggtagttcttatccttctggaaagagaggtctgaagccagcagctggaggaagacctggcaggtcctgccgtctaaattgagagcaagcatgtgcagcaaaacctcattataacatgacctgttattatgtggattttgatatcccatggggcaaatatgtctcccagcatagaacaactccatatagcagatgcctgttgtaacttgtctaacccagaatacaaccttgtctctgaatccagtgttattaaggggttcatgccatttttttttcaaattgaaaaacgtaccaaatgtagattgtgaattatatatactatacaaagtatgggtaaaatgcgtatgatgcatggcaagtgctcattgaggtctgtccttttgtagaatttacattgtagaagaatatggtaggttaattgcaaaaatgtccccaattttcaggattcctatatgcatgccctttgcagtgtgattttataactgttcccataaagaagtgggaaaagctatatagctctcttttccctctgcttgaatttagactggttttaagacttcctttgaccaacagaatgtagtagaaatgacagtacgccacttcccagcctaagcctcaagagctcaagctctctctctgtctctctccccactcccacctccacccctcactcagaactctgcctaaccatgtgaaaacaagcctaggctagcctgctggtagatgagaggccatgtgcaggagagcccagttgtcccagccaaaaccaccctagaccaggtcacagccagccaagccccaaatgtgtgaaagagccctgccaagatcagcacagctacctattccacttatagaggaacatgagtgagcccagccaagacaagacatatcacccaactgacctgtggactcatgagcaataataaatagttgctattttaagccactaagatttgaggtgatttgttacacagcaatagctaactaatacagggagacttgcaatgtgtaagtagatagtatttgtttcactgtattttttataaggagagaagttcaaataaggacatctgccttgcagggaataaaacagggtcacttggccaggttactttagataaaacgctgagtaaaggcctttctgaggagacaggtgagccaagacttcaatgaaaggaggtgcagactgtggtaggagccaaggcaagagctttcctggagcacagtgaagtgtgtggaaggccccgaggtgggctttagggactggtaagagaaaaggtctgggagagtcgcagggaccagacctcatggagtcctgtagggtgtttgtattttggtacaagtgctgggagaagccattgacaactctgtacaagagggtggcattgcatttttaactttctaggctgctgcaaggcagcatgagtaaatttggaagacccagtgggtagaccactgcagaagtcagatgagagatgctgggaactcagatgaggatggccctaagtgggaaggcccctctctgcttgctacagaattcgccatatcctgccttgtttagagcctgctgtttacccagtgaggtttcccatgtattggtgagctccctgcagtgggggccacgtcccctttctctctccctctccagtgcccagcacagagtagggccttagtaaatacttgcctcagcaaagcccttctctcaattttctaccccaactcatactgtggcagtctagacaacctcttccatttcctttcactccagtggatcgggagaggtgcccttcttctttcgcaggaacatggaggttacatgaagccctctaggacctagtctttgttattagggagcatctcttaatgaagaacctgtggccaccacctagcaggttcctctccaaggcctagagtatggtgcatgcctggggtctgtttggggttcagcctgacttatctggtgactatggggatgtctttaggcttcttggctcctcttcctcctgctataaaattcctctggtttgtacttcccaccagcccaccttgcaggcctgtgattgctgtgatccagtgtttatggagcacccagagcaatagaggcagccgctggggagcagatgctacatttgggaccctgccctgatgagctatcattccccaagtgcctcgggaatcacaaataaagggaactttatgaggatataaccttattatttttaccccatctctcactgcccttttattagtagaattattcaaggctggccttctcctttcaactggcataaattttctttcactcagcttggatttttttttttctctttttttttcctagggaaggtgggtggaatttagaattaaaaagtagcaatgcagtgggaatgcagacctgtcttaaatttcacagcagttcatgaacttcaggaaatctgaacacacagcatgcaattaagagcaggaggggatttttttaaaaatcagttgtgaaagaaaaggtgatcgggtggagaggggctgatcgcaggcctctggggcctggaagttggcgctgaggacagggcagacaatagcctgttggcaagccagacgtcttagcttgtcttttgatctttaatcacctcgacttgtctaagacagagcacggcaagactctcctctggacagagaggccaggactctgaacagggctcaggaaaggccacagggccctgagagcttgggttcagcctaagatcctcccccaagcctccctcgcacgatgcggtgtgactgactcttgttgccactttggagctgcagttttctgacatggtggggtcgggcaggaagctgaggggctaggcacgaggacggggccgtcagcccaggccataaagatacaggggacggctgtgagctaacgggcaggatgcaaggtgggggtttcctccgcagctgcttctctatctcttggcttggctcggagttcagaggaaaagccatgttcctacttttgctctggaaattgggatgagaagcccttgggcagcagcacacatatgctaagggcacgtgcctggagcctggcagacctgggtttgagccctgctgcatcactgctctggggcaggcccctttacctccctaagcatcggtttcctcatctgtaaaataacatcacaatacctcccctgaaggattattttgggcatcaagtgtgctaatctgtataaactgccagtagttcctggtgcatggtagggcctccattaatgtttttattttggatttatttttttttttttttgagatggagtcttgctcttgtcacccaggctggagtgcaatggcgtgatctcagctcactgcaatctctacctctcaggttcaagtgattctcctgcctcagcctcctgagtagctgggactacaggtgtgccaccatgcctggataattttttttatttttagtggagatagggtttcaccatttggccaggctggtctcaaactcttgacctcaggtgatccacccacctcggcctctcaaagtgctgagattacagacgtgagccaccgtacccaacctattttggagaattttatagaggtaaatagcttagttataaactaactgtgtgacctttaagcaaatcactgagcagcctctctgagtttcagtttactcctttgtaagtggggataggaaaagtacctacgtgcttgtttataaaggtgaggattcaagcaatcagatgtgtctaatgcacagcccagggcttggcacaaagtcccaggcagggtttgactgctcttgctactctggttttcccctaaagctgtactgtttcagccagggggtaaatttggtgcccttggtccttcctctcccctcagctgagccactagtggagctggagaaggcctggagccagggcaacctacagggatcatggtggctggtggggagccctctggggccaggaactgggcccagcaccctagtccataataatgatgggcttctgtgtcctacttacttttcatacatccactccaaagaattcttataagagccctgctgggtttgtttccatcatccccattttgcagatgatgcaatcaagaggttacatgattttcaagaggtcacatgggctagtcagagtaaagcagccaagatttgaaccaaggcagtctggtaacaggaccccatttatccactgtattctgttggtcagaagaaccctggggtggtcagaccaggaagagggtgggaaagtgcacctctggccttctggctgagtgtggtggcttacaactgtaatcccagcactttgggagtgcagggtgagcagatcacttgaggtcaggagttcgagaccagcctgcccaacatggtgaaaccccgtctctactaaaaaataccaaaaaattagctgggcttagtggcgcatgcctgtaatcccagctactcgggaagctgaggcatgagaatcacttgaacccaggagggcggaggttgcagtgagccaagatcatgccactgcactccagtctgggcaacagggcaacattccgtctcagaaaaaaacagaaagaaagaaagaaagtgcaccttctgtgagccagtagttcagccaggggacccagaagtctccactcctccagtgtgtggtttctccaccatggatgagcgggcacttacatggcagtggggtcagctaggggtttagaactggccctaggaaaacagagggcccattctggcctgtgtctggagggcacttgtgatagttaatctaggctctgactcactgaagagaacttatgggactttggagcttgcagagacagcctcagtgatcaactcgagccttctcagtcatggtagcaatgccaccatcacttgagccctcttaggagcatcaccctgcaaacttcttaaatcctcagtggctctacaagactcttgtcctcaatgcacacatgcagaatactgagccagcagagccttagagaggcacagtgcctcacccaaggtcacacaactagtaggtaacagacctgagattttatctccccccatcccagctcttcccaaggccacaggaatcttccttggcacccctttcatagggcacgtccttcctcttggatatatctagtgtgagagagctcattcctcctaggaaggtccattctgtacatcccctcatgcatcggccagatgacttgggagataaaagtttgttttatcaagggactttggcaaaggaaagtcctgcccaagatttcattagggaattgacagagaaaatagcaaccaccgaatggtatggatgaaacaggaggaatctggaagccaggcaggcctgggtttaaatcccaggctatgaagctgtgaagccttggataagtcacttcacctgtacggaccacagtgtcatcattggtcacatgagaataaccagacctaatccaggataaaaaatagcacatgcaaagccctgggcctttgaaaaaacttgacaccaagtagcttctaataatagcaataactgctatgattactgccactgaccctggcaggacagcatttaatctctgtacaaatgcaaggataaatgagtgtgttccctcaatttttaaatgcctcttgcatttattgacagctgtttggtgatgaggagaagcgctacatcaagtgccctcatcaaataaaagctatgttctcaattcagaaaaacttaaaggtagggagatcttgcagtctaggactatggaaattcacggctcttcatcactccagaaaagtgtgttgacagaatccatacttaggctgaaggcacgtggcaggcttcattgctgcatgaactgtgtgcactcacattaaagatgaggcagggacatgtgggctgaggaaggtccaggcagctgactctggcaagcagaggactaaggaggaagactccttggctgtgcaaatggaaaagaaagtcataaaaattgtgacgaaccacatgaggagcggcccagtgtgtcacctacctaccccagcctttccttgatcagggcctgcctccaactagctgtgacattgcctcttggtgctgctgctgcagaccccactatcctggcccccctcgcatctgttgctcttcacatcatcactccagatggagaggcatgcaaaaaaagaaaagtgaatcttaaagttcaacaatcaaatggctggctaacatttattgagtgcttgctgttgcctggcttcatgctaaatgcatcatctcagacaattctcaaataaccccgtaaaacaattgctattatccatacccattttactgatgagggaactgaggcacagagaaaactaaatactttgctaataaacattggaggtaagatttggtctgttccataccaaagcccatttcttaccgacatctttctgtgttatgtcctgtcattccataacataccagaaatatttactttgagacaagactgttgatggggaaggaggtggtataagtggagaacacttggaaggtgcctggtgttttgcggtcaaacctgttctcttttctgaggcccagagaagttaagcaacttgttcaaggtcacacagcctctatataaagggggtttcagaggccctggggtttctgagctcctggaggaagacctgcagtacttagaagtgttgttagaagtgttgattgctgaattaaagtgatagagtagaaaaaaccccttagtgggatcatctgggggcaactgcctcactgtaatgagagagcagctgagaaccctagaggtcaccagctaaggcttttaaacacttaacagaatttgactattggagggaggccctccagggtaagggaaagctagatagcaggggtttacacctggccccacccttcactatgtgaccttaggcaagtcccccagccccagtcagaatctgtgttcccatctgaaaatggggttgctgacaagattattgtgagacttggctgtcaagaatacaaagtgctccatgtaggagcttgtgtaaaataactgctcaataaatattcgttattttctagaagattccagatatcccctgagggtccaaaaaatggcccctggtgttatttaagcatagaattgcttcagctccttctttttgttgcctacatgggtgctcgtgggagatgatattgaggattgaggaaagcacaccgccaggaagggtgttccctctgccatcaaattctcacccttgggttcctgtgcctctagctggccgggccacaagcatttctccagctgctggcccagggaccgaggtgaacagaagtgggtgacaaagcctgcctgtctcccaggccactttctgggctgctcctgaagtgcagccaggatggaaccataaaaggcgacgctccctggccgctgtctttgttttcctcgctagctggaatgcctcatgatgacaggcagccaggaaatgccccttcactgtcccaacgccacctccctcaggaacgccgtcagtcttgccttcctgggctgcacagaccctgcgggtggcaggaagaactgcactccctgggtctagagggaacacctgaatttcggcccaggtaggtggcctggtgttcacattatcttgtaaggaaggacaaggctgaagcaagagggaacagtatccaggaagtttttgtggacttttacatttaaggaaagactcattcagtaccccctgcaggtattaattgagcacctactgtgtgctaggccctgtgctagtgtcttagaatgtaggttttatttttaatcaggtctggtgaggccactgaaaagatgatttgttgctcacaattccaagaggggaaggcacaccacatcatgcaggaccactcaggaaacacttctgaacactccacagaatttgactattctgtttggtcagaaagcagagggagccaggggaaaacgtgggcaagagcctttgttgtggcttttgtgggaaaggcgagcaaggcagggtgagcaggtttagaactgactagcttgaataatttcagtggactctggggtgtagttgttgtcctcactgtctggtgcttggtcccagggtgattggggcagggaaataatggtctggagtgtgagacccctagaagagccccagaagggaggaagtggttggggtcggggctttggattgattggtttgcatataaaaggtgagctccaagtcaaaattgtttactatctctaggagttagctagccctaggagaggcagtgtccttcaggtccctaaggccccagatgtcacagcatcagaataaaaagccacacttgctacagctaggctgtcaggagcacagttgtgcacaaaacagacccgattcttgtcatcatagagttttctaaccagtagggaagaagacattgaattactttttttttttttttttttttttttttgacggagtctcgctctgttgccaggctggagtgcagtggcacaatctcggcttactgcaacctctacctcctgggttcaaacaattctcctgcttcagccttctgagtagctggtattacaggggcacgccaaaccatgcccagctaatttttatctttttagtagagacagggtttccccatgttggccaggatggtctcgatctcttgacctcgtgatccgcccgcctcagcctcccaaagtgctgggattacaggcgtgagccactgcgcccggcccacttctcattattaatgctggtcaaaatggactaaactaaaatgaaaaattggagcctgtcaaaagcaaggaaaacaaagcaaaacaaaacaagacttgtgtaagggcagaggccagaagttggggaaggaaagggaagctccaaggttttgtaattttccttgaccaccctaatcacatcccagtctaggtggtttatctgaccacagaccatctgttcttccccgggcatgccagtggtgagttagagaatatcgtcagaaccctttgaactcctgggagagatgtcctgcagaacagccccatgcatcatccggctgcagctccccctggccctccctctgcactcacctcatcccagaccatttggaaccaacctggaaatcattatctcgtcaggttactttgtcacatcagcaagaggaaaactccaaccatggagataagatgtggacttcgcctctcttctggccgaacttcctaccgtgaccatgctgtgattgggggcctttccagcgttcagcacagcctctcgtgctgccctaccctgcctatgactgagctgggaccagaagtaccaggacaagaaccaattttggagcatgaaattgagacgggtgggagatttaaagccccattggctcctgggagaaatggagagactcaatgaatataagaaatggggggtcgggcatgatgactcaaacctgtaatcccaacactttgggaggcggaggcaggcagatcacttgagatcaaaagttcaagaccagcctggccaacatgataaaatcccgtctctactaaaaatacaaaaagctagccaggcatggtggtacacacctgtaatctcagttacttgggaggctgaggcaggagaaatcgcttgaacccgggaggtggaggttgcagtgaactgagattgcaccactgcactccagcctgagtaataaactctgtctcaaaaaaaaaaaaaaaaaaaatagaaatgaagtcatctccaaaatagaaatttattgactgtgtttctttctatccccaaactttggacaccacgaaatgatcatcaaacccaattaattatatgtcatgtaattttttaaaaagatgagtagtgaaatgtttttaaattcttgacttaattgaaatcagtgttgatgtgacttgccaaagtttaaaaaaatgtgtgtgacaggctgaacattttagcttaagaggagtttcaggcacatcaaatgcaaaaacactgaaaacgattcgtctaatttaattgtcaagttgtgccaaaaatgctaacatgatatctttgaagagtaattggtacaaagaatatcctcaaagagaaatatttccacacgtctggctcttatcttgccctcgttaaatttttttcctccccattggcagagcagcgcatgcctcttccctgccccttcggcatagggacccaactggttctgcagatttttcagccactgaacttaaacatgccatcggaatggaaggagtgcagattccttcttcagatttagcccaagataatcttggaggagttttttttaatcctttcttgccgccaaatgcggtcttcatgtgtatttgtttaatcagataggttgggaagctgttgtgtgctaggcttcttatagataagcattctttctccctgagggtgatgacttctagagttttggtgctatttccttgaagtgggttcaaaggtaatgtgcagcccctccccctcaaccacattacctggaagttccttgtataggcccaagggaatgcttccgtgagaatgtcatatttgagtgaaggcctgaagaaggtgagggagcgagttttggtgatatctaggggcggggctttcctggcagtgagaagagcacatgcaaagcccctgaggtgagactgtgcctagcacgtgttcatgacacgtgacatgagtggagcgaggataggtagagcagtcagggacgtgtcagagggggagcaggtcagactgtgtagggtctcatgggtcacagtgaaggcttttgctttcactgtgaacgaggagggaagtcaccagaagatggtggcagatgttggtcctgagctggcttcatctgaatgggatttctctggctatttctctctgtgagaataaacaggatgggggcaaaggcaggaaggctattgaagtaatacagaaaacagacgtttgatggtttggaccaaggtgatggcagtggagatggagggaagcagttggattttggatgggttttcaagtgaaaggtaatagtatttgctgaaatattggatgtggaacatgaaggaaagaggagccaaagatggctccagagttttgggctgagcagccagaagagtgaggctgccgccatccagaatggggaagattacaggagaagccaaatgatgatgttccggagctcaggtttggacatattaattttgagatgcctgctaactattgcttgctggatgactcctcttctacctcctcatcactctgagcttagaccacatgggtccccggccaagttgaaccagggcaatgatttaactagcactgatccaacccgtgggctcctcgtgcccacataccactcatcacaattcagagggcaacctcctgggagacactgagagaacatgagatttctgtctcaataagagtttgccattatgaaatgtacttggctagtgaggcctatacacttgtaatgagcagaatatagattcaactgagctataaaataaaataataactattttaatatacagcatctccctgccaaggcagctgaagagaagcctatgagcaataaaattagtccagagaaagaaatgaaaaaccactgaaaacagccaccttctaaaaggaaacagattagaagggcccaaagagggaagccatcaccaggagtgaaactcaccagatagtgataaaacagttatgagagaaaaggccggaaggaaattttccaggctgctgtctgttacttcactaatcaccgtggtgacctcatccctccccctggcttcatgggtgatgactctaaagccctgatcagggccccggatcctgcttccattggccactgggaaatctccttctcagtgccttctcaccctcactccagatgcagtcctcctcctgaaaaaccttggcatcatcctcacctctccctcctctctcacctcctgtcagcctcaccactgtccctttcttaccatctcaccattcaccacccactccaggccaccatcacctcccagctgagtcctgcttccaccgtagtctctatacgctcagaaggaccagtttttgaaatgaaaatcagatcaagctctccctaaaaaccctccagtggaatctcattttatttggatgcaatccaaatgacttatgaggacttccatgtcccataaggtacctacccacctttccaaccttgccttatttcactcttccctttgtttaactggcctcctgtctctttcccaacattctggcctcagggcctttgcgcaggtctattgctctgcctggagtgcttacctccagattgtcacatggtggttcaagcagtttctccaactcacaactctcctcaccactccatcattgattgcttgccatcacataaccctggctagttgctttcatggcaataaaccatagggaaggatcttgtttgcatatttgtatattgcctgccctcccctccatatgcaagtactatgagaatatggtcttctcttatttcgctctggatttccagcacttggaatatggtctgatatatatatatatacattttgaaaattaattatcggtcaggcacagtggcttatgcctgtaatcccaacactttgggaggccaaggcaggcagatcacttgatgtcaggagttccagactagcctggccagcatggtgaaaccttgtctctactaaaaatacaaaacaattagctgggcatggtgacatacacctgtaatcctaactgctcaggaggctaaggtgagaggattgcttaaacccaggaggcagaggtttcagtgagccaagattgcaccactgcactccagcctgggtaatagaacaacaatctgttgcacggtggctcatgcctgtaatcccagcactttgggaggctgaggcgagtggatcacttgaggtcaggaatttaacctggccaacatggtgaaaccttgtttctacaaaaatacaaaacttaaacaggggtggtggcacagacctgtaatctcagctactcagaaggctgagataggagaatcccttaaacccaggaggtggaggtagcagtgagtggagattgtaccattgcactccaacctgttcaacctgggcaacagagcgagactccatcataaataaataaataaataaataaataaataaatagaattaccagcatagtaacagcaagcattcattgaataattactttgcaccaggcctgatacatgcaggctatttgcctactttgttccttgcgcatcaaatagtacctggcacttagtacgtgtgtaaaaacatttttcatggtgaatgaatgaatggatttaattcttcatgtacctatacaatcgcagataggacattatgggtttgctcaaagtcccacaattggtaagtggtgaaaccaggatttgaactcacactgttaggaccaagtagatgctcttgatataccataggaagttcaatgaatggagtccatcatagagtgaaagtcaagctactccatccagagccagaatactcagtggctaagacatttccccccaagctaagagaccactctgcctccttgctgggtgcaacaatttcatttgagatataaggaagaagaaatttggaatttgagagaagtgtagttttggatttgaaacttagcagcaaaagacttttgactcgccctgctttcagttgctattgaatgtgcctgtgcagacagagtatttacatccatctcagggcagcctgcagttcagagtctgaaatcaaatgattatttctgaaagtattttattttaaaagcctttgagtgacaaatgatttagcaagttttcaacacgatgtttcatgtggttttggttgccaaagagtgacttacggccaagcctgggcactctaacccaagtgagcctacatggatctaggccatcacattttttttatgatgtttaataaagtttagcactttttttttttctgagtggtttatgatagtcctgatggtagcatctcagcaggctgggaaggagtaccatgctgatatattagagggaaatgcagaggtggaacgtggattcactgacccctctagacaagtgcacggcaaagggcagaaaggggacactctgcctgtggcctggacctctctcctctcttcccagcaggcttccagtacccgtcagccactatgttcttaacttagaggtgggttaaagcttttctgaatacagctatctggttattattatgaaatacctattttattcaatatccatttgtttctaatatttatgttggatattttatatacatcacttattctttccttaaacaactattttaattagaattaagtttggcttcgcatgacagaaaatgctaaaataattgtgaaacttctttttttcttatatgatataaatctggtgggaggcagtccatgtctgggtgatgggtgttacaatgtcatcagggtcccaggttcctttaacctgctgctctcccatcctagagaaaggggtcagcaaactatggcctgcagcccactgcctgagtttataagtgaagtgttattggaacacagccacactcgttcgtttacatattatgcatggttgctttcgtattccagcagcagagttgagtactgccacggagaacatatggccagcaaagccagaaatccttactgtctgaccctttatggaaaacatttgctgatccctgtcctaggacatggattctgccttctgagtcaaaatggttgctcgcaagctccagccttagtggctgtattttggccacacgaatggggatgggtcaaagagggagggtctttctgtggacacttcttagaaactatttgcagtccctctgcttatatttcattagtcagaatttagacagatggctatacagagctgtgacagagcctgggaaatgtagtcattattctaatagctgtgtgtccatctgaaagtaacaaactctataactaagaaggacggtgtacttagtggagtggacagctggcagtgtctctgtcacaagaatcctgcaatgtgagtattattcccatattacagtcagggaagctcaatctcaagcatttaaacaacttatgataaagcgcacctcagtttcacaactggttaaattatgggtggaaaaaagccatttagaatttggggactagagggcatcagggaagcatgaatattttgcaatctcttttaaataattttccacggtatgaaatactctaactagacttccaagtttatatcctccaagctttttcatttcctctagactttgttcaccttcctctccagcagaatggtgccttcctagttccaaataataacagatctctccgtcttcaaaacatcaggcagacatccaccccattgctcagcagggaaatcctataggatgagatctgtgtcatcctgatcttggagtcaccagataccgcgccttagaacagaatagatgcttagcaaaccattaccaaactgaacacaaattagattgtgaattcctttgaagtaagaaccgtgtcatcctcctcctgtatccaacttctcttatggtcttgatcacgctgcaaatattgtgggtaactgtatcagtgaaaattagttcagttccaagtggcagaagcccagctcaaaactaaacgaagctgaaaagaatatttattggctaatgttactgaggagcccaggcaggagtggctctgttggcaggcacagctggttctcagatctctctgcctctgtctctgtctatctctctatctttccatctctcccacccctgttgcattcatctctcttctctgcttctctctgcatgttggactcattcccttctacaggaagctccctttagatggctgggggaaagatagaaatttctccacgttccgtggccctttctgctttggattctgaagggatcctctgtcactgtctctgtctctctctctcagtgttctcttatcagatctcatggaagactcaaatggagcacttacccaaccttgaacccatcactgtgaccagaggttgagtaatcacactggccaagtcccagttgggagcccatcctggggctgggaagaagtaagttagtttcttcatgcttgtgacaaagtgaagagtgtccaggtaccaaatacgtgagagcaattgattattgcagatatggtccttgaagtaaaaaaaaaaaaaaaaaaggaaagacactcaggatgcatactcaccaattcttcagcaaaattctcccagaggagcagaattctgatggccacgcagagggcaacagtccaccttacttactgctaagaaatgattattatttctttttaaacaccaatgaaggttttagaagctcagccttccaaacagcaccttcatcctcttcatatgtgtacagtctctctggtatctggagctgatattcaggccttttccttgtacatcagttgctgtttatttgggattcatgtgtttctttgaccttctgtgcaaggttgatggatgggtttttaagcatctttaaatgaattacaatatatgccaaacttatatttttgtaatatttctgccaaactggactacagtggatggcttatttccacattcctttggaatgtgcatgttcataaaattttacacctgtcagttggcaatttgccaacattcatttgctatcatatcatgatctttttttttaaacaacaacaaaaaaatttaaacacaggtattagcatggacagaaatgtcttccaatagcatgtcattttgaatgtcttagaaagatgggctccataaaagaccgtgcagctggaaagaaatgaaaaaaaaagaaaagggatgggagggcaattgggctggctgagcttggtgttctttggtgttgcacaaaccctcaggccaccaacctgggaggttgttttctttgcaagcagagtatgcaaaacacttggacttttcttatatggcatcccagactcaattaaactgtatttacttcttctattagctaagatacttagtttcaagtgacaaatactcaactcaaattagcttaattaaaaaagaaggcagcgggccaggcacagtggctcatgcctgtaatcccagcactttgggaggcctagggagttggaacacctgagatcaggggtttgagaccagcctggccaacatggtgaaaccccgtctctactaaaaatacaaaaattagctgggcatggtggcgggcaactgtaatcccagctactcgggaggctgaggcaagagaatcgcttgaacccaggaaggtggaggttgcagtgagcagggatcacaccattgcactccagcctgggaaacgagagcaaaactccgtctcaaaaaagaaaaagaaggcagcgggagaatttttcagcttaaagaactagaaaatccaaggacctattgccttgaggtatagctcaatccagcagcccaggcgatgctatcaagatgctgtattttcttcttcacttggctttccactcctttaggtgggattcattcttaaactgcctttcacattgaggtggcaggatggcttctgtcaactccaggctagcattctacaattccacaaagagatagccacttttatgatggttccagtgaaaattcagggcagactctcattgggctggcttaggttctgtgcccattcatgacttaataatatggcatggccaaggggatgctgcattttaatagaccaggtctgctcacatgctcccactcagatgggtcatggactgagagtagaccttggatagtttcccagagtaaattgggggtgctattattagaagggaggatggatacagggcaagaaaaaaagcgagtagcccaccatgcctacctttctgaaaagggcagtggggaaaatagatacacaaaaatgccacattcattccccatcaaaattaggggcagagaatttagggatgaggattctagaaggaccttacaaactgtgaagaccagtgatgtgcaggcatggtttagctttcagtttcaaattaagttctgacaaatgcccataaatgcctttgagtgaaatgaagctagaggacttggagccccgtttgccaagtcttccctcttacctaccctctaacccacagaaatgcacccacagcctctgaggggtttctgtgggcttccaaaaagtagatatgaaaacctctgagcttgtccaaagccataatggacacacggaaaaaatgaaaaaccagggaagtaaagaaatttgccaaaggtcatatagcttgtcatcttccatggtgatagaaatcccaagatgtctgatttctagcccaaagtttttcttcttgctcttaatttttttttttttttaaagaaaagcagcagtagtttggtgagctttctgctgtgactgtgccgacatcatctaaagcttctgcctgaactggtgaagccatgtttgcctttggccatcgatatattgatgagccagtctttcaggtttcccaagccatgaagaggaggtgtggagggccctccccaaaaaggccgagtcttgttgggagaagaggttccgtgtactcactaaaggaatattaggggcttactgggccaataatctgccaagacagtgacctaatattctgccaccacagtgggtttctgatcatttagttcccctttgatcagatttctaacctaggttggtaagatttttggctaaatgacagatttttctcattcttcgctgaaatgtatccagttacctcttgttgtataacaaatgcccccaaaacttggtggcttaaacaaccattttcttacatatcagaattttatgggtcaggaattccatcagcactaagctgggaagtttgactccatgtggacacggagtgtggtccctcagtgatacttagctggtggctgtcctgggttggagcatccaagatggctgtagtcacatgccaagggccttggtggggtcagctgcaggctgggcacctctgggaccctcttctccatgtactctcagagcctctcctgtggtttctctctgggtagtgcaatttcttacatggcagcttagggctccaggagaccaaggtgcatgggacagacccctacaacaattatcaggcttaaaatgtcaatagtactgcagttgagaaaccttgctccaacctgacattctaagatcatttcttgagcaagaaatagccttatactaggggcaaagttcagcaaaatgtggcctgtgagccaatgtcagcccactgcctgtttttttaagtaaagttttattggaacacagccacacctgttcactgacctatggctgctcttgagacatagtggcagagctgagtagtcaaggtctgcagggttcctcaccaccatgctttcctctggcccaagaagcaaggggctgctgagggttttcctggagctaggaagggcctggtactgcactactccggagaagtaccttgtctctgggctaaagttccttcagcagcccaaccaagataacggctccttgctcccaccttgctccaagggtagggatggatgagataatgtctgagcagcccctgtgggctccttcaagatagcatggccatccgtacgctgtgggctagcgctctgtttccccagaaactgatgattcagcgtgaaatatggtcttgcctggggagaagctgaaacaggccaaagcctgaggtcaagcccttgctagaaaggaaggattaaaaagaaattaatctctcttgttctctctttgttcacatctccagtggagagaggccaaaggcaaggaggacattgatggatagactgagggtgttgtcctctgaggccgctccatggggagttttgcagggatctaggttgcacccctgacagtctagcccagcacagtgcccaggccccatccattggggacttccagtcttacttcatgggccaggtctcttggggacacatgtgttgtctgatgtcactaatttgatttgtagcatggtggaaaccaacaacttagttgctaaacagatagctattgagacctaaaatgaggtagagaggtaggaaccctgaggttgtgagttctggattttacaggcacctggagctatggcttcagtcctgccctaggagggcatgggccttaagtgcatgcacacactactcttcaccactttgggtgctttcttctcagagctacactccacagatgcttcctgaaatcagaacctctgagttggagaaccattgctttcttggaaggagaaaaatgtggaaaaactttcagaaggctcaggagtcaggaagaaaggcatctctgtggtccaggcccatagggagatgctggactggtttaagggagcatgaaaaagggaaaactggttaaaaggccatgccctgctccagggaaaaccaatacccagttggagccacatgccttggtaaatcccaaggtgagggctccagcatctgggtctcctgctctctcagcctgcccaactgtgtctccagaccttgctgtgggactaacatgttttgcaaagggaaatactaatgcctccctgcaaactgtacccacttttggtcatctgcatctgagcccttcttcctggaggatcacagaataatgatggatcaaaagtttgacatggaaaccactgtttacccctagatctataacatagtctgtacttgggagatctagcttggatctcagaggagaatttggcccattatgaggcgcatattaaaaacataccccaaagatgtaaactctcagaaaacagcattgcagcaaagcataatattatttaaaatctgggccaaaggccacactcacagaaacctctctgtaactgttagggatactagaaaaggaattatagtcatttgatgcacatcagacaaacttctgttaacttcagagcattgcatctggttggctggccacatttactccagcctcatgtccacttttcaggaaatgaattgctaaagaggaattcagtggctggagcatcttttggaacttgttttattcatctttgaaaccacagatgtttgcaacttttgaggtcttgctccttggttatttggagtgacgttttgaggtcagggtttctgcaaatataagaatatttgggaccttattttccccactctgggttcttttattcatacctgcatttctgaaatatttttaagccatctattacgtgccaggcaggatactaagtgctagaggtgggcaaaaccagacattgttctacctattaatagtagggcatttagtcaattggcaaagacagacgttaatcaaaggatcacatgaatgcattaacttgcaactgtgactaggcagagaggcaggacaagttgctctgaaatcatatgatggtagctcatgttcattcagtgttatctgccaacactattgccattatcaagcctctccgttaattagccaatattacagatcagaaaacagaggcacagaaaggtcataaaactagtaagcactggagccagaatttcaacgcaggcattctgactctggaacccttgtctttaactcctgtactgggaggccttgagccctggagggccacgagcaaaggcttctatgatgaagtggcaattgagttgtgatctaagagataagttggagttgcttaggtaaaagggtggtgttccagacagagagaacagcatgtgcaaaggtcctgtggctggaagccatagggaatgcagaaagcagagggggccatggagtgagaagaggttggcagggatcagaccatgtaaggttttgactggagtgctcctcccagtcttttcccaaatggatttttgcccatgtggcatgggtttatgctggaagcagactttggagagtgccaactgagctgtttaactttgagtggcagtagatctcacatggcaactacttaatatataaaggattcccccaaggggtggccaggagaagcaaaagctagaatcctttgcaggctgatatctgttgtagaaaacccttccctcagcaacccaagatgacagaacttcagccagaatatggctgcagtatagagacaaagacatttgaggttccctgagaggaagggagggccctggccaggaccctgcagaattcctgatgtctgccctttgtttcccctggtgcttgtctgtcaacacgatgtctgccattctagaacatgtctctctcacctttgctcacactgtcccctccactgggggggccatctgccactttccaccccaaattctgcttgtcaaattccagccctcttcaaagcagtgctacgagccatctccatgaatccttttcctggcctaaagccagaagaaggctctcactccttgtgtgtcagcagaactttttattccctgctcacagcatttgtcatattttttctttatattacagtcactcaaactcatgtctcatctctcctaaaagattgtaaactctgggtctatgtgtgtgtctggtatcccatagtgaacagagtgcagtgccaggcatgtagtagacttgcagtaaataattgtttgatcttactcatagcctttgcctcttctctatcccctattcagctcttccctttttcaactctttcatttgcaagcaaaaagaaaaaccagctcaaaatcacttaagcaaatgagaagatttattggcttgtggaattagaagattgagacccgccttcatgcatggtgggtcccaggggctcagatgatgtggtcaggagctatttgtctccaccctgagtctctcctgtcctgcgtgtgttggttacctcctcaggctctgttggtagcaaatggctgccagccatcatccttccagattcagatccacaagcaaagagcaggtgcctttcctgcagtagttcagcaaaattctcagctcctctcactggatttgattgaatcactgcaggccagagaatgtgatgctgtgattggccaagttgagtcatatgctctatgtctggagcttatgggggtggtgggagcttctggacagaaagtggaggaggtgggaacttggtctgtcttcctggaagtaaggtgaatgggggctgtggagcaaaaccccgtgcctagcaggcagtaacgtgactccatgtggggcactgagaggctgtagctctttgcttttgaaaggctgctgttgacattgttagagtggaaatatccatgcagtgagagaaagggtactcaggcctagattttaggtcctaaccctcctccccaaagactagcaaaggaaatcccctgatttttaaagctggatgaagagttaggaaatgcagtcacgtgagtcctggaggctttttccctgctgtgtccttctcagccaaattgaaatgtttgtttccaagggagggcttccatcctctgattaaggaggcagagcttcctcctgccccgggagtttccacagcccagtgtacttttcattgtgatggtctctgggtgctgtgagctcagtcgtggggcttgggggataggcatttaaggttcctcaagtccctgggtacagtcactttggaattattgaatgggctgctctttcctgctgaaatctttcctcggtgacccgttttctgagcgagcagcgcggatttcagcaactccacaggtagagagggcactggaaaagctacctggagacactctagagctgagcacaggttgctgattaatctgcttctctgcctggcccgtcagcttcatgaaggcaggggccttgcaggttcacttgccgtcacactaaaggcttcatctcacttaactgtggcaatgattcttgaagaacccaagacagaaagtttaactattttgcccacatcaccccagtggtaagaggttgatccaaccaagttgtgtgactctacaacttctgcttttaaccattttgctgggcagcctaatttatttctgagacgtctgtgaccctccccctaacattgcaagcggccctggtacccatttctctttctggaagacgctccaagcatttgctctggtgtcatttgagagttggccatgatgaggagatgctgtttcctcacccaggtcttgctcaggactcagcttcacttgcaggcctgttgcctttctcaatttaaagctcagatgtgctcaagctggggccgatagggtttctccaccggtcaagacaacgaaaatgcatttctggcatggtttgaattaaacgagaatttcccgtttttcataaacatttacagtagttgtggatgcagagttgaaaggtttagggttttggtgtttaattagaaacaaatgccctttatggtccttttagcaagggcggcatgtctcaaattattaggattattcatcttatttgtgcctgcattttgattttgtttccactgctctcggtgctgacttccccaaggtggctgggcgtggtggtgggaaatgggatcctcagaatcgctggtgaagtttctgtctgagagccagggctctgggctggctttgggccccacctcacaggcagcccaaggccccctccttcctttccagaggctggggtaagctgaaagcttagcgggcagagcagctgcatcctctcttggggcctgggaagagagatatttgccagccttgagaacccaggtgctctgagatgaggctgacagtgcccctaggctgagccctaactcttggtttaaaacaagggcagcttgcagcacggggaaggggggaggggggaagggacacatgcatgggaacccagccccctgggaagcagcagagaggactctgaaccatgcagtttgcaaatgtctttgttttgtcattaaggaaggttttgaagctgtttctgaagaagaggaaaaggccattcacagcagcctgagaccatccacaccccaggagagggtatcatccatttggtgtctcctaaaaacaggcctgtgtctcttgtcagagttcctaggagtccggcttcagcctggctactcactccttcaggtcccgtctgcacctctgtcttgaaagcaacagacaaaatggaaggacggaaaatgcctgaaaggcctttctacttgttaaggatgtcatcagctcccataaagcagtatctttgaatatttggtgacaaagaggccatctttggtctcaaagaggttttttcataaacaaagaagtttatgaaaaagccttttaaagccatttcagtctatgagtctcactttacagatggaacaactggggcccaggaaagggaaagcgcttgccttcatggatggtaagatagtccaggtcgtctacaccctagaacaccgcattctacctcagtatatgcaaagaattatgcaaagatgtgtattatttcctctcagatgtatttagatacttcataaaagacattgttttccctagttaagcctaggcaggattacattatttcctccatgaaacagttctaaaggcactattccataattcactatggaaaatttggaaattttaataaaatttgaagaagaaactaaaagtcactcatattcccacgtcctaaagttagttctatgactattaacatagtcattgtttccaattggcttttcttacttagaaaattagacttgaatgatgccgatgcttggctgtgaggcttaagcctcagtgctgccatttcttttttttttgagacggagtctcactctgtcacccaggctggagagcagtggcgcgatcttgactcacggcaagctccacctcccgggttcacgccattctcctgcctcagcctccccagtagctgggactaccggtgcccgccactacgcccagctaattttttgtatttttagtagagacagggtttcaccatgttagccaggatggtctcgatctcctgacctcatgatctgcccgcctcggcctcccaaagtgctgggattacaggggtgagccaccgtgcccagccagtgctaccatttcttaaccatgaactggggccagttccttaaccccacaatacctccatattctcatggggctcttgtgaagattaaataaaattcttaatgtggggtgttcagcatagtgccagtgcattttaataacttgctattgttatcatcataagaaaaatagaaaaatctggacctgacgtggtggctgatgtctgtaatcccagcactttgggaggctgaggcaggtggatcacaaggtcagaagttcaagaccagcatggccaatatgatgaaaccccgtctctactaaaaatacaaaaattagctgggcatggtggtgtgtgcctgtagtccaagctactcaggaggctgaggcaggagcatcacttgaacctgggaggtggaggctgcagtgagccgagattgcaccactgcactccagcctgggtgacagaatgagactccatctcaaaaaaaaaaaaaaaaaaaaaaaaaaaatctggaagccccacaataataacgacacagaaattattaagttagaagacccaaacaaaatgagagtaaggtagaagaatgatgaccaattactcaacaactcaagaaaagaactaattcagtcggttggtttttaaccctatttccttaaatccactgggacaattttaaaaaatatatgtatatatttttaaggaagagattattagaaagcaacagaaaatgagtccctatatcttctccctagaggagaactccatttaaatgttcttaaaccagcagaaattatatgaatgctaatgtgaaattgtaagatataaatgctaacagggcattttcaggggttcctttcttttctccttttttttttttccttttttccaaattctctggttggggttagttacacccggctgttttaatagaacaaagtcatataatgaactttttcacataaagtgcattttttccatgattcactcactgtaccttgtttacgcagcttgtaaacatggtagattaaataggtttctttctctggtgtgcaaaagtccagacgcctcaaagccagggaggaagaatgagggggaggaagaagggaaaagagaaggaggagaaagcaataaatggatggggagcaggcgggtgcaacatgaaaatgaaaacaatgtatggccatggaaaaacagagagcgctttgctggagtggaacgtgcaagtctttttccctgcccccaaccccacccctggccaaggtcaagttataaacagacgtggctggggcatagaggaaacttctttctaagactgtggaaattgtctcacaaatcagacctcaccttttgggcatgccgattgggcctacacatcaggaagcctcctctctgcactctgagaggccaggtttctcacagttgaggaccgagctagctcttagaggtgcggggttctatgggcatgccttgcagttggatagcttgacttataaagtaggttgggatagaaggatatagggcctggggtatgtttcaaaacacttcaccaacagaaaaaaagaaaagaagggggccagctggagcaaatgtagcaatttcattgataatggctgaatctgagtgatgggtatacagaagttgtgatgtttaattttatgtgtcaacttgactgggctacagtgcccagatagttggtcaaacgttattctggatgtttctgtgaggatatttttttggacgagtttagcatttaaatcggaggactttgagtaaagctgattaccctccagaatgtgctgggcttcatccaatcagttgaggccttcattgaacagagactagggaggaaccctgccagtggactgcctttgaatttaaatgtttccctgggtcttcagcctgccagcctaccccatcagattttggatttacctctaaacacgtgagccaatttctttttgtttttgtttttgttttttgttttttgtttttttgagacggaatcgcactctgtctccaaggctggagtgcagtggcaccgtgaaaactcactgcaacctccatcttctgggttcaaccaattctcctggcttagcctcccgagtagctgggattacaggcacccacaaccacgcctggctagtttttgtattttcagtagagacgcggtttcaccatgttgaccaggctggtctcgaactcctgacctcaggtgatccacccgcctctgcctcccaaagtgctgggattacaggcatgagccaccgtgcccagcagccaatttcctgagataaatctctctccctccataatatatatatgtgtgtgtatgtatgtgtgtatatattcatgtgtatatatatgtgtgtatatatgtatgtgtgtgtatatctatacacatatacacacacacacatactgttggttctgtttctctggaaaaccatggctaacacagaggcttatcatgttatttctttctttcttttttttttttttttgagacggagtcttgctttgtcacccaggctggagtgcagtggcgcgatctcagctcactacaagatctgcctcccaggttcacgccattcttctgcctcagcctcccgagtagctgggactacaggcacccaccaccacgcccggctaattttttgtatttttagtagagatggggtttcaccgtgttagccaggatggtctcgatctcctgacctcgtgatctgcccgccttggcctcccaaagtgctgggattataggcgtgagccactgcgcccggcccctatttcttaaattatatctgtttgaaaatttggaaatcgggcagacctgtagtcaaatcttcccccatctcttactagctgtgtgaccttggacaagccactgaccatctcagactctcagtcttctccccatcccctgcaacaaggaacaattcataacatccattgttatgaatccatattatgaataacaattcataatatctcattgggtgtggagagaattacatgaggtagatgttacctaattcacatatttatttatgcattggttcaacaaatagttactgcacatcatccctggtgctggagttgtgacattgaatacaaagggctgattgccctgccctcaagcagcttacatttcagtgaaagagatggaactaagtgagataatcacacacccaaacatacaagcacaaatgggaataagggctttgaaggaaaggaccatgattttatgagagatgaatatgaccaagaatggaggcttcagggagggcttcctggaggcagtgacacttgagctgaggggaaacaggtggtgcaaaggccttaaagagggagggaatgaggcaagtattactgcaagaaggttcagcagagagggagggagcatgagcccagggaaggttgcaaagggcaaaggtgcacaggaccaggctagaccaggtgggaagtcctgtcaaagagtatggtccagacaatgtgcagtaagaagccacagaaaagtgtcctattaacatagtatttcccctctctctctctctctgtctctctctctctctctctctctctctcttgtgtgtgtcggggaggggggttgggggcagagagagagagagaaaggaggtggtggtgaccagaagcagctgctgttgctgtttttaccatcctcactaccaaaaccatgtactaggatgcttcagctgctgcaaagctcgctgaggacagggccctgtgcattaagcctatatttagaaagttcatcttttgaaagcaggcaaccacccagagaggactgccagcagacagcagtctaggccacagggcttccatcttgtgccatgtactttctctggcaccttgacccaatcattcttagctctgagcctccgtttcctcatctggaatagaataatacctgatataacagccttgcagagcagctgtgagtttattgatatcagagcccatgaatgtggaaaggctttgaaaacgtacaaaagcacaggaaaaaaaaaaaaaaaaaaaaggtaaggcggcatttgctccgcatctggtttccatattgtctcaggcattttgtgttcggagagctgcctgggagacagctgcttaagttccaggtttaggcctcagggtccccagtggtgaagagaagaatttctggataataagaataaccaggacatggtattctacccttcatagaggcctttttttttgcaggagggacctcatttcgtcctcacaggctactggtggaaccataggacaggtattgcaaacaccatttcatagaaagatcagatgctcgaggtgataggttctttgagtcagtggtgaatccaggactctaactcctgtcttatgcagccaaattcagttctctgtttaatacacactctttttctgtaataaataagtatggattatggggttttaaaaccggagttactttagagatcaacagatgcattttgtttgacctgcatagcacggtgtcttacacatctgattttgttgccaagatgtaggaatttggtagttcacataaaactctaggtttggggtttctcttttgagaaatgaaggatctggctgctggagatctccatttctgaaaaacaacattggctggagggagaggtggtggctgtctctttagttgacccaggaactctcccagtttgcctgccaccatgccttctactcctaagaagcctgcctggtacccatgtgaacagtgcacatttgggacccctcatctaagccacccacgttattaaagtagaaaaactgagttccagagaagccaagtggcccatcgaaggacacccagcttttgattgtcagaactggggtagacagagaatttggatgccttctctccagccccgcccttggccatgcttagctccttgctgacacacgtatgtctgtgtggctggggtttttccctgcccttgttttctagcccagaagatagggacttaagtgagagcaagtgtggcacatggggcaatgaatgggcaaattaagagtaactgtgtagacacatttagaggggaaaaggccatgtctcatttgcaaaaaacccagatcaagccacactatttacatctcctgtaacaactgaccaaatagtcaattagtagagtaattccaaaatgatttatttaaatttaatctgaaaggagaaaaattaatgtatcgttgggagacgagcactaggtccttttcaaacaactgctatggagggcattgcccatgtggcatgttttgggaggactagatctcacccacaggcattcacatcagctggtaacccctggaatgtaggggccacaggtcacttcagcctggcattcaacaagtgcatctaaaatccttgtgatttttatttggaggagacctcctgctgtctgtgaaactggccaccagctgcttccccagcccctattgtggaccagccagatcctcatcaggcatcttcaactccgggctagacctgacagcctgaagaaggccccctggccctgtctcatgggggtcctctggagcagaaggaggtctggatggggacccaggaaaactgcttgtctccccagctctaccccaactagtccagctctgctgtgtgaccttacgtctgctgcttcccttctttggaccacaagtgtttgttgagggtcttataaaacgcttttagtagcaaaattctttcatttgacaattccttcagagaggatgaggaacccaagcttcattccctatatttgcagcactgagggttcctaagcccccacctctcctcctccctaatagaaactgcactagctttttatttctcccctggtctctgagacttcctggggactgagcaaagctctcctacggctgggggttttgtgtgctaccccacggaggaagcgttcatcttcattattctaaagaggagctgccggagcaacaatgagacattttatgagaaagaagaccttaaactggttttcattaaatgtggcttgatggaggcgcaccggaaacgtccactggagcaatggcagcctttcaaagcccccctgcagaaacgataagctataaaaacaaatggcccagcaacagaacaaaaaacaaggctccaggaacatttgctgggctgcaaacatggcccgctgggccctaccctgcctcccagaggctgaactatccagacctggccgatgtagaggatgaaaggagccaggggtgcttcctcaccccgggagattcagtggtggtgggcccggctggggcaagtcgaggacagccctgggcatcagcagagtgccaagacagcagctcacaggtgccgtgtgccaggcactgtaagaagccctttacacgcatcccctgctgtctttgctaacgcccctacagagatacgctattaccattctcgttttgcagccagcaaacgaaagaaagggaggctcagagatgttgagaagttgtctcaaagtcccagggctgagtgggaaaaatgggacttaaactctgttccagagaaagtgccccaaaccacctgcgactccgcctcctatgaggaaatggttatggacttgaactgagcttcagacctcaggagagagagcctcggcaataaatcattgagcccaaactcctcgtttcccacataagttgtaagtggctgggttaggggtggggaggagacagctctctggtaccggagaggcctgcgcttgcacacatcttccttcctcactccttactggctggctgtgcatagacagttccctaccctcaccgaacctcagttttctcattcatgaaatgggaggagcctcaacacctcgttttgattggtgtcactgtgatggtgaaataggattcattcaacacacattattgaacagcttctagtgcctggcactgtgcttggccttggagatgtagcagtgaacaaaacagaccaaaatccctgcccttacagaacctggattctaatgtggagatggacagtgaatatgataaacaaggaaatgaggctgcatgtcagaaaatgatgtcagtcacttgaagaaaaatgaatcccagagaaggggtgggggtgcagcatggaacagggttaatagggtgctcaaggagggtctcactgggaaatgatttaaacaaagtcttgccagggctgaggggacagtgctcccggaggagggcatagggaaggcaaaggcctggaggtaggagccagcctagtctgtgaaggaccagcagggaggccggacagaatgaagaggcccaggaagtgccgagcagagcctctgcctcctgggtagctgctgtcgccgttattcttcttttcattgtattaaccacagagccagatgtctggaccctcctccccagtctgaagcttttcctagcttatcccatactgcataggtcaggatgatgctctctggctcctgaccactgggtcctcactttctgctctcctttccgtccatgtattctcttctcacagcattactgagtaaccctgtatgcgctcagggaccctaaggaaggcaccaaaaacagggtaacgggacccaagacctccaaatgggattctctagttcccccgccccttgggttcctttagcagcagaggctgccggctgtccagcccagccatgctctgaaccacacccaagaactcacaaccctggcaggaggacccggcccagtgggtaccccctggcacagcaactatgagcacagctggccatcctctctttgcctcttttaagtctcctcctgtcctgttctttgcagtgttggtgtactctgtctgctccatatgacacacacagaaactcctgactggagggcagaggttttctgtgagtgcttcttggagtgtctccaatggaagcagattacccctaagagtcccactgaaaggataaattgttcctcagttactgagatgttcaactcttccccatttacaatgcctggcactcctgtgacccatccattctacctgatcccatgcattcccacgtgatccgacgcacagcagcccacaccttccgccgctctgcagaaatgcagtaggacatcagtgttcactgcgtgtcctggtggctcactgcttcttaccactccatccttctgatccctccccagtggagtcatgtaattggatttgcgtcttagaaggagctctctggttgccatttggagtttggagtatggatgggctggaggatgttgacgcagggagttctattagcaaactatggcaagaatctagaagagagatgtggccgtggtggagtgaggatggagaatgggcactggtttccagagatattctaaagaataaaagcatcagggtttggtgattgatgagatgggagagaagtcttttggagaaagcacttatacagccaggaaaatgatgactgacaatacagatgaaggtgcagttcagtagatgtggaaagtaggggctattttgcattacatgaaggaaacgtcacaatgataaccacagaagtagacacctttagcaaagatatggatgtcaaatctcttgtctgacattggtcacaggaccctttggcaaagaatttacactttgtgagatgtaattcttcctttgttgtttgaggatatgatgaggtaacagccctagcacggagtcaggcacgtaacaggcagcatccattgctatgatgatttgtatatggttgtgtggaatgatagtgattgttgtattttgtccctcctcctgcctcccttggtaagggtctcagaaggggcttcttgactttaagctgttttatattatgctgaattcttcaaggaatccaaggagtatccagcgaggatccagcatttggcaaacaactcagaattcagatttatcctaagtgactctggtaagtgagaggaaaccaaataatgccccaggggacaattcctagaaggactgccccgtcatcctcccccactgatatggggtgggggaggtggagaacttcttaggtggagaaggatttggcctctttccagccagagacaaagggtggatgtgatagagctgggggtgggaggtaaggaatggaggccaaatggcacatcagtcactaataaaatgctgtcgttgaggcctaataaacccagtagcccatcactgggccacatgtgtgagtgggaggacagcccttttctgtctgtcgaacacttgcccaacccaagcagcagggccctggagctcaaggaggagtataactctaattgggaggctgagacctgaagcttggaggcctagacttaggtgcttgaagaggggaatagggagcgtcccagacaggcccagaggtatctaaaggcccacatcactctcatccccatcggtagcctctcctgcctgggcagccttgcttagtcccatgctgccctgccccagccatggttgattggatgagggctgagcactgggaccaacagcagccacctcatcatctggatggactcctgtgaatcggcctccctgaacggatgaaataggccaggcaggttcttgttcttgagaatctgaattgaggatcgtggggaggtggagttgattagtggtgagaggtaaggcttcgagagagagtgggagagtggccagggcagccatgacatgcaagctgtagttccgaggaaccagagaagagggacgtagagagaagcaaatggcacacagagacagcgcagcaggaacgaggagatccatgctgccccagctcctgaccctcctccagatcctatggactgggtgaatccgtccccagccaagctcccgttctcttgatttagcttaagtgcctccttcattcttacaactaagagagacttacagggtgaaggtgaccacacaccatgtcatctgcatgaaccatctctgtggtcttctccaagggaagggaaactggagggaggccaaccgctaacccgcctgaggccactaggcctcgtttgtgaccgcactggagccaggctggggagagcgctgcagtgacctggccactcactcatctttatgagaacatcccccacgtgggagccttcctttttcatcgggatgtttttcttgatgtccggccgaaacatttccattctttatttcttcctattagtctaagctctggccctcgatgttactggctgatgtaaccctgtctccctgtagctctccctccaagtgcagatatttgactgcttacacgtggacagccttttgctgctgcccccatccgagacagctcctccacagcccctgttatttcagccttactcctccactcccccagagacgaggtctgatggagttcagggatagatggaaggacagattaaacacagcgggtgcaggaaggcaggaaggcaggccaggagaagggagactcatggacttgcagtgaaacaccagagatatggaggctttgagcagatgtgggacctagcagatcatcccagtggtaacagcccaggaggaatccctgcagaggattcccttctctaaggggtagaagctgagagtggttgttttaggaagacctgaacctttctgggtggaaatagaaagcagaaggaagacaagtattggccactatggaatccattagaaggcttagagaagttttgactattccttttgtcttttagtcaagaggtaactagtctgctgttagggaagctatgggtaaccttgaagtagacaaaaatttggatgaaaaaggttacccagagctgctgtcaatgagaaggggagaaaggggaaataatctgaaagacactcaaagctcttcattttttcatgaaagatctgtcccatcttttcatattccttttttctgttctcagatatttcactgccagagtaagttttgggggaagtcaagtttggtgccatgagttacggactcaacgtgttgctttttcaaggcatgagaaagagagagagagatgagttttggtcctgacagtattaatatccatagttcagagtcagaaatctgtaatacaggtgccactactctccagtcccaaggctggcttaaccaataccttctgcactcttttcacagagccacagtgagtatggttctccaggcagccatggcaagcctgtcttaataacattctagatgagatgtatttaccatcttgggcaatgttcccatttttgatacaatcttcaatgatctcagcattgggggattaacgtggcacaagggagtggtgacctccaccatagctgtactgaaaagaaaaagaactgacctcttctgtaggatatagggaaaagaacttatctgtgtacatttggttggttcctggcttcatcctatataaatcctgcgatcttagatagattcttagattttctgtctcaattttctcaacagtaaaatgggtttaaaacgtcaactctgcagaattactatgaagattaaagatgctatatgtcattgcttttcacagcgcttggaaaatgctcaataaggggtagtttggcaaaaattgtgaaaattcttaagactctttcaagtctagcaacttgccttaatatgtttttggctgaattggttcaaaaaacattgacttggcatattaacacattgacctgtctatattcaacgtttgtaaaactaaccagggcaaaacattcctgcttggattactatctggagtctcatgacagtcctcgcctggctttctagacaatccattttgtgtagacacttagcctcacaatttttggattctgtgtatagtatgtgcttaggaatggccaatttttatgttggagaagacaacataaagattgtgaaagctgctcttgatgaattgttaaaccttcccatgaactttccctaccagagatagtcagagatagtcagatgcacaagccagataagagccaagaatgggaatgaccattcctagcatttatttgcaatggaaagccaatggcttttatttacaatggaaagtcaaccctaccaccagggctcttgtcatgtaggctacggggtctaaaccccagcgagcaccaatggcgtgatttgacaacctaaggcctttcatcaaagctgtggcttttctgggacctaagggggagccagactgtttttggctgtttcagcgtctttgtaaaaccaagttgtttgtcatcttaatttttaaaagcatggaatttgaagttctggccaaaaaaattagcaaccttgtacattgcatgtagcttgcataacagatggtggtctgggaggttgatgtttttcaagacttgatgacttcacggcttgatgtcctgaatgaaattgttttttctcagatagcatttcaggaatggggcttttgttaaggaggaagacctgagctgaacccaaagtttggatctgacttttcttgagtttctgaaattcccttccaaagaaaactttgatgtttatatatatacttgttggctcctgcacatctgcacctctcactttcttcatagggagtgggagccagactataataagagaagctgttatctgagggtcttgcagtgactgggaagtaaggaacagccaacccttccaggactgccctaggtgcctcccagaaatggcataagctttgcataagcatttggtctgtggggtgccggtccgaactgaccttgctcttgaaaggaacaaagacatttctttcccagataagagaattttgactttaaaagcagctattcatggtacagtcattgtgtgaatgtggctttgagtgtcactcccaggagagtgggataaagaacgttaaagctgggaggggcctccaaaatactctggttcacctccttcgttttacagatggggagactaagatcccggacaagaaggcaccatcctgagctcagagagcaactcagtggctgagctttcattaaatcttggattttcttctcccaaatgagcatagaccatttcttacctctattccctagccatctcagcatccatactttgcagaaaagatcagccttaaataatactggcttagtcccctagttctcagtctggaacattctcaccacaacaagttgttgcccaaagtagaagagtaaggtgtgaaatgatctatgtgaattctcagtgggcacctattctgatgaacttgctccccagttccccaagtgcattctgttttctcccttaaaaatcacagtcttttaaagatgtcacagaatggcacattgacttatcctgatcttaaagagcatctagtctgtattgtcaggtaggatataacctcaggtagggcataaatgaggtttaatccacaggcattagcctggaaatgcagcgatccaggatccttatctcccaagaactccctaagatgcccttgggatcctgaacaaatcctttcctctctaggcctcagtatctttgtttataaggcatgggatccagttggcatttcccaaatatattctgataaacactggttccatagaactgtaaaaagtttacaaaaaaaaaaaaaaaatccccacaggatatattaaattagtattatttacaatgagcatttaaaatatttttattattttaataaacattactgaaataagtattcttttaaaaaatctataatcacaaacatttggccaattctgggctaaacaacattaaatatattgtttttattgcaggacttagagctttcagtgtgaaaatgtgtcttagggtggggcgcagtggctcacgcctgtaatcccagcactttgggaggccgaggcaggcagatcacgaggtcaggagatcaagaccatcctggctaacatggtgaaaccctgtctctactaaaattacaaaaaaacaaatcagcctggtatggtggcaggcgtctgtagtcccaactactcgggaggctgaggcaggagaatggtgtgaacctgggaggtgcagcgtgcagtgagctgagatcgcaccactgcactccagtctgggcgacagagcaagactccatcaaaaaaaaaaaaaaaaaaaaaaaaaaagaaagaaaaaaagagagagagagagaaagaaaaaagaaaataaaagaaaagaaaatacgtcttagaaaatctccaagcatggataaaatatatgctatttctcagatgtatttgaccaagtggatttgttcaattcagtgtccagcctcaacctgatgaacatggggcagatgatctctgaagccatgcgaagttccagcattgggcttttatgcacccttcgttaatatactctaacattgtgcttctttcatgcctagtagctctgttttctaaaataatgaatggacccacttccaggtttttctctcttattatcagtgtgattctgtttgtattttctcagcttatgttttttcagatgcagaaaattatgtaattagctgtgaggtctcaggccataatttgggaaacatttcccacttaaattaaaggctctgtacgcccacccaatccacaattgtgtggatctttcaaaactctccgttggcttcatttaattgttaaacattaatttaatggggggaaatcttcaaagaagggatagagggatagaggaagcgtggctggtaggacaaaatattaataggcggttaaaagcaaaacagtaattcttcccatctaagcttgcagtctttggtcgggtggaaaagaaacaatcggttattccgggattatataggtttcattgacttaaaatgacctaaaagcagccagagagggatttaccttgtctttattttttgcctgaggagacagaaagaaaaacagggttttgttttgtgaatccaaaaatgcccttttccatggtggtttccaaaagcgttcgttaaagcacgcaatgccgttcaacaaagactaaaaattaaaatggaaaaatcccattttgccagcagctttgctcacacagccatttagcgcagcaaactccaacccagtccccagtgtgggacaggactcagcaccttctcggcatccgagttgaggctggagatgtgtggtgttgtcatggtgattgctgccaacaaaggttacccctggtggaacccctttggccctgtgacccacacacagagttggaataatagactctgtaagtggcttctgctctgcaaatagagacagggctggaaatcaattattaatgagatgggtgacattgacattcatccacatttaataagcacagcccagcaactggaggaaagctggttttgcccagcaaaatctcacgggttgatgtgaaattcagataaaaagaaaaggccagggacaaaaaccccaaacaggaagagatgatggtctatagctactaacagattttaattatttagatttctctgcttgacattccttttgataccagttttatcctaaatgacctcaaaggatttgacatgctgatcatacaatctcctccccaccgcctcccacacacctaccagagagacaattggagggtggtgggctcgtccgcaattgggggaaggggatgcagtgttctaatagagtaataggcacagccttcatttgtggttcagaagccctttggtccatttttggacttctttgcagaaaactaagatgctaatgaaacttttttcaaaagggaaagatgttgaaatgtgtcctcatgacctgtgtcctccatgcagagtaagcaggactttggtttctaaggctctctacaagaattaccctggtttgtctttttaatttccttccaagacagcttatgatttctttgtatctgaaagagtggaaagctgcatttgtactaaactagaggttgacccagagtatgcagcctttgtaagcggggagagctttttaatttaaaagtatgcctctgctctaaagtgcgagtcggggagcagagacaccgatcatttttctagaatcacttcacagatgggtaagctaggatccaaagaaatcagctagctgactataacatttactcaactgacctttgaatgaaaaacaccagccagcctccctttggaccagacttcgttaagtctcaggcctggtatctcaccctttgatattctagatgcttttctggagtctgtcacttcagggggggaaaccatcgtcttccacctctatgctccaaacctatcctggtttctaagactgttctttcagcaaacttgtcatttgcagacattgattgcttgtggcacccagcatggctgtgaggggagacttcttgtggaaatgtggccggccagccccgctggtctgcagtgagttaccggtgtcggtggagcccatgcggcctcccagcatgctggcaaaggacgccaaggtgttcagcagagactggagtcaattaaaggctgtgacttgggaaaagccctccttgcatctctctttttaatctggaccctttaccttttgatattctagacgcttttcttttgccctctgtcagcattgaattttttaatgtgactgatgtctcaggtcaataattatatgtggcgaaagttcttaggtgacaggtttagatgcctctaatttcaaggcaaaagcttgaggtttcacagtcccttcctgtaggacggggttgaggcactgggccgagggggctgggaggccatcagcattctgagagtgatctagggtttgccccacttctggtaggttgtcttgatatctgagtaagatggtaggggctcctacccttcagttatttcccacacccgtttgtttagtgtagccccttagcaggggccaggaagttcagatttattactacgaaactctttaaataagtttcaatttttatgtttcacaatttctcaatttatgacttcaactcctttgacagagactaacaaacttgggtcctgcaagaccttactccaggccctgcatcaagtcagctcagccaatcaatacaatatgtgcttattgggcacatactctgtatcaggcacagtgctagggccacagtggcagaccgagtaggcaggatccctgtctccatggagctcacagcccagctgggaggaccgcacagctacgtctgggaagtctcagggttggggaggtacggggccttggaagcaagggcaacaatcatctaactcagaccagggctcagggagggcttcccagaggcagtgttgtctaacctgaggtctggacagtgagtttgagtttgtccagtgaaggaggacaggagaaagctaaatcagagagtggaggcagctgggaagatggaagaagcttaaggaggtgacttggtcttgtgggtatttccttagaacagtaaggagctaccaaagggacttatgccaatttgtatgttttagaaagtttactctgggcacatcagagacaatgggattagaatttgagacttaaaactattgtttttttgttgttgttgttgttttgtttttgagatggagttttgctctcgttgcccaggctggagtgcagtggtgtgatctcggctcactgcaacctccgcctcccaggttcaagcaattctccctccctgtctcagcctcctgagtagctgggattacaggcacccgccaccatgtccggctaatttttgtatttttagtagagacagaatttcgccatgttggccaggctggtcttaaactcctgacttcaggtgatccgcccaccttggcctcccaaagtgctgggataataggcgaccacgcccagcctgtgttgttttaatataaggaatggaagaaggtccacataggatgggggagatggtcctagcccctttcacaggtcatgctttaggaagagggtacagacagccccattcatgggtgtgagccttacctctattttactcccaccttttccactgttatctgctgccggtggctcacaccagtcatcagaacctcagtttctccaaacatttgtctcctgggtataaatcttttgctctggcaacacccctcaattgtggcttagaatagacttccaccttctctccccaaaacccacccacagcctttctctctaaaaataatattcctggacctgctggcactcacacaagctctgggccttagttgaatttggaaggcagtcatgcagtggaattccagcaagttggcttaaggtacccatttatttttgtacagtagtttcctgctttccaatattccagaggatatttctcctgtcacttagaagaggagctgaagaaactacaagtcaggcaagatgaaggggaacatgtttcagccccacttggaaagctggttgggaaatgaagctctgagccactgaaataacatactgaactcacacaccatgaaatactacatcctggatacacctgggatgagtcatggccacagcaggaaccctggtggaaatggccacagtgactgatggttgatggtcgagtgacttgtgtccctggctgtttcagctgctagacttcagccactggattctttgtgcagatgctgcctcttcaccgttatgtcttccattgaccatgatgctcagccatttcctctcaaaaccatgggggccatcactgttctgtttgggtcctggttttgaaatgactggggaacctcctgtcatcaccttgtgctccttcagattgcagcttgaccccaagaaaagggaagaatttgaataggactgaaaataatactcactactatttattgagctattattttgcaccaggtcctgtactaggtccttctctttttttgacacgaggtctgttgcccaggctggagtgcagtgacgtaatctcagctcactgcagcctcgacttcccaggctcgattgatcctcccacctcagcctcccaagtaggtgggactacaggcgtgtgctactacatgctgttaatttttgtaatttttttgtagaggcaggctttcgtcatgttgcccaggctgttctgagactcctgggctcaagtgatccacccatcttggcctcctaaagtgctgggattacaggcgggagccaccaagcctggccttttttttttttttttgacagggtctcactctgtcatccaggttggagtacgttggtatgattgcagcagtcctcccatctcagcctcccaagtacctgggaccacagccatatgccaccacgcctggctaaggctaatttatttttattctttttgttaagatgaggtcttgttatgttgctcaggctggtcttgaactgctggactcaagcaatcctcctaccttggccttccaaagtgctggcattatggccatgagccactgcaccccactgtgctaagttcttcagtacaggatctcatcacatcttcacatccatccagtgtggagttcctgttatccttttcctgaggatgaagctgggctttcggagaggatgtcgcttgcccaaggcacatgaccagtaagtggccaagctgggattccatcctgacctgtccaattgtaggggctgcattcttatccagctcgccacgctaccactcactccctgggtgacctgcccctcgctgggcttcactgtctctgcatcatcaaaataatatgaaatcttgaattcgaaggaaatgttataaggaacctcagcatctggaagggagaaaatgcagagctgtcctgggtgaagtgcgggcatgtgagagtcaggagagcaaggagcgggtctgagactcccatggaagcatctccccaggagcagcacacgtgtgttgctgtttggtttgctggcatcctgatctctccacaccagccccagtggcctgagccgcctctgggtctcctacccactgccctcaccccatcaccttcctttctcacctcctctcttcttggcagtcttctactctttggcttctttgctccttttgcctgagggagtggactcggggtttggatggaactatgatcactccccttacagggaggtagtgtggattaaatgccaaaagacatgctgtgtgcttagtgtcaagcctggtacagggcatgcagcaaacgttggttcctaaggtgattcgtgtgaatactgtcagtatcattccggacacagagggagatgagggaacctttgaacggtcatgagccctggttagaatggttagtcatgttcttctccctctgccccgtctctcacccaagcaccctgagcccttcttggactcagcctctgttgccaggaggcctctgccacagcctggcctctcccatctgtgacactcctgccagatctcactctgtcccctgacggacacaggatttgctaaccctgtgaaaatcccttaggcgagaagcatattttggtaaaatgaggccttaccctgtggtccttccagtgttgaccctgtctttgcaggttagccagtcctgacagctaggaagacattttctgactcatgccccaggattttaggggccaagggccctcaccagagaagaagggtttcaggcagtttttgtttgtttgtttttttcctgttccgttgaaagccctgtgagagccagggaccttgtctttctcagttgctgctatcatcccagcacccagccttgggtcaggctctaccaagagtttattaaaatattttggaataaatgtaaaagtgaaccgattaactgagaacacagcacaagtaaagaaggagcctgatagtacctttatgtccatgagatgggggtgcagcttactagggcccagtggccaggctgggtttggtcctggctgtaccacttaataactttgtggccctgaacaatggtcctgacctgttcagtcctctgtgttctcatctctaaatgagaataaaaagagtatgtattgaaaagggacttggggagaattgagtgcgttaatatatgtaaacagccttagaaactgtacttgacacctggttcatgctcaaaaagtatcgtcatcattattacatacttgagatatcactggacatagaggtttgtttgcttgtttgtttgagggcagggatgaatctcactgagttttgtaccccatgacaagccccagcttagtccctgttgctggtgttgtttgtaatcataaaatgaaagcaatcatattgtgtcggtccttagattcagaggaagagacctatatagctggggagctctgatcaaggcagtgaaacgttgagcagctcaacccaggtcaccctctgtgttcatgttaaagctgggacaaggatgcaggtctagcctgaactagaagtcagctctatggtcttcccattcatgcagggaattctcctagtcagagttactttgaaatggcccttgatatctttatgccaccaaggagatccagaaatcctatgaaaagggtgatgtagctcaagccaaagatcttgtgtagctctatttgcgtagtcttggtataaagcagccttgaatctggaatatcagcatggaaggctgaagccgaggacagttccttgagttttatttgccagtctttttacagccatgattaatgactgcgaaactgccaaggctttcattcaagcaagtgagatgagccccttcaccaggtttgctatgtgccttaaaactcttcaaatatgttgaggtgggaaggagagaagaggaggattatgtcctgtcattgccagtggtggcccagggaaaggcaaaccattcgacaaaggcagccaggaaggggaattcatttctatcgctgagctgaaatcctgggcctggctgagggttcccatcagcaggttgaaatcagagggagaatgacctcctttcctgatgagatcgtgagtatctgtgatttgtgcatgtggttatacaccaggtcacctttcatcatcttttaaaagggaaccaggaatctttggggacttctctgtgctctgacattctgctagcaggaagtcaggagtcattagcatgaaaaatggcagcaaggacacaaatgcacatcaggggcagacagtgggctgagcaaacacattaatgttcaggggcaagggaggggtggcttgtcatggggaaggatcagcttccttttcctagaagttactcccaattactgctttacaagaagggaaactgtgcttgctttggcaagggctcctgcttgtgacttgagggttgcatcaattcattccaaattgtgttggtaaccaatgggagtcttgccttctggagaattacagctccttaaagacatcctagccagcaagtcaagcccaaggagtagcaggccaaggcccctagagtggatcattcacttaataatcaagtctttcctcctggttccttccatggctctccctcccctcagcctgtgcctctctatcaagcaaaaatctaaccatcaaaggaatgaaagggcaaaaagacttggaaaaaaatcagagaagggatcgactccaaaatgcaacataatgaggttccctgagcagacttcaaaaggtcagttgggctctggagccctgtgcgatgacctcccgatcaaattattccttcatagtcctgttagaatccaaaccgtgctcctgtgtgagatggaaaggtgttctggtggaggggggatgcccacccccacctctgactgctgcttgtaataattaggcttcgtaacacttaacacttggatttgatttcccagtgatgagcaagtgacagtggtgggccaagttcctgtgcacaggtgctctatttccaaccatttcttccttctgatttcccagctcttgaggccccagcctaacgcatggagaaagtatggcttttgatgccaataatcttggagatacttgttcctgagctgaaaaggaggttctcgcagggagatttttgtaggctccaaccataggagatgagctgagggagagatggggctataattattgcagatatcttgggaagctgctgtgctgctctccaggccctgagcaccagggactgatcaagatggagagaacatgtcaggtcagacgtttcaagccataccaggagccagccgactgcagcccacagccaaatccagcctgcctcctgtttttgttttactggatcacagccacacccattcatgtacttattgtctgtgactgctttcctgccacgattgcagaattgagtagctgtgacaggatcataagacctgcaaagcctagcacatttactgtctggccctttgctatcttaccaatccctggtccatagcatggttttcataaacctaaacatcatttattccccagaataaggtatccttggttttgaattaaataagatggcagaggcagctcagcattgcagttgcaggaaaactccactcatttgttgattcattcattcatgaaatgcctactgtgagatattactgctaccagtgacatcatctccaaagaggaatcctttattcctcttgctttaggaagagaataaagaggagcctttattccatctagaccaatgacctaatcttgaaaatggggaaactgaggcccagtgaagaaaaagtcttccagaccatacaatgagtttggcaatattgggactagaactcaggtctcccaggccagagtacttgaatcacagtagtcagccatattacttctcctgtgtcttctgcatttgattgtcaatagcagccagtggcctgggcaccatttgagggagcagtagttgactgtgtgatgcagcagtttctccccctgaagagcacgtctctggtttgttcttaagtgtggctgattatggtgattattcacgtaaattgcacctgtcactcctttgcacaatgtcagtccaagggtaatgcgagctccttgaaagaggaacccatttttttcagggtgattataaattaaatataaatgtaggcttaggatcctggtggacattcttccagggaattctttatcttgcatatatttgcaaagtaacctttgtaaaggttaggctactcttggaactgcaatacaactttgaagtttaaaaattccaagatattttgggaatgtaataatcccagttctctttcctctaagagtttccgtacaccctcactgacttactgtttaaggagtcaaaacgtgaactgtgctccatagtcaatccaggagctcactggaaaattgactcacattcatagcaatatgcagggatgtcttgggttcagaatgtggattagctagagtttccttcaactttcaataattaaatgtttatgatggttaagatttggcagatttggagagaaaaaaagaatccaaaggtagacttgaagggtggatatgcattgatagtaaatgagacagaatcccagggctatggcctggggactcccatctcctggaactcaacatgcagaaacaaaaccctatcaacttcaaaggtcagctctggtttctgcttcatatggcagaatcccatacttgattgcaaccttggatttagcctctctgagatccactgtcttcatcttaaaagatgtggaaattaagatctaagtcagcagttctcaaccgggagcaaccccatccccatatccctccccacccccagggacatttggcaaggtctggagacatttttcgttatcaaactagggtactactggcatctgagtgggtggaggccagggatgttgctaaacatcctgtaattcatagagcagaccccacaaggaattcttaaataaagaataatctcaacaagtcagaaatgacttgtcttacagaaaaggactagaccttgtttatccttgtgtctgtaccagacagtaccatacctgcacacaatggatgctcaagaaatatctgttgaacaaagaaacatgaacatttatgaatatatgaatgattgaatattatgcctgccttgtgagagtgctaaaatttttttttttgtcaaataaagtatctatgcacagtccctggctcagtgcccagcacatagtaggtattcagcgaatggcagctcatgatgatgccgataacatttacctgaatttgcttcatactcattttaaataagaattcacttgttttcatcctttgccaagataataggcagtctgtgcaggcagaaagcccagtggggcttttacaaatattagtttacaaagaatctttttcatcttgttattttccagataggtaagccaagggccacttggttgtgccttcatttccgctccctctggcaggctgttcctaggcagggttttgtttctctaaaattattgtttcattgctttgttgttctaaaggaacctgttggttaatattaatgcatttttatcttgggccatttccttcaggttcttttttccaatctgccatcatattttgcttcatcctttttaatatcagtgctgcttatgaagccctttcatgtacatattacccctgatcctccaaggaagcctgtggggtgttactatctttattggacaggtaaggaaactgaggctcaggacattaaatcacagctgaggagtggcctctgactctaccctgactctaccctattgcctcctcctaggatttgagaactagaagagattgagagacagagatcagaaaaggggagttgactgcccaaacccacgcatgaaatagtgcccaagtctctgatgcttccatcctatagtttttagctcttattttctttcccacctatacctgagaatcattttgcgattgagtttctcattcattcattcattccaggaggaggtatggcatgcctctgtactttgttgtgatgtcatgggaagacttctgggttggggttttgctctgctacttatcactgaaaagtgtttgcctaagttacttaattgccctgaacttcagattctcttatcagaagtggagatgacaacccttgccctatgtcacagagttgtcatgacggtcagttgagatcaaggtaatagcaaagggtttgtgaactggagtcttaagaggatttcgctacgttctcttctctcatccttttcccccaagtctagagctggcaaatatgaacacttcttttacactggcatacaactccacaataaaaatgatagtcatattgactaatatttattgagcccttaagactgtgaggccccccactaagcactaacatgtctggtctatgctatttctctcaacacctctatgctttagatatttttactatctccgtctgacagatggggcagtggaggcccagaaaagtgcagtttcttgttcaaggttgcatagctaatcatgggctaagccacgattggactcaaattcagttggattaaagagcccaaggtcttcattcattcactgattcatttattaagaacctcctagtgccaggcactgtgctaggcactgaatagccatgtggatacttcctgactctcctgcccccatccaggccagaactggggtggccaggacatcccttcctcccaaaggaggtgtggagacacgtgtgctcctgctggcctgcagacccatcagctgtgtcagctggagtcctgggaagaggatgacattgctgcttccagctgggaacagctgatcagcaccaagggagggccaggaggctttggctgagctgcatgaggaagtccaaccccagcagcagcacaagcacagcgattgtgcaccaaggccccgtgaagaccctggcccggggacgagtcccctcgtgcttcctgtgatgctgcctgccagagcctactgtttgggacttttgtccctcctggctcatcttcaggggtttccttgggacagagttacttcatggccaattgaaatctctgaaaaaacctgttggggctttcatagtgcaaacacaactgttgcctgtggacaaatattgacttttggtgctaactctctcacggacagccacccttgggagagccacgacgcgggcctttgagcacaagttgctcaaccaggtcaaagggagacagaagcaagaggagatgcttcttggatctcagatgaccctctcccaaatggacccccatggtttcagcaccaaggctgcctggagtttcagttttattgggagcagtgcagcagaactccaccatgactcctgtattagtttcctaggggttctgtaacaaagtaccacaaactggttggcttaaaacaacagaaatttattctttcatggttctggaggccagaagtccaaaatcaaggtgctggcagggccattccctcttcgaagcctctaggggagacccttccttgcctcttccgagcttctggtggttgctggtacccttggcattccttggtttatagatgcattgctccaccctctgcttccatcaccccatggccttctccctgtatgtattctgtgtctctgtgtccaatttttcctcttctaagaacaccagtcattggattaaggcctatcctaattcagtataaccttatcttaattcaaatatatctgcaaagaccctatttccaaacaaggtcacattcacatttactagcggttaggacttgaaaatatctttttaggggacagagttcaactgacaccacccaaggaattgttcttcccttaaggaaaggttatgtagtccccacctgcctccacccagcttccactttgccctgaagtcacacatctggccaggtcactccccttccatggtgtcccactgcctgaaggcagcatctagtctccttaatgtagccataaagtcccacgtggcctggccttgcttgcatctctgccctgactctgctactccccccttcccattccatgttgtgtccttggtgcttgaggttcactgggtcagctttggcctggctctatttcaggccttaccacatgctgctttctgctcagatggttcctctcttccctcttccactcggtagctcctactcaccacccctcacatctcaacctggaagtcatcttctatgaggaatgtttgctggccctctctgacaccatatgaggtgtctcggggcatcctgggcccccatgaactcacacatcacattgtatttcagttgtcttcttacccatctgtgcccctgacctggctgcaagtctcccagattagggtttatgtcctactccccctcaaatccccagtcctggcccatggctggcaaaaatgattgcttgttgaattgaagaactgaatgaatgcatgaatgaatgagaaaataggcaaaaattataactgtatcccagccaccttcctaattttgtgaaaattaaaggaaattcttctgccttcctgctcttgacaccctaccattgcattcaacccaagccaatactcagagaaatgatgctttagaaattgttagtgtgccagggtttggtcaggactgaggataaaccatgagggtagttcctggaggagtcttgatttgtcatcaggaatgtccagccttgggccatcagcactaacgatgaccaactgcggtacctgtggccgtcttttgagttttcagctccatttcctttctctataaaggtggaaggcacccaaaaatatggataaactcagctaatttcttctgctttggcacatgtagcttttgtgcatgattgaacacctcagcccactgaagaataaaaactgtaattcctctctctctctcttttttcattgtgtttagccaaaacaagctgtgaaagaatgtaaaatatatcattttgttggcacccgttcacaagtgagtcagtgagcttgctcacatttacaactaaaattggattttaaccttccaaaaatttatgacaactgctccttcttgtggcttaaatgttgacatataattaatttaggatttcttcccaagtcttcctgtccaggtttgtacctgccacagaaatatccttgaaagtttatctaacagctggagccatgaaaaaaaaaaaaaaaaaaaaccactggagctttgtaaaacagggtgggctatgccaacaggaagagcccaagagaaagtacgaggctgccaacgtggctggctgccagaggtgccccaggttggaggcagggaatttgcagttttggggaagcttggggttccttctaccactgttccttcctggccccagtgatgtgttctctctttactgtgcacacatcttttcatgaagatgaccaagcccatacataacctgggcatgaacaccccactgtggttatttctgcactcaggatcaagctggtcctattgcccagctctctgctgtatgggcgagtatagagggggagataataaggactacttctcattgcactcctgttatatgccagccattagtaagggactttataggcagagttcattttgttttatgttctcaaccacctggagaggttagagttactatcttcactttggagatgagaaaactgaggctcagagaggttaagtgacttacctgaagtcagcaaaatggaaaggggaaggagtaataggtagtctacacatacgaagctcctgttaggccctgtctccggctctcacttttagtgcttatggcagcaacaaattatctagtccaaaatgtcagtagtgctgaggttgaaaatcactgctgcagaagcatttggggctattcctggcacacagtcagcatttgataaatgtgtgttaccatcaatgaacttagttagctctcttcttcacctacttcaatatttattgcatgcccactgtgtggcaggaacacaagaaacacttcagtgagcaagacacacatagcctgtcctcatgaacgcagcctaggatgcagtcaggcattaatcagatcctaacacaaatgtctgatgccaagttgcccagaagcaggagtgcatatggggagaggggggagaaattgtcaagacggtgtttggcaagaggattggaccaggaagggaagtcaggaaggctcccctgaagaagtggtattgaagctgacatccaaggataagcagaaggtagccagataaaggatgatggggaaagtgcccaagtgagagggaacacctatgcaaaagctctgaaggaagacccagccatgtgcctcctccagcagtaggaatctctgttcatggattggcaccccggatcaggaatttcatacatctctgtagagttttgcaatatcactcaagggactagctcccaagcaagttctccgtagcaaagctgaggccactggtatatccatgggtcttccaggggactctgcagtcctgctgcattgggctttggcagtggcttcaagggtgcccccggaacccactggcattatgcctcaggtgaccactttgtcatgccccagtcccttggtctctggcccaggtctgcccaaaggcatttcctagccttcagtcctggatgccaacccagtcttagaggagttaagcctgaaccctgcctgccaggactttgggatttaatagggaaacttccagccagttcacatattatgaaaacacattttcctctctttaatcttcaaagtgaccagggacaaaagcagcacagaaattccctctcagggtacgtctacatctaagttggaaacatgtatgatagctggaagccccataacagatgggagaatgggcccatcttggaggcccattgttacagctctcccagttacacgtggagacatttacagagttcacttatatccctgagtgggagctggagatgggagaccaagggtttcagccctgggcccttgtgcttcatgcagacctacaagggcaggctttggcatgggatttaaatataagttcaaaccagagagtatgtctgctttttggcactgtgcaaatgtgactggcctcagattcccactgaaataacctctgcttgcttttctcaaactcctcattctttggaggggaatgttattgtttccctttaaggtggtctgttgggcaagggagggtgggaaggaaaggagaaaggaaggaaggattcctgtagttttcataaacaaagattgaagacaatataaaatccagactgaatctgcctttgtatctcatttaagaacccacttcactttcaactctgcagaccaaaacgaggtagcattcttcctgttcctttgtttgcaggtgaggattagggcccagagaggcagcatatcgttaaaaggcctgacttcacccagctggttgctggtttgtgtttatgtttcccttttcccttctcccctaccaaaaatggtcccctccccccagagaagactatttccttttgttgcggggaaactctgaattggtggttgcttagaaaacacatagaagtgtgtagcaagttgaagttaaaaaatagttcatgaaatgcaaaactccatttagcccctatctgccaagaaataaatagtttaaaaaatgaatttcagatcactgacaatgatgactgtgtttatggcagtggagttgtctgtcttcagcaggccatccttgcaggcatacacccagcatttagaaattaaacaaaaacacattgaacttgctgcattagctgttgccacattggaacgctaatgggtttagtgaccacaaccgacccaggccagcgtgtgtcaacagccaaaggagcaacctcagtcactgtttgtgctttgcccaagttgttacaagcttaattctttgcagcttacttttcctgctgttttggcttctcccccaccatgtcttagaaagtgtagccccagcccagcctcacatagcaaggccacggggtcctggcaagatgtctgaagatgcaggcacctcagcctctttggtctcatgagcagttacatcagggctctgcctacccccttcttttgccagtcacttctattaggcgttctggaaatggcccagcctgaagcaaatgcagacagcctcttgatgagctactcacctggaaaagtggagtctttctctctctcttcttctccaagaaagtatgctgcatagcatttcacctccaaggtggtttctttgcaccacaggcaagccttcagccctgcctgagaaacaaggtcaaatgcctccatttttgcacagctgaatcaagcactgggttgtaggatcttggcggtgaagaggttaaattgctcaaaaggctggatctgtggtttcctgcccacacttgctctggcctaaggcagtgcttgctgtgtggggagagggaaagggaggtctcgcctggacccaggtggccgacaggcaaaccatgttattaagaagcaggaatcgcaaaaccttgatcttcaaacgagacccctaattagtcaccagcccaagagtaaatggcattccacctcagtgaggcgggaagggcgccttcaaatcctggagactaattgccattattggctctatgaagatcctgttgtaaacacttgtcattggagccacttctggtcagtaaacttgagatatcaaattgttccttcatgtttcaaattctccagaatgcctctctctggctccttttctaggagggggcatctctttcccgaacatgacagctttcttaagatccagtttagggagatgtcttcctgtgacttgtatatgctatggcaggctcatcttaaaaccaagttcttttcagtaaagggctttttaacagtgttttactttattttcattggaatttgaaaatgccatctcaaaaataagataacagggcttattatcatgaagataatggagcttacgtttggagcacctcaggtaagctgacttttccaaggccctgggaggtgccccagtgaaatgttcacaaggccgtatctttttatcaagcttgaaatagtcaattatttatgtattctttttctgaaagaaggcctctaaaatggtacgaactttaggccacacaaaaccaagatgtgttccacagtattcaaggtgtgtttctccctttcctatcatgtgttcttgttgcttctggagataagtattttctctcttcttagatttttttttttttttttttgagacagagtctcactgtctcccaggctggagtgcagtggcacgatctcggctcactgcaacctcggcctcctgggttcaaacaattctcatgcctcaccctcctgagtagctgggattacaggcacctgccaccatgcccggctaatttttttatttttagtagagacagggtttcaccacgttggccaggctctcaggccatctgtcccccttgccctcccaaagtgctaggattacaggtgtgtgccactgcgcctggctgcctttttgtttcttgagcctgtttggcatttgtgaagggtacggtaaacttttccaggccacatacagggtgcaaggttttgtctaattttatccttttttttcctttttttttggagactgggtctcactctatcacccaggctggggtgcagtggcataatcatggctcactgcagccttgacctcctgggctcaatcaatcctcccaccttagcctaccaagtagctgggactacaggcacctgccaccacacctgggtaattttttgtatttcttgtaaagatgaggttttgtcgtgtttcccaggctggtttcgtcatgtttcccaggctggtttcaaactcctgggcaagcaatccacccacctcagtctcccaaagctctgggattacaggcatgaaccatgatgtccagcctaaatttacccttaactaggagaatgtttccagagattgggatcaagagatcctggatccatctgcttcaagggcagcctagataatatcaaacccagatggcagaagagatcaatataaggaagtttgggagccatgggaatttgatctggtcccagggtctcaggaccactggaattctattatctggacactttcatggtactaagtattaaatatgtcagcgtgtgagagagaaagggaagaagaaagtagtaaatcatttctgaatacttcttggaaatggtgagttttttcattcacctttaacaatgatttttagccagcatcaatgggccctgggatgaggtattccacattaacatccatagccagccatgtggcagggctacatttcagatgatgtcaagtatcccctttctcatggagctgagcttcagaactgtttcttcagcaagctcaggaatcactattactcagcaataattcctttgtgtgaacagtttagggcaggacagggagtgggagttctagacacaggcttaggatatttgttcataggataccattgtctctgtgatgaaagccacagttttccctctgcaggtaacctaataacctcaggcagctcagagagcagaggtaccggcgctacccaagtggggttctccaggatgactcggacatccccctctttccagagtgcaggtgttctgtttgttggatcagcccccatctctgatgtcagtagtggcacccgcaaagattcccaaagcattcttttaacctgtatgttacactgatttgagatgttagaaattgtattccaaacctttggttattttaactagttcagaaaagaaagactatcattagttttgacaacaaacaaaaccagtttttgttctatcggttgtgtttaaaagattccaatttcaaactaaacacaacgtgtggttattctgtcagcgatttatatagccaccagggcgccacagttacacactgcatacatcattgtatttttaaaatgtacttaatgaactttttttttcttttctagtaactacttcattgccttaaatgaatgcattccaatagaatttgtaacaaatgaccactttgtgtttgcattaatgccaaacacgtttaacaaatttttaacaaggaagcttggcaaaatgccaaactcctagagggacactgaaggaatgctataaatttaaactagatttcaccttttcacttaactcagcaagtgtcttaggtgtctcgctatctcaggattgtagcatttctgtttttatgtcagaaaagttgtacattttcattatttttattactgaggttgtacctacctatttccacaggacttttcaatctatgcaactgtttctgaaataatatgaaagcagcttagaaattaatctttatttctccaaaagtgttcatatcttatataggttggtagatgcatgtatgcatatactgtacatatctaccaacatatcactgcttaaaacagcacagtcaaccaattgtgtacagtaacaattgactaggccagtggttgtcaagtggagcaattttatctcccagggatatttggccatgtcctgagacatttttgattgcatgactgggagaggggcagtgctgctggcatctagtgggcagtggcttggcatgctgctaaacatcctaccatgcacagggcagcccccacagcaaagaatcatccagccccacatggccgtagtaccaagatggagaaaccttggagtagagtgacaaagacctttggccatgggcagtctctcctgttaaagaaggtattcttttgaggaaaaacaatcaaatacatttctactcaaccaatgctttaaaaagtgcatagagtacctaatgcttgtgttaaatggcagatatctgatcttttatttcactgctttctgcccttgagaagacaaaagcccaaaatgtagactagggtggtgctggggctggccggtggccagagtatatgcaagaccagccgactcgtgcctggttctgccagtggggagaaggccatggctgggcgctgggaaccatcttgcaggcaaggctgattgaaggcaaggagagcatatccaggagatagttttaggtgttctgtgaacaagcacttttactttaatagccatgcaattatcatagtgcatattagacagataatggttctattatggcagcaaaataaatatttctttaaaaaggaaacatttaggtttttgataattttttttttttttttttttttttgagacggagtcttactccgtcacccaggctggagtgtagtggcacaatcttggctcactgcaacctccacctccaccttcctggttcaagcgattctcctgccacagcttccctagtagctgggattacaggtgcccgccattacgcctggctaatttttgtatttttagtggagacggggtttcaccatgttggctaggctggtcttgaactcctggactcaagtgatccgcccgcctctgcctcccgaagtgctgaggttacaggcgtgagccattgcacccggccagtttttagataatttttaaaaaaatgttagttacatatcacaggtattgtggagaggttacaaaaatgggaaaagtaggacacaaaagacaggtttaggaaatgcttgcctcaaggaggcagtggtctctggagagaatggtcgctggagtccaaaagacctggattcaaatgaggccccagggagctggggaattttaccaaaagcatccagttcttctaagctttcgtttcctcatctgcatgaggggctattaaccaactgcatcagtacctcagtgctatcgagctggtttcagataattaatgcaaaacacagagggtggtggcagatagcacgcaacaaatggtacctgttaataattctgaccacaataataatgacaaaaataaatcctacggagacatagcagtctgtgctgccattttgatgtacacagcctatattcatttgaatcccttcatttaaaacgttatggatgagttataccccgtgcacagaaaccaaagttgaaataccaagtccctccactgcctcctcccagcaaactccgtcatccctaacagcagtgtgcaattctgagcacagggctggccccgccccacccccatcccagcccccagccctttgggttctgaagtgttacattttattgccccgtggagctgtaggagtccactctcaaggtaaaatgttgctctccactcatattttttgaattatggtttcaaggtggttgcttctatcaagaaaattaaatgatttaacataatttgttgccactttgatcacaacaataataaataaatcttcatgaggaaaacgggaaacccattccaccccgtttttaaagatgttaagtaataacacagatgtagttatagttttggttttttgtttgtttttttttttttagcagaaacgactctattgggttttcctgtgagcagagtggcttcatggagctgttctgcaggatgcccgctgcccccagaaggagcagctcttctcctccaaccgttgttaattagtctatcaggggcttgccttttatgtgggcaccacgtgcagcgtgttaggggcatctgaagccgtcgtgaatgggtgtctgtttttgtacctgggggcacactgcacacatttggaaagcacatggaacataatggacattaacccagatgtcaaaaatagcctgcgttttactactgttattaaacagtttcccctttaacccctccgtgtttaccaaagacccctttctcccagcctgtttctgcaaatcactactgaaagggcaggagaagaaagccataatcgggcaggtgtctttattccaaagaaaaacagtctgaaggaatatttgtgagacaccacacgtttatagcctgctctccctggggcgtctgtcctggggcggaatcttactgctgtgctcagtcacccaccccgcccctcacacacccccacctagaaccaagtcaagagcagcagtcccacccaatactggtttctccccacaaagaaaatagctttatattttagtatgatactatttatacattcttaggtttaaaaaaatccaaaaagagcaaaaaaaaaaaaagtctgaaggagaaaattttaacggctgggcaccatggctcatgcccgtagtcccagctacttgggaggctgaggcaggagaatcgcttgaaccagggagacagaggttgcagtgagccgagattgcgccactgcactccagcctggacaacagagagagactccatctcaaaataaataaataaataaaaattaaatacaggggaaaagtttaaaaccaccacccagagataaatattaataatattctaatgtatacacttgcaaatgtttgtttatgtgcatgttgatgcaaaaatgagatgaagctatgcatataaaatggtaatctgctttttccactgaaaagttgtggacggacatcttttcctatcaaaagaaaataaagattgacgtcataattgtcatcagtcacttaataaatcttaggcatccctatcacagttccccgttccttttcttcatggtgcaaatgtttacattctcattcatttattgatctgtgtgtctatttgtttctgtcttcctcccaagaatacaggctccatgaaagcatggaccttgtctgtttttctcactattatattcctggcatcaagcacactgcctgacccagcgtggtgctgcattagtcttctttggctacatagcaaattaccataaatatggtggtgaaaatagcacccatttattagcttacagttttgtgcataggtcagaagtccagatgggctcaactgggttctctgcttaggatctcataaagccaaagtcaaggtggacttagctggactttaatctgaaggctccaggaagcatccaccttcaagctccttcgggtttttggcagaattcatttcctcgtggttgtaggtctgtggtccctgttcccttgctgacagtcacctgggtgacattctcacatcctataggaagctctcaggtccttgcccctggctccctccatcacagcacagccaatccctctggtttcagatttccctaactttctcttctgctacagcaaataaaagtctctgctattaaagggcgtctgtcattaaattaggtccactcagatccacccttttttaaaaaattttattttttattttagacaaggtcttactcttgtctggagtggcacaatcacggctggagtggcacaatcccagcttactggattggcaggctggagtggcacaatcacggcttactgcagcctcgacctccccagttcagttgatcctcccacctcagcttctcaaatagctggtaccaaaggggcatccaccacacccagctaatttttaactttttttgtggagacgggtttttgccatgttgcccaggttggtctccaatttctgggctcaaaatatccacccacctcagcctcacaaagtgctaggattacaggcatgtgccacctcgcttagttgataatctccctttagactaatttgaagtcaactgattagtaactacatctgtaaggtaactttatagtaaacgtggtctgaaacgttctcactccctgtgccagggattcggatagggaatcttggataaggagtagatttaaggattctgcctacctgaggtactctctaaactggtaggctgggtttagtggctcattcctgtaatcccagcactttgggagcctgaggcaggtggatcacttgagcccaagagtttgagacgagcctgggcaacatagtgagaacacatctctgtaaaaaaatacaaaaattagccagacatggtggcatgtgcctgtagtcctagctccttgaggggctgagctaggaggattgcttgattccaggaggtcgaggctgctgtgagccatgatcacaccactgcactccagcctgggtgacacagcaagaccctgccttaaaataaaagatatgtatatatatatatacatacatgcacacacgctctattggatgtacaagtctagacaattcatcagaaggggactctgcagtatatgtgagacttcccactctatatcacatccgagagggtcaagaaaggcttcttgggaagacatgacatccaagctgaaactgaggaataaacagggatcgatcagataaagagctggtgtaaatcatgttagatagagagacacgcttgtgagagggggagaaaataaatttttagggctgcagaagcaagctcagctttggtggaacataaagagtggaatgtcagcgttaagtacaggactgcagagagagaggccagatggggcctcgccagtatggccaggagtccatcagtcctgcattctcagggcaacgggattataaacagggttgtaaacaggagttgtaaactgtaaacgggaatgcactatggactggatgtcaccattgaaatggcgctgttgttggctgctgcgttgaaagcgcagagttgggtgctgtaagaggaagctggagaagggtaagggccgctgtgactgtccaggtgagggaggactggccagggatcatctcacagtgggtggcagcccagattggctcattgctggaagccaggattcgttttttatttttatttttaaagcatatgcttctttgcccccccagaagggatcatctgcatttctaaatgctggcggtgtcacttgaggtttccttgttgtttttctttttttccttaaagccatttaggcctcctggtgaatggattgttcgattgaaagaatggctacactttttgagaattctcttgtctccagcataaaccttacccaaaagcagtttgctgcaattgtggggcattgtattctgccttgtgacctgctgcccagctggaaatctttctcacaactgaataaatgactgttctttgctactttatcttggaaaaacatcaaggacatcagacattcactgtaattatttttcatctgtaaaacaaaacaaaacaaaagactggtgcattttaatactacttagggtttctctttaccttttaatcatgtggccttttaatatattggtcagccctttaaaaggatgattaagaaatgcttaatgcacaaaagaattagagctatgcacagctcatgaaacagaaagcgtgctctgacttacaattttcatacaaagtttgcagagagtttatgtgccagaatgagtaatatgatctgctctaggaactccctaactttctggctctgcaaaagtcatttttttgccccgattcaagtttcttaaccagaagggttacaccaaagtcctcagagtatgaattagcagagttcatccaagccacatatttcatttgcactacttaacgatggcttgaaatagctggctacctgtgcagacactgggatctttggcattcttgttagtcggcgtgactcgaaaaatgctgcatatcaaccaccaaatgagacagctcaggatatatatacaaggtgacttgtgtgtacacgagtgtgtgtgtgtatgtttgatctttcctctccctgccatatttcccagatagctgagctcatgtggctggaaacccagaagcactcacaggccatatgtgaatgataatggcacaggcacacaaagttgagcatcagcagggaagaaagtcctcatctgaagcagtagtgtgggagggatcccccttctcactcattgcactattgcttcccaggatgcagttgtatccacactctgggcccctcactgggacagtgagaaaccttggggtgcttctggatacctgttccccagggcagtaaatagacaaatggatgactgtcacatttatgtttggttggtttttaagtgcatgctaagttctctgatatcttaaccacctttaattctttaatctccataaaatcaagttaaaaaataattttaaaaacatcatcattgtagaaaagcgtagagagaataaaagttgacatatagtccgattatgtggaaataatcactggaacattttggcatatttcccttcaatttccttttttgtatatcaagagacatttatacatatacgtgacatattttgaaagaggcctcttctcagatgcacttgcaggacgtagtttatctttctgtttcctttgtccttcctctgtgtttcttccccttaccccctccccactcccacccaaccccaaccattgagagtggtggagaggctgttgtaggggtgaagagtgggaaacgttctgccaggattatctcagatattgttgccagtttcttcccctgctaaattatgtgctttcttgttgcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaagtg

SEQ ID NO: 151 - DNA, 27646 bp, Homo sapiens
ctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggtaggtgctgagccggctgggcgccgcttccgtgtgacattgtggggccggtgacattgggtgtgcgcggggggcgggggcaccgggacccctgcgctccggggccaggcctgcgagacccggggagccggctgacccagccaatccatgtggtcgtggggccgcagggggcggcggggggtctgtggcgcacgttggcatggctttgtgtgcggagatccgcgaggttgtgggccagccctcagcatctccgcctgaccttgtgcggttgcatgtgcacagttgcatgtgcgtatgagagctgctggctctgtcaggccctggcagcgagtgtgtgggccccgtggtgtctgaaagtctgcgatcgcgtctgggtgtgtctgtgagagctcgtgttagtgcgtctggggttattgaggcccccctgcttccctggcagggtgcggataggtccacgttgtgggatggacaccagatgacctctctttctccttccaggcctggatggggggactccgcagtgtgtgtgtgtgtgtgtgtgtgtgtgtgtgtgtgtgtgtgtgtgtgtgcaggctccgcagtgtcgcagcctggggctgcagtgtgtgtgtgtgcagcccctcatgtaggggagcaggcatgggaggctgggaggaggagaggaacaggagagccacggtggggagactgagtgcacagctgagggtgtgcgtgtgcaactgtgtagtggggagcgtgcatgcctggctgtgtccttgcctctgtgtccgtgtgtccttgtctgtctgtgagtctctccagcagatgccgcctccctccctggctgaccacctgacccttgctgcagccctggattcctccctgtgtgtctggggcggggctgaagggagggggaatcaggagaggagggggtgggtgggggtaggtgggatgaagagggcgggagaggccagtggagggagaataggagggctggggagaaagatggcggataaaggctgatgggcccagggatggaggtgggggatggggctgcagatctgtggggtggggcagggtgggccggggggctgggaaggaggattgggttggggcaggactaggggagagaagggagaaaggggtagtcagtgatggctgtcaggtaagtgggatggagggagggaagctgtggatggattgggagaagactgatgctaaaagccctagagaaggaagttagagggaggtggtcttaggaaacggagtggggacgagaggagaaatgaaggcagcttagacatgggaaggaaagacagagacacatggaaagacagagatgctctgaaagagacagagaaagagacatggacatagagacaaagagacagagacaagcagagagacatggctgagacacatggagagacattgagagagaaaatgagaaactgaggctcagaggaagagacacaaggacagatatttcctatctagcggcaaccacagtcagcctgagggacaggaagaggaggcagagggcaaagggggaggtcaagggagggatggtcagagatgtgggccaggtcccctgcgagggggaagggaggccggcccaggcgcagaggctgcgggagctggcaccagatcagggagaggcggacagcatggaaaatggcaaggagctgcagaggcggccacagcgagacaggcatggtccccacccttggaggtgctcccaccccgcagcgcgcccatctgggcctcctgccttgactgggaaagcctcagctgtgcactccaacagatgggagcctgctccccaagggggtctggctgtgtcaagggcaagcaggagccaaggccagggccagggtgagccaggagtcccagggtcccggtccctcctccctcagaccaggagtccaggccccagcccctcctccctcagatccaggagtccaggccccagcccctcttccctcagaccaggagtccaggccccagcccctcctccctcagaccaggagtccaggccccagcccctcctccctcagatccaggagtccaggccccagcccctcctccctcagatccaggagtccaggccccagcccctcttccctcagaccaggaatccaggccccagcccctcctccctcagacccaggggtccaggcccagcccctcctccctcagacccaagggtccagccccagcccctcctccctcagacccaggagtccaggccctggcccctcctccctcagacccaggattccaggctcccagtccttcctccctcagacccaggggtccagacccctgcccctcctccctcagacccagggatccaggaccccagcctctctcagtatctgagagtccggcccagcccttagcatttatggggccccgagcatcagctcccagccttcaactaaggtttctgggtgggcagctgattttctccctctctctctcctgacccccatctcacccctctcctggcctcctgcacaggacttgaccccaggcctttgtagctccacatctctccatctctccatgtctctccatcctgggtctaccccatcgggcaaagctgagaccaccccggcactgtagggcagtaggaaagatggtctccccgtcccccaagcctctgtgcctccgcatctgagacgcagtgctgctgcagggctggcgtggggccaagcctccctcccaccccctgcaccccttcttgaggctcccagatctccaggctgctgcccctccctgcacacccccaccctccgactcagcctctgggtctgggggcagacagcaggcagctcaggccctctacaaggtcacgaggagattagcgctgagccgcgctgagcctccgatcccagcttggccctgggcctgcgggacctgtcagcggcccctgcagcacccagcctcgccccacccctcccaccagcctcggacactgccctccccatccgcccaggctcccaaactggaacttcagggactcacaccatgcgcagttcaagccaggactagggcttctgcctctaactctcctgctctgtcctccaggaacctggccatgcccagcctctgttaaggacgctccatgggcccaacacatggaagatcccagagagaggcagagacagagatagaggaaggtaccagagggagacagtgagagagacagagacagagagacatagacagagatagagaggcagattccagagacagagagaggagatctcagagagacagaaatagagaataagatcccagagagaaagtgagagaaagagacagagagagagaggaagatcccagagacagacagcgaaagagagaggaagatcctacaaaaagagacagatatatatatatatatatatggacagagagagagagaaagagagagagagattgaggagagcccagagagagacagtgggagaaagagagacagagaggaaaattccaggatgaggtagtaagagagagaaagagaatgagagatatatggggaaggagggggacggaagatttgagagagacagagagagggagagagagaaagagaatgagagatatatggggaaggagggggacggaagatttgagagagacagagagagggagagagagaaagagaatgagagatatatggggaaggagggggacggaagatttgagagagacagagagagggagagagagagagagaaagagaaagagaggagatcttagtgatagtgagagagaaagagagattcagagatagagaggagatcccagagagagagagtgggagagagacagagataggcagatcccagagagagatattagagagacagagagagagacagagagaggttgaaacaggaaaagagacaggtagggagagatgtgagcatcccagaggagacagcttgagagatgaagatagagacacaatgacagagagagacagaccgaaagacggaaaaagacagagacagaaagtactgatccttgagacgccaactcagagggaaataagaacccagagagacagaaactcagccagacctggggagacacagccaagagatggagacagacatcatgcaaggcagagagacaaagaaccagagatcagagagagacaaaatcatagaaagacacatgcagagagacccagagactgggatcaggatagagaatgacagagacaacataaagagatcagagcgatagagagagagagagagctatcaagagagagaaacagccttgcaaagacagagatacagagatggagagataaagagacaggagacagagagatgatgaaacaaagcaataagaccaagagccaaaaacagacctggagatacacatcaagggagacagacagaggagaaagagatggagatacacgtggagacatagaaaagacagatacgaggccgggcacggtggctcacgcctgtaatcccagcactttgggaggccgagacgggcggatcacgaggtcaggagattgcgaccatcctggctaacacagtgaaaccctgtctctactaaaaatacaaaaaaatgagccgggcgtagtggcgggcgcctgtagtcccagctactcgggaggctgaggcaggagaatggcgtgaacctgggaggcggagcttgcagtgagctgagatcatgccactgcactccagcctaggcgactaagcgagactccgtctcaaaaaaaaaaaaaaaaaaaagacagatatgtaggaaggttggacagggccagggagagggaagaagagacagaagcagagttaaaatgtcacatagaggtggggcacggtggcttattcctataatcccaacagtttgggaggctaaagcaggaggatcgcttgagtccaggagttagagaccagcctgggcagtgtagtgagaccccatttctagaaaaaaattaaaaattagccgggcgtggtggcacacacctgtagtcccagctacacaggaggcggaggcgggaggatcacctgagcctcagaagtcgaggctgcagtgagctgtgattgctgcactccagcctgggcatcagagtgagacattgtttcaaaaaacgaaaacaaagtcacatagacacagaacacaaaaggggagagccccgcaaagatgggcacagaaacagagagagactgaaacacaggcagaagccagacagggaccttcggggacagagactcagagacacacagaaccagagacagggaagctgattgcagcagatgagactcacgaggcctgagagtcaccagaggcagaagggaggtgaagtcacccagaggctccgggagacacagggagaccccgagaggcagacagagaccccccacccagagatgcaggggcaccggccaggaggatagctggggcatggagggccggtgtcctcctggaaccccttctcgcccgcagtctggtggctctgacagctatcgtatcgccacctcgcaggacaagaaagatgacaaggactcacccaagaagaacaagggcaaggagcgccgggacctggatgacctcaagaaggaggtggctatggtaagcctcgccctctgcccgcacaccctcccagagaacctcgccagttcttggctggcctaggcactcaccgtctcccccaaactcctgttcctcagacagagcacaagatgtcagtggaagaggtctgccggaaatacaacacagactgtgtgcaggtgtggccaggctgtgggctgggaccctgggaactagggaggaggagctgggggctaggacccctgggtctgagggaggaggggctgtggctggtgtcttaagttctgggggtctggtgaaggcctggggtgccagggttgcccagggagggttctgtgtgagtcctctgtccctcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacgtgagtgcctggaccctgccctgtgcaaggctctgcacatttatttacggacaccgcaccccaacttcttcccatccctctaagcttttcacagcccactctccccctttttcccatctaactcacaatcacccagcaagagaaccagatcaaatacaaggcaaactgaggctcagaaaagccaggctacttgtccaaggccccacagcaggatgtgtgagccggggctctgtcccaaggctgtgtgacctcagcggccttgagaacagacaccagcaggtggtcatggcttgacagatacccagagtgagtgtcacatagagacccaggcacaccccgctgctgatacatcagggcccatccccataacacagggacacattcgagatgcagcctcagatcccatgcgcataacacagaccacacaccagccacacagagctgctcacctgggtaggcgtgtgtgcacacacacgcatgtgcacggagggtcaacgcagatgccacaccaggatgtggtttcaaacatggccacctaattcagaaacacagacacagactcagatatacactgacagagaaactcacacacacactgacacgcacacacacacacagcaatgcaggcataacctggtgacagagagacatgagagtcaggcacagagagtgtcctcagatgttcaaatctaaacagtcttagacataagctctcacagagaggcagagctggagacacagagacagagatccacacacagagaaccaaagaagctgccttgtagaatgtaaagtcaggcatgcagccagtcagacagacacatggacagacagccgcatcccagactcaacatgtgcaggaggacagacacacacacaaaacagatggacaagtcgggcatggtggctcacgcctgtcatcccagcaccttgggaggccaaggcaggagggtaacttgagaccaggagttccagtagcctgagtaacatacccagacagacccagcctctaaaaaaacacaaaacatagccgggcctggtggcgcacacctgtagtcctagctactccggaggctgaggagggaggattgcttgaatctgggaggttgaggctacagtgaactgagattgtgccactgtactccatcctaggcagcagagcgagaccctgtctcaaaaaaaaaaaaaaaaaaaaatgccaggaaagatggctcacacctgtaatcccagcactttgggaggccaaggtgatagatcacaaggtcaggagatcaagaccatcctagccaacatggtgaagccccatctctactaaaaatacacaaaattagccaggtgtggtggcatgcacctgtagtcccagctactcaggaggctgaggcaggaggatcgcttgaaccaggaggcggagattgcagtgagccaagatcatgccattgcactccagcctgggcgacagagtgagactctgtctcaaaaaaaaaatcgacagacccttagattcaaacacaaccattacagaaagagggactcaagcacaaacaggggagactcagacacaccaaccctcataaccaacctagggtcagacacacaaatacagacccccactgacacaaagctcccttcccagactccaggcgagcagggactggtggagagtggcttgggcggcccctgatcaacatccccacatctccccacagctgtacctgggcatcgtgctggcggccgtggtgatcatcactggctgcttctcctactaccaggaggccaagagctccaagatcatggagtccttcaagaacatggtgccccaggtgaagggtgcccagcaaggggccagacgggggtgttagtgtatgggctgggggccgggcccagtgacccccaggcagagggagtctgggaggtgacattactccatcccacctcagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtgggcctgggcctagggcccggctttaccctccctcgggctgcccaggagctcaggcccagcccctcctccctcacactcaggagtccaggtcccaacccctcctccctcagacccaggagtccaggcccccaggccctcctccctcagacccaggagtttaggccctgggccacctcctcacccaacagtcaggagtccaggcccagccctcacctttcggagatccttagggaccctagaccttggccagcagcactgtgccttccccaccttcaagatcccagcctctggcctcccacacaccactcacccactgggcacccaggcttctagctgtgatctccaggcacacaggcttcagccccaagccctgtacacaaataccctcctgtcccaggccctggactgaaccctctctctgctgcacctacccccaggtggacaactcctccctgactggcgaatccgagccccagactcgctctcccgactgcactcacgacaaccccttggagactcggaacatcaccttcttttccaccaactgtgtggaaggtgaggcgggtgcagagaagacacacagctggggcagacacagggatgtgtcccagggggtcaggcctccagaacctccctgagccaccccacctcagcctaacccctctggcctgcaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtaaggccaggctcctgggtctgggtggggagggcctgggggtctgggctcctgggtctgagggaggaggggctgggatcctggacccctgagtctgagggaggaggggctagaggcctggacccgtgtgtctgggggaggaggggctgggatctggacccctgggtccggagaaggggctgggggcctggatcacagtattcttgtgaaagacaacttgggcctgactcagagggcctcattaacaaagcaaacaatcaaagaaagaaacaaacaaaaatcttgagaaacactggcaagccgtaaagagccaacaatcctattgcaaaattaagaagtgcacgctcatgatgaaaagttgaagagtacatcaagttaaaaaataaaataatgaggctgggtgcactggctcacgctgtaatcccagcactttggggggccaaggcgggcagatcagctgaggtcaggagttcaagactagcctggccaacatggtgaaaccctgtctctactgaaaatacaaaattagtggggcgtggtggcacatgcctgtaatcccagctactcaggaggctgaggcaggagaatcgcttgaacctgggaggcggaggttgcagtgagccaagatcacgccattgcactccagcctgggtgacaagagtgaaactccatctcaaaaataaataaataaataaataaaataaaataataagcctggcgcagtggctcacgcctttaatcccaacagtttgggaggctgaggcaggaggactgcttgaggtcaggagtttgagacaagcctggacaacatagtaagaacccatctctaccaaaaaatgtgaaggctgggcgcagtggctcatgcctgtagtcccaagactttgggaggccgaggcgggtggatcacctgaggtcaggagttcgagaccagactggccaacatggcaaaaccccatctctactaaaagtataaaaattagccaggcgtggtgatgggtgcctggaatcccagctactcaggaggctgagacaggagaatagcttgagcctaggaggcagagcttgcagtgagccgagatcgtgccacctcactccagcctgggcgacaaaagcgagattctgtctcaaaaaaaaaaaaaaaaaaaaaaaaatttttttaaattagccaggcgtggtggtacatgtctgtagttccagctatttgggaggctgacccgggaggttgaggctgtagtgggccatgattgaaccactgcactctagcctgtgtgacagagggagactccatctcaagaaaataataataataataattattataataataataattattattattatttttaaaaattttttctctggctgctttgctgccagcttcaccccagaagtccattctctgtgaggttccgcctgacagctgtgagcatattgactaaatgctgtcttcaaggtgcatggcagggactatcttagaaataccattctcctctttcattctttgacttaatgttttatgtgaagttttccatattagggccgggcagggtggctcacgcctgtaatcccagcactttgggaatccgaggtgggtggatcacttgaggtcaggagttcaagaccagcctggccaacatggcaaaaccccatctctactaaaaatacaaaaattagccaggcgtgatggtgggcgcctgtaatcccagctacttgggaggctgaggcacaagaattgcttgaacctgggaggtggaggttgcagtgagctgagatcgagccactgcactccagcctggacgacagagcaagactgtgtctcaaaaaaaaaaaaagtttactgttttccatattagcaatgttgaatgctaccctatgtcaaatggatttttatacgcaaaggattaagcatattgtgagcacatagtctgatgatttggggcaaactgaacagaatcacgtcagctgcaacgagactgcgtctccctgaagccccctcaagaccttatttagcccctgccccccaacccaagggtaacccctgatctggctgctaacagcatagattaactttgcctgtgttcaaacttcctattaacggaataattcagtatgaactcatttctggctctttttggctgaacatgtttttgacgttcacccatgcaggtgcaggcagcagtaatgtatttgtttttatcaatgttagtattccattgtccacaatttatcttttctgctgttagtggacatttgagtagtttgcagttttggacaattttttttttttttgagttggagtctcactctgttgcccaggctggagtgcagtgtcacgatttcggatcactgcaacctccacctcctgggttcaaggggttctcgtgcctcagcttcccaagtagctgggatgacaggagtgtaccatcatgccctgctaatttctgtatttttagtagggatggggtttcaccatgttagccaggctggtctcgaactcctgatctcaagtgatgcgcctacctcggcctcccaaagtgctgggattacaggcgtgagccactgcacctggctgttttgcactattatgcatgtggctgctatgagcattctagtccctgtctttgggtgtctctgccctgtttctattggtctgaattgggggtggcattgctgggtgctgcctcattcttttccaggccctcaggattctctgggggctgggcagctgggctgtggccctcgtgtcgctcatccaaccctgctgccgggcttgtccctgtaacttgcctgcccttgctcgtcctccaggtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcaggtgagcgcaggccccgggtgaggaccatgggggcctggctccaggagtccctggccctcacacatgcctcccccagggacctcatttgacaagagttcgcacacctgggtggccctgtctcacatcgctgggctctgcaatcgcgctgtcttcaagggtggtcaggacaacatccctgtgctcaaggtgggttcagctactggcctcacctcggccctgcctgtgtcctcccctcagctgtccctgttctgacaaccctttctccttgcagagggatgtggctggggatgcgtctgagtctgccctgctcaagtgcatcgagctgtcctctggctccgtgaagctgatgcgtgaacgcaacaagaaagtggctgagattcccttcaattccaccaacaaataccaggtactctgggctttccgggagagccagcctggacctcaggttccttatgacgcctgtaaagaggtgtcatagagccttgattttcccgtctgtaaaatgggaatgataatacccgcctggtggggagaggaacagggagagcttgagagtgggagccggatctctgttggagtgagacgctgaggagtaaagatcttcctgcaggccaggcgcggtggctcacacctttaacaccagaactttgggaggctgaggtggggggatcacttgaggccaggagttcgagacgagcctgggcaagatggcaaaaccccatctgtacgaaattttttttttaattagccaggtgtggtggtatgtgcctgtggtctcagcgatttgggagtctgaggcaggaggattgcctgagccggggaggttggggctgcagagagcctacatcacgcactgtactccagcctgggtgacagagcaagaccctgactcaaaaaaaaaaaaaaagttttcctacagcagagagtgggaacaagcaggagacctcttggggcagagcagcaactttaaattattcagcaaactttttttttttttgagacagagtttcgctctgtcacccaggctggagtgcagtggcgcgatctcagctcactgcaagctccacctcccgggttcacaccattctcctgcctcagcctccagaatagctgggactacaggcgcccgccaccatgcccagctaattttttgtatttttagtagagacggggtttcaccgtgttagccaggatggtctcgatctcctgacctcgtgatctgcccgcctcagcctcccaaagtgctgggattacaggcatgagccaccgcgcccggcctcagtaaacttttttttgagatggagtcttgctctgtcgcccaggctaaaaggcagtggtgtgatcttggctcactgcaacctctgtctctgggttcaagtgattctcatatctcagcctcccgagtagctggaattagaggcgtgcaccaccacacccagctagtttttgtatttttagtattgatggggtttcatcatgttggccaggctggtcttgaactcctgacctcaagtgatccacccacctcggcctcccaaagtgctgggattacaggcataagccatcatgcccggcccattcagtatacattttttgaccagccaccacatgttaggccctgttttgggtgctgggtgtacacacagtagtgagtgacatggtgaagtcacccctctctgagacttacgctctggttctagaagacagacaataacaaaggcatgaggaggtaatcgtagtggttgtggtgctgagggagggaaccctgcaggtgtctgggggaagagcgctccggtagcaggcacagcctgtgcaaaggcccagaggcgggagtgtgctgacgcatctgaacaccagccagccagccagtgcagaggggctgggagccagggagcgtggtgggggtggtgggtgctggccagatcctgtcaggccccacgggcatggagaggacttggctgtgactctgaggagcacacaagcctccagggggctctcagccaaagagagacaggagttgactcagagcttttaaaataactttattaagatataattaacataccatagctcgtccctctaagtgtataatttaatagttttagtatattcgcagatataggcagccatccacatagtcaattttagagcattttcatcacctccaaaaagaaaccccacatctctcagctgtcacccgccccctcctccccgacactcccagccctaagcaaccactaacctactttctgtccgtatggttttgcctattctggacatttcataaaaatggaagcatacagctgggtgtggtggctcacgcctgtaatcccagcactttgggagaccgaggcaggaggatcgcttgaactcaggagatggagaccagcgtgggcaacatagggagagcatgtctctataaaaaattagccaggcatggtggtgtggacctgtggtcccagctacgtgggagaccgaagcgggaggatcgcatgagcctgggagatcaaggctgcagtgagctgtgatctcgccactgttctccagcctgggtgacagagtgagaccctgtcttaaaaaaaaaaaacagggtgggaggaggggagcacagacgtggtggcttatgcctgttatcccagcactttgagaggccgatgagggcagatcacttgaggccaggagttcaagaccagcctggccaacatggcaaaatcccgtctctactaaaaatacaaaagttagctgggtgtggtggtggtgcctgtaatcccaagctactccggaggctgaggcaggagaattgcttgaacccaggaggtggaggttgcagtgagctgagatcgtgccactgcactccagcctgggcaacagagcgagactctgtctcaaaaaaaaaagaaaaaagaaaaaaagaaaaagaaaaagaaatatatatccatgacatagacagagcggacaggaatgagcagaggtctctgtgagagagtgtgggggagccctggtgtgggcctatcctggcacccgtggctctggacaggggacaggatggggcagggagcttcctggtgtctgcgtggctcaggcacgccaccctctgatcggtccccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtgcgaggctgccgggcgggctctggggtccctggagggcaaggagggttgtgatgctgcccaaagcctgtctcagcccagggcctcccagaatatactgtaaatgaatgaatgaatgaatgaatggatggatgagaggggaaggtatcctaggaaatgaatgctgactggccgtcttgctgatggggagatggaatgcgggcgatgcagacatctaggggcatggggcggaggttccgaggctgggaccctcacaccccaacccttccctgccactaggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtgtggcttggggtggctgggggaggcaaagccaggcgtggggcgggagaggccatccctaaaaaacaatgcctgcaggtcatcatggtcaccggcgatcaccccatcacggccaaggccattgccaagggtgtgggcatcatctctgagggcaacgagactgtggaggacatcgccgcccggctcaacattcccgtcagccaggttaacccccggtgagccacccatcccagccagggccctggacatccctctagggtgttgacacagggggaccgcttccccccaacctccctctgcactgcctgtcccattctttctgggactcctccatggaccaggccctgggtctggccctccctccggtgtggggacattgcagccacagaggtagccaggcataggtttgcatcccagcctttattttattttatttatttatttatgtttttgagatggagtcttgctctgtcgcccaggctggagtgcagtggggcaacctcagctcactgcagcctccgcctcccgggttcaagcaattatctgcctcagcctcttgagtagctgggattacaggggccctccaccatgccccgctaattttttttttttttttttgtatttttagtagagacgggggtttcactatgttggccaggctggtctcgaactcctgacctcaggtggtccacctgccttggcctcccaaagtgctgggattacaggcgtgagccactgcgcccggcctgcattccagcttataccgctcacaagctgtgtgacattgggcaagtcctttagcatccatgaacttcagtttgcccatctctaaaatgggctactaataattcctatctcagaggattcagtagaatccagtacttctgtgtctgtctctcttttttcctgtctgtctgtcattgtctctcttttctgttctgtttttctgacttcttcaactttcccatcctcatacctatctctgactctgccttccttcagcttgtccatttatctccgttcctctgaatccactgtgtcttggctgggcgcagtggctcacgcctgtaatcccagcattttgggaggccgaggtgggtggatcacttgaggtcaggagttcgagagcagcctggccaacatggcaaaaccccatctgcactaaaaattaaaaaaaaattagccaggcgtggtggtgggcacctgtaatcctatctactagggaggctgagacaggaaaatcacttgaacccaagaagcaaaggttgcagtgagccgagattgcgccactgcactccagcttgggtgacagagcgagactccatctcaaaaataaataaataaataataaataaataaataaataaatccactgccccaaagtccttcctcaggtctgcccgcacgccctgctgcagtagcccccttctcccctgcttctcccagaggcctcttcccccagcccctggtcctctggctctcctggttgtggggctggcccctctgtttctctgtctttcagggatcactttgccactcctcacacaccctgacctcagccatcgctctctctgctcttcccagggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacaggtgggctgcgctcccgcagaggaggggacggggccttgactcctgggtcctcactgaggccggggcctggtttcctgggtctgagggaggaggggctgggggtctggacccctgggtctgagagaggagggtctgggggcctggactcctgggtctgagggaggagggggctggggacctggacccttgggtctgagggagggggcctggacttctgggtatgagggaagaggggataggggcctgaactcctgggtctgagggaggagggggtgggggcctggacccttgggtctgagggaggaggggctgggggcctggacccctgggtctgagggaggagggtctgggggcctggactgctgagtctgagggagaaggaggctgggggcctggacctctgggtctgagggaggagggtctgggggtctggacccctgggtctgagggaggaaggtctggaggcctgaactcctaggtctgaggggaagaggaggttggggacctgaacttctaggtctgaaggaggagggggctggggtcctgggcttctggatctgagggaggggactctggggactggcctctgggtgtcatccttaccctctctccctccagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggtgagttggccaggggtggccctggagaccagggtcactaccggaggcctgagaccagcaaggggaactggccagggctgcagggggatgtgtggcagagaccacaggccccctggccctggaggagcctgagcctgtccttttctgtcttcctcccctgtggggtcgggagctcccctgggcaggactgagctgacacacttcagggtccctgcgtcatccagcccaggccccatctggtgggtgaagctgacttggaggctttttaaagatattctcagccaggggcggcagccacgcctgtaatcccagcactttggaaggctgaagcaggcagatcatgaggtcagaagatcgagaccatcctggctaacatggtgaaaccccgtctctactaaaaatacaaaaaattagccgggcattgtggcggttgcctgtagtcccagctactcgggaggctgaggcaggagaattgcttgaacccaggaggtggaggttgcagtgagctgagattgcgccacagcactccagcctgggggacagagcgagactccgtctcaaaaaaaaaaaaaaattctcaagcccaaccagggggaagccagggaccctgggggataccccctctgccagcctgggctgggggtcaagggagcttcccagagtggacagggatggctgagccaagtcaggggccatgctgtgacgtccacatagactagtgccagggagtcgcaggcagaggaaccggtacacaggcaaggcggtgtgaggggctgggtctgaggctggtgctgctgagccgacaggcaccacctcctgacaggcccagacaaggccacagaagggttggttcacattcagatttattttgatcatcaaattaattcatgataatcatagacaaatgcagaaaagcattcaggaaaaaagtagaatcacccgtaacctcgccatccagaaataatcacggttcatgccttggtggattttcttccaatttctctctcctatttgaaatgtctctggtgtaaaaagtagttcatggtaaaagagaattcaaacggcaaagccgagcccagagtaacagattaaatgtcctcagcccttgtctcctatatcccagaggaaaccatggttaacaccttcttatctcccaagagacatctttttttgggggctgggggcggggatagagtctcaatctgtcacccaggatggagtgcagtggcacaatcacggctaactgcagcctccacctccgggacttaatcgatcctcctgcctcaggcccctaagtagctgagactacaggtatgcaccatcacacctggctgatttttaagattttgtagagatggggtttcgccatgttgcccagactagtctttctttttttttgagacagagtcttgctctgtcacccaggctggagtacaggcatgcaatctcggcttactgtagcctccacctcctgggttcaagcaattctcctgcttcagcctcccgagtagctagaattacaggtgcatgccaccacaccaggctaatttttgtatttttagtagagatggggtttcaccatgttagccaggctggtcttgatctcctgacctgaagtgatccccgcaccttggcctcccaaagtgctgggattgcaggggtgagccacctcgcccagcgaggtcttcaactcctgggctcaagcaatcctcccaccttggcctcccaatttgctgggattacaggcatgagccaccacgcctggcctccccaagacatctatgcatacacagtacacacactgtctcagatacagccgtctgctccttccgaatcttgtgcatcatgctggaagcctgggaggcagctgtgagcagagcagacaccatccctgttctcacagggctggagagacagccttaaacaagttaacagatatgtaattacaaattgtgatatatgccccgaagaaagcaggccgctgtgatagataatagtgagggtcctgcccagatggggtggacagggaaggcctctctgaagtgagggaagaaatacctaacttccgtcaggggccaggcacgggggctcacgcctgtaatcccagcactttgggagaccaaggcgggaggatcgcttgagcccaggagttcaagacctgcctgtacaacaaattaagacctcaaagatcaaaaaattttaaaaattagcagggcgtggtgttgcacacctgtagtctcagagacttggggggctgaggcaggaggatcacttgagcctgggtggtcgaggctgccatgaaccatgatggtgccactgcactccagcctgggatagagcgagatccgagaccctgtctcaaacaaacaaacaaaataacttccaacgggggcattccagatatacccaaaagtaaagcaaaggcacagtgggcccctgcgcctccatcccacctgcagcggcagtcagcgcacggcacaccttgtttcttccccaccacctggaacacacactggattatgctgatgcacatttgtcaccatttcatccataaatagtttaggatgagaaacccctagtttgtggagaagagcacaatgcagggaacgagaatatcaggtgggagcggcccaggcccttattgctatgcaagagacatcaaagcaatcaaagaagccacaccacaggcagcctgcttcaccttcccttccctccctccctcccttcctccctccctccgtccctgcctgcctgccttccttccttctttccttccttccttccttccttccttccttccttccttccttccttccttccttccccttccttccttccttccccctcccctcccctcccctttttttgatggagtcttgctctgttgccaggctggagtgcagtggcgtgatgttggctcactgcaacctccacctcccagcttcaagcgattcttctgcctcagcttcccacatagctggaactacaggcacacaccaccactcccagctaattttttgtgttttagtagagatggggtttcaccatgttggccaggatagtctcgatctcctgacctcgtgatccacccgcctcagcctcccaaagtgctgggattacaggtgtttgccaccgtgcccgcctgttctttcttaatgattgacctcattgttcatgggctaatctttttacttatttatttatttagagacaaggtctcactctgttgcccaggctggagcgcagtgctgcaatcatcagtcactgcaacctcgacctcctcaagtgatcctcccacctcagcctcccaagtagctgcgaccacaggctcgagccaccgtgcctgactaatgtttattttattttattttatttttttgagatggagtcttgctctgttgcccaggctggagtgcaatggcacaattgcggctcactgcaacgtctgcctctgaggttcaaatgattctcctgcctcagcctcccaagtagctggggttacaggtgcccaccaccacgcccagctaatttttgtatttttagtagagatggggtttcatcatgttggccaggctggtcttgaactcttgatctcaggcaatcctcctgcttcggtctcccaaagtgttgggattacaggtgtgagccccagcgcctggcctggattaatctttattttgtttactttagacaacctgtactggttgaatatttattgagatatggcatgcatacagtgagttgggcatattatatctcattaaaatattcaaccagacagggtgtataaatttttacacatgtacacagccatgcaaccaccagaccccagtcaagatagaaaaccattccagccccccatttaggttttgtctgctctcttccagtctatatccctcctcctagacataaccattatcctgacttttagcccagagacgggtgctgagcctgctccagttggagttggatgctaagaatgcttttgtgtctggctcgtgtcactcagcacgggatccaaggtccagctgtggagttgtgtccgtagctcgccccttcttgctgtgtagtatttgactgcatggatgtaccgtggtttattcatccctcacctgttgatggacatggggttgactctggcttttggctctgatgagtggtgctatggtgaacattctcgtacttgcttttcgctgggcataaacagtcctcctctcttttgggtataaaacctaggagtcggattactcggtcggtggggtgggggatgtttgatagcaactccgaaaccatcttccaaagtggttatttcaagaatgtttccacaaaggcgatgtggttggatgtttatgtggaaaggtaggtgggtgaggggccaggtgtggagacttatgcctgtaatcccagcacttcgggaggctgagatggaatcacagcccagaaattagacaagcctaggaaaagtggtgagactctgtctctactaaaaatacaaaaattagctggacgtggtggcgcgtgactgtagtctcagctacatgggaggctgaggcaggaggatcacttgagcctgggagtcgaggttgcagtgagccgtgatcatgccactgcactgcagcctgggcaacagagtgagaccctgtcccaaaaagaaaataatggtgggtgggctggggggtagaaaaggacgctggacaggccgggcgcggtggctcacgcctgtaatcccagcacttcaggaggccgaggagggcagatcacgaggtcaggagattgagaccatgcaggctaacacagtgaaaccccgtctctaataaaaatacaaaaaaattagccgggcgtggtggcaggtgcctgtagtgccagctactcgggaggctgaggcaggagaatggcgtgaacccgggaggcggagcctgcagtgagccgagatcgcaccactgcactccagcctgggcaacacagcgagactctgtctcaaaaaaaaaaaaaaaaaaaaaaaggacgttggatgagggcagaggaggggcagagggagtggggctccctggcatgggcgcctgctctgagcctgcctgtgccacaggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtgagccctggcagccacccttggggcccaggagggtggagtcctcccctctccggctcacccggcctcctccgcctaggtccctgccatctcactggcgtacgaggctgccgaaagcgacatcatgaagagacagcccaggaacccgcggacggacaaattggtcaatgagagactcatcagcatggcctacgggcagattggtgaggcaccggggactccatctccttaccacccagtgccgggcctagagcagtgcctggcccaccgtgggtgcttgggaccctggcattgactcaggggagcagacgtgggcaggaccaaccagtgagctatctgtggggggggtctgcaccccatccttctccacctcctcctctctgctgttgatgtgtgcggatccccagaggagtggagcagccacccttgggggctgtcccagcaagcagagacttcatggcagtggttccaggcccagggaggtcattcctgcgtagggagctcaagctggggatcccccaagaattcatgatgtttaggtggcctaggtcaggtgagagaggggctccaggttatccctctgggagagccctctctccaaagcccctgtcccaggtggcccacccatctcagggcctcaccaccaagtgagacctcaggtcaccctctgggaaccaatgtccagataacagggccaggagggcatactcccctctccaaggaggcctccgggccctctgaggtgccctgggttggctgctggccccaatctgagcctctcctcggcttcctctctcctccttccaggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtgggtgagtagggcagggtgctgtgtctctgcccaccgtaagatccccggggtgagctgttccagccatgcatggccacttcctacgatggccccctcagtctcccatggcagcatcaaggcctttgctgggcacctggggcttcctggatgcccttggcccagcccatctggagccttgtgtcccactgctggagctctctgccctgccaggccttcttccccacctctgtctgtcccttcaaagcccagttgctgtctgtcctccttgggaggcccacagggtccttatcctcctccctggcccctggtggatggtgagatcaccattaacctttcttcttccttgtacgtctcctgactcctccctcgggactatgagcccgcagaaggaagacacacctgaggccctgaggaccccatgcaggatggggcggggcaaagagcaccggaacgtcggggtggcggctagggctgcagtgccactaactgacgtcccgtgccctggtcaccgctcctgcagacatacgagcagaggaaggtggtggagttcacctgccacacggccttctttgtgagcatcgttgtcgtccagtgggccgatctgatcatctgcaagacccggaggaactcggtcttccagcagggcatgaagtgagggccgggggcacatggtgactggacagccatctgtcctgtccgagtgtctgtctgtctgtgtacttcctcttgtgtccttgctttggttttttgttgttttgttgaggcagggtctcactctgtcacccagactggagttcagtggtgtaatcatagctcactgcagcctcgacctcctgggctcaagtgacccacccacctcagcctcctgagtagctgagactacaggtgtgcaccatcatatatggctaatttttatttatttatttagagacagagtcttgctctgttgcccaggctggagtgcagtggcacaatcttggctcactgcaacctccgcctcccgggttcaagcgattctcatgcctcagcctcccaagtagctgggattacaggtacgcaccaccaggctcggctaatttttcgtatttttagtagagtttcaccatgttgcccaggctggtctcaaactcctgagctcaggcaatcttcctgcctcagcctcccagagtgctaggattacaggtgtgagccaccatgcccagcccattttgggttttgccactgcactgattttctctcaaggggtcctgtgtgtcctagattctctctcagcctctgtgtgtgtggtggaggtgcccctggccttttctttttataccagtgcctctctgtgtctgtccctgtctctgtgtctgtttctgtccctgtctctgtgtctgtccctgtgtctgtctctctgtctgtccctgtctgtctctgtgtctgtccctgtctctgtgtctgtccctgtcttttgtctctttctgtgtcaccatcgctctgcctctatctttgtctctctctgtcggggcatgtctccccatctctgtctctccctatgtctctgcctctctgtctctgtgtctgtgctgctgtctctgggtgtctgcactgtgcctccccctgtctctgcggggtggcaggtgcagggtgggtgctctctgggcccagccctgcccttctgtgcctccaggaacaagatcctgatcttcgggctgtttgaggagacggccctggctgccttcctgtcctactgccccggcatggacgtggccctgcgcatgtaccctctcaagtgagtgccccgctgcccccagccctgcccacaccagcgcctgccatggagccttcccttagactcagcctgaacctcaggccccacctcccctggtgtccccactgcagtccccattctgatgcccccgagcctcccccataggctgctcccaccacggattactccgaagaccccaggccccagccccgcccagggcaccctccacctgtgagcacgaaggatcctgggagactgcccctctgcgtcccctccagtcccctgaaactctgcctctcgttagggccccgcactcaagccctcctgctctcccctctgcaggcccagctggtggttctgtgccttcccctacagtttcctcatcttcgtctacgacgaaatccgcaaactcatcctgcgcaggaacccagggggtgagggagctcggcaaggcagccgaggggggcggggggcagcagggtctcaggcagctggtcccaggctcccctcgccctgctggatggctctgccacctggttcccactcttctctctcttcccatctctccgggcacccactctgtcttctcacgggtctctgtctgtgtggtttccttgtctctctccctctctgtccctctctctgctgggcggctcgccttgcctgtctctctccatctcttactctgtctctttctttccttctttgtctctccaggttgggtggagaaggaaacctactactgacctcagccccaccacatcgcccatctcttccccgtcccccaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 152 - DNA, 22706 bp, Homo sapiens
cctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaacagacctgagtcaggcactgggtttgaatgcagtttgagaatttcccacatattcagtcattttttttaatgtttaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttgactttttaagaaatcctgaaagcataactttcaggataaggtaatgtacagaagcaatagctttgtcttcagtgaccagtgctatatcctcagcacctaaatcagtggctagaatatagtagacatccaataacttttgaaagtgttttcaaaatactttagttttgagagatttatgtgagattttaagtaaataactgactagagaaagatctaaatgagtttactcattgaaatacactgaattgcctccacaccaacaaattggccatatgtaataattctttttgggatctaaaaaacttagtaccgagaagccaaccctgcccatacataaacacattgtaattataacaaaactaggcagaagcttctaacagcagcaggaggcatgtgggaatttagaccatcaacttgctcctgcaaattaagccctttctctttaagagttaaaaactatttggctatagacaatatcaaacacatcagcctaatgactcagcttatgcattttgagtcatgtaattacgaaggatggaaatccctagaattttctcattaagggaattgtcagagagtttgacattttttacagtatatgactcactttatgggggatgattattattctatgctaaactttgccttggatttccacaaagactgatgggaggcaggaaacataaatcttactctctttcatgtcatctatactcactagttcaccctggtgatcatactatttttaaaatatataagaatgctagttgaaagctgggttttcactccaactttttaagtttcagattttttagaagatgtataattaccctattcacatgattacgtcaaaatacttcccagtttggggtataggaattcacattcagttgctgcttgttgaaagttgtcaattttctgatcatcacaaggatgatcaagagaagaaagggatactttttaaaaatccaaatcatttacactattaatcaactaactccattcagtaggaagaagacttctagatgacactggcttgcctatgatacatattccacacaatttaaatttttatggataaatatgtctagatacctatttaaatatgaataatattaattattgagcatttaaagaataatagattaactcattattcaaaagctctatgtaatttcaaaaccatagtaattataacaccgtcaattgacataaactttttaaagagaagctcaaatgtttcatgtatattttcagaattagaattcttattttaccttttcattacttatttctcagaaaatattatactcatagctaatccctattaaatccttactgtgttctaagctacctctttgtaaatatccattcagtgattgctcatagcacgagtttacatattagaacacatgtcttagagaagttgcctacctgacagaggaccacaggtagagtatccagaatttaaacgcacatctgtccagctctaacaccacaggtcttaaccactgtgtacattaactactcttagccaagaatttttcagctcacgtcatgtagaatattctttttgtaaaatgccatcacattttataagtcattgaagggaatttttcttggttacaaagcaactctgccccataatatctactgaaaagccagtgagctgcttcctaaaacacagccattttaggtgcaggaaacagtgtataaatggctcattgtatattgtatgctttgccagactgagtggcagtgggagtcctttgttatgtgggtgctgacatctgctagagtgtgctgtctctattgaagaatcgtgaagacaaagccgacccacaggatgtctgaatccaaataataatacatgttctgtgtatagaattggtggaagagaaaatgtcaggacagtgtgaggactgccatgtaaggtcagaaccactgcatttagaaagctaccactgcacagggaagaaatctaagtctacaaaattagtgggctgtctctcattatttcgtgctgtcatcagaaggagggccataccctgctgaaactacataaagagcttttgctggtggcagaactgtgaactggatggattctgggaatggccagaaaaacaaatgcctgtggttgtgagcagtgcccacacccatggtctagctagggctgtttgagatttgttgctttgactgaaccaacctgtcattcaactggttggtccattcacagtcagctttattaactttcccattttccctactgagttatttaagtaaagaaagtgctattcggacagcccttggtctctgggacaatcaactgggatttgattttagtatattctgtctccagtgtaaagccttggaagcatctaatttctagtactgatgaaccaaaaatacatggaagcagtcctaggctcacacttgagcactctgagaatggctttgcttactccagattttctcaggtcccagtgggtgtatattttctgacatatttattccagcctcactttctatcatgtaaaacatacatacaaaatgtagatttcattatagggtctacaaaacagcttaagaaaccaaatactatgtgtgacagatcacactttccaaaagtaatagcaaaaaaaaaaaaaatctggttccccactttcttccagcatcctgctagaatctatcagatactgcgtctatagaagaatctataagaacagaagcagtatgtacaacattcacaggaagtttcaccaaatcggagtcctgccagatctaattttttttccctaatcacgtttgtctcagtcagtagcttaagacaatggaaataatcagtgccacttttaattgggatgcctttttaggcaagggaaagtgacctcttaaaaaagcaaaattctgactgcaagatagctatcattgtccttcatttaagacaaaaaaaatactagggagggaataaattatgatttgtaataaagtgaaaagtgagattaggtagcatggggataatggaaataaagtgtctcttctttgaaataatatgaacaatcaatgtaacaaatgtagcagaaaaaactccagtttaaatacagaaaagaatgtgttcaatgcctctggttctttaactcagaaatatttggaggttacttactcattatgatggattttttttttctattggaaaactctgttagcattgagcgtttttgttttttgttttttgttggttggttggttttgaagcatttttcttgtctttgcccttgggcttttcttccttgaatactacataatccattactatttcatgtctgccacagagtctgctattttattaaggtcatgccatatttcaaaaggatgcatttatttgtttcattaacagctgcatgtttgttcctccccaggagacttggaagatgcagaactggatgactactcattctcatgctatagccagttggaagtgaatggatcgcagcactcactgacctgtgcttttgaggacccagatgtcaacatcaccaatctggaatttgaaatatggtgagggatggtggttttaatggttgcttagacatcctctgtctctcttttcatatgctctttttaatagccacaaaagaaagaatatgtggcctaattaacaaatgttaacatctaaggaattcccaaaggcctcctgaaactccttgtccttcaccaaaaacactcatacaaatctcctctcacggttcagctttcagaccctgagactcagtcaaatgatgctctggatcttggggatcccacatccctcccaacttcatatcagaatttaaatcctgcgtctcctacaacacttctcaccaaaaatctgtttgcccaacacgagacaatccagtgtcttcaagttgcatctgagagttaaactgccttgtttccaatcccaataccagtgcttactagttttttgacctagagaaagttatgtaatgtatctatgcctcagtttcctcacctgtaaaatgagataacctgcctcacaggaaggctgtgatggttaaataatttcatcatataaatcattccaaatagtcggccagtgaataacgagtaatggggaagcaacattaaattataattctgtgaatattgacctaacttctaccatcttgacacaatttgacttcagatgatcctctcaatgtaaattttccaaaaatccacaggaataagttggcattttgtttcacaaggtctcacagaaaagacaaaggaaaagagtctggtttgaaagtttactaaaggtctcagggaactttatcttctccttctccttcatccataagtcatctcttgttgccaagggttactatctctggtgatttgagaaactactctagcttgaaattctgacctgaggctatctccaaattcatatccgaatgacctactttttagttagtgtcctagtgagcaaagtaaatcaagatccaccagtagtaatagaaggcttcctacattccatagacactgagacaattctccacagtctatagtccaaacaagccctgaattccagtttttgtcaatttatgggagcttcctgcatctatttatggagtgctttctgctgcagtccttagataaacatgctgttggacttgagtagtgtactgtgttctctgtctgcctctgttcacttccctaacacattttccaggaataaaatatgtcaaaagaacctgaaccagttcgatgtccacaatctaggctggaaatggattgcactaaaacagccataacaactcattcaaacaaggcactcattttcatgggcaaatcactctcccacacggaggtttgactttggcttctttaaccagctggctggtgggctgagtgttcatcctggtttctcttggccaagctgaggttgacctttctgttcactttcattcacaccatatttgaccacttccttgcccactcaaacatacttaccctttaacatatctcttgacttttcctgtcatattgtaatctgtccagagcctcctctatttgggttttccaattggattcagatatttcagttggaaagggactgccttaagaaagaaacgttttcagtggaaaatatatgtatgagctctttaatagatgaactcctggagttcagagcccttaaaaggatgcccagtttcacaagacagccatacggtcatccttgattgtccattgctcattaatttcattctcaaaatcatgggaatgagctgagaataccattttagatcctccttaaattcccaacagtaccagaaacttgctacaggttggggcctgtaattggatatttcacacatactttccttacaaatatattctatactcaagaattgaactaaaagttattgtcctagtttctccacatcccatgtttacctaaaattcagaaatgggaccccgctcccagtctccccttctatatttatttatcaaatcgtgacaacattaccatcttcagatctttccacctgatgtttgtcctaagcttattccctggtatctgtctagcttacccaaaaattcggtttttatttttatcctgttccaagttgggaaagcctatctaccccaacaaggaacacaactccctagtaactttgagacacacacacacatacacacctactctttaaagcctaaacaatcgcacactctaaaagatagcagttaacaaaagtaacgatttgggagaacagttttaaggaatgtccccaaaataatcaatacatttagccagttaattaacttaacatttcttcaccaatctctagttttcatgactgtaggagcttaaccagtcactctcagaccacaataaaccaaaggtgaaagattctgtaacaaaagctagggcactctcccctgcatttaacctcctggccagctcactcgaagccagacaaacaggttcctctttttgtgcagagtccaggaaccattctcgaaaggactcatttgagcacatgcagagaagagtgtacacacatccagttcaccaagggaagccaacacacattgtgggttgtaggtagtaaaaggccttcctagaacacactccttaggatttaaacaaaattacatcggttaatggaaagaattctttcatatacgcaaacttacccagaggaacttttcttctgcccagatcttcacttccaatttgacccagttatacctctttagagctatttggctgagcttaaacagcacataggaaaaacaaattggtaactgtgtttatcacagaagaggaaaattaaatttagggttgggaaaggaaaataaccctatgatattacttttattctacctttacaatgagaatatatacctttgttacttctttaatttttacattatttacttatttttctttgctttcttgtttgattacaatgcattttaggggtaaaatttatgtgtggtaaaatgcacaaaaattaagtgaatttggagaaatgtctatgacctgtagccattccaatggtaaagatatagaacttatttttcccctagaaggatgcttcatgttcctttccagtcaatcttcataccccaggagcaatcataattctcaattctattaccctttggtttttgccagtttctgatagttcttattaatagaatactctttattcttttctgtcttctttcatttaaccagtgtttgtgagagttagccatgttgatgtccatctcatagctcatcttttcaattgctaagtagtaattccactgtatgaatataccacaaatttttaattctttctcttcttgatgaacatttgtgttttttcaagtttgagactattattttttaggttgctgttcacattcttggacaaatcagtttgtgtatatatattttcatttttctggggtataaaacctcagaatggaattgctgtgtcataaggtaagcatgtatctaagtttataagaaaccgcccaacagtttttcaaagtggttataccattctactctccttccagcgatgcatgagagatatacatcatttgcaacgtttgactttgggatagtatctcgttaggtttttaattcgcatttgtcaaataacaaatgttgagcagcttttcatatacttggtcttttgcctgtcttctttgggctagtatctgttaaaagcactgagttatttgtccttttgttattgctggatatgagttctttatacattctgtatacatttcctttgtcagatagatgtattgcatctattttctattctgaagtttgccattttattttcttactggtgcgttttaataagcaagagtttttttttattttgatggagtctaatatatcatttattttcttttatatgtagtgctttttgtatccttgctaagataactttgcctactcccaaagttgggaagatattttctcatgttttcttttaaatgttctacagttttagcctttatatttagtttttttaattattattatactttaagttctagggtacatgtgcacaacgtgtaggtttgttacatatgtatacatgtgccatgttggtgtgctgcaccgattaactcgtcatttacattaggtatatctcctaatgctatccctcccccctccttccacctatgactggccctggtgtgtgatgttccccttcctgtgtccaagtgctcttatcgttcaattcccatctatgagtgagaacatgcagtgtttgattttttgtccttgtgatagtttgctgagaatgatggtttccagcttcatccatgtccctataaaggacatgaactcatccttttttatggctgcatagtattccatggtgtatatgtgccacattttcttaatccagtctatcattgatggacatttggcttggttccaagtctttgctattgtgaatagtgctgcaataatcgtacatgtgcatgtgtctttatagcagcatgatttatactcctttgggtatatacccagtaatgggatggctgggtcaaatagtatttctagctctggatccttgaggactcgccacactgtcttccacaatggttgaactagtttacagtcccaccaacagtgtaaaagtgttcctatttctccacattccctccagcaccttttgtttcctgactttttaatgatcaccattctaactggtgtgagatggtatgtcattgtggttttgatttgcatttctctgatggccattgatggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcaatggccatcagagaaacgcaaatcaaattgtgtttatttgtttctcttgtcttatgcattggctaaaacctcctgtacaccactgaatagaaatggtgaaagtggatattcctgtcgtgtcctggtcttagggaaacaattcatgttcacaatttcagcactaaatatgatattaactataggcttttgtaaatgctctttatcagattgaggaagtgtctttctatttcttatttgctgtgagtttttaacatgaatagatgcattcatgttattaaattatgctttgaatgcattgattgattataaccaggttatttatgtcttctagtctgttaacatggcaaattatattgattaatttttgaatctttaacctgctttggtttcctgagatgtgccctactttataattatgtattaaaattagtgtgttagtattttcttgtgaaagtttgcttatacatttttgagggatatttgtctatcaacttcttttctctaatattttggccaggtttgggtaccaggattaagctagcttcaaaaaataggttgagaagggtcattcctcttccagtttctaaaataatttgtgtcagattgacactatttctttccttatacatttgatagaatttaccagaatataaccatcaagcatagagttttctttggggggaagtttattgataataagtttaatttctttgagagaaatataactgttgaaatattccatttctatgtgggtcagatttactaatttgtgtttataaaaacattttcattacatctaagttattatatacattaaaatagcatttaaaatttccttattatacttttaacatctgcatgttctatagtgatatctcctcttacattccagatattagtaatttatatattttgttttcttaaccactcttgttagggttcaccagccaaaattacctataaaaatccattacgttacccatcaagtatatgtgatattatgtatataaccctttatactatgttatcattttctttaacactttttttaatcaatattttttacagctcttatttcttacatatattcctatggaacatcaaaaaaagcaattactttttaatctaaacaaagtatttgtttttcagtgatcaattataaaaatatagaaatttcccataattttataaatatgtcttgactatttcaggttcaattgcatctaattctaagtaaatcatcactaagtatcatagcagcagaaagccataagattttaattcattatctctcattcctgaacatgcctccactcacccacccacatacctatgaacagagttaaagtcaaacatacatcaatgtgcatatgatactattccactgcatacaggaactcctacctgaatcaagacatatcccctttttattcctacagtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataataaatgaaaagcttgaaatttatactttcctgcagtgaaagaattctgaggatcttcaaacccaggtgtgaaagatagtgtttgtgcaaacctacatgaagtggctaactggagctgggcttcctgtcatccatcacaggtgtcctttccttccttatctgtcctttccttccttacctgtccttctcccaaattccttgtggtcttctccccaaatccccacaacattctgagtaagtttagctaacttatcaagttattttaaaaagcatatatgccttctctattagtcagagttttctacaaaaaaaaaagggaatcaataggaggatagatagatagatcattgataggagagatttctattaagaaattgacttttgtggttgtgggaactggcaatcgcaaaaatccataaggcaagccagtaggctagaaattcaggaaagagtgcagtattgagcctaaattccgcagggcaagaaactcaagcagattttctgtattgtactcttgagacagacttgcttcttcttcagggaacctctgtctttgctctagaggccttctactgatgaggtgatgcccaccacatcacggaaggcaatctactttactcaaagtttactgatttaaatgttaaccatgtcttaaaaatacttttagcattccctattcgctcccccttcaaccctcaaaaagaaaattaaaggtaagagagcaatactcattagagataagaaagagtaagaaacctagctcagctttgtctcagttttgtttcactaagatgataaaatagagaggtaaagcagaagttccatgtgtgaacaattaacttgtgaaaaggcaaatgtagtagaaaagagacattaggcagatggctgtgcatgttggccacacagaagcagcattggccatgaccagtgtgggtcctggttaggggaagagaactggctttgacaacaacagggtatctctgaggttataaaaagttgggttctgatcatttggagatgaggtccctatggatagggcaccatatctaaaggttcaccatttacattgcaaatatacattcagttctctgagagtgagcagagaaggcagaggttctcagtcttctgacaaggtcctggagcatcaggggagagcccattcttacaaaactccacaccagcatgcaagcccttacatgcacataagcactcacaacacaccaagagcctccaggtgacatctgccacctccaaatccccatatcccacatgctcaatgcacttgcagtctccatcccccagcagactgcaaatctgacatgcctcctccgaacggcaagggggagaggtacgtatggtacacacactgctgatggcataggcccctttggaaggggtagtgtgagtctcttggggctatggcaagcacccctggacaagcaggaagagaggtggtggaggcatgtctcacggtagcatctccttctaggtcctaatgggacacttcattaatggaactaccatttaagtgagtttaaactggatgcttctgattgagccccagagccagtgctccactgccaccacctgcaccctcacttccccttgtttaagcatcttccaacccagtaaggctgaagagggaagcatcctgccttcccacttctcttagcagagtagattgatatgattattcagattgtacaagaatctattccctctgaagtattgcttgatgaatgagcccctttttctaatttgctcaaagaaatcatttgagcttgaggaaaactgtccagagggcacgaggaccagccgttgtgatatgtaacaaggtagagaaacaaaagctaaatgaagaagagtgagcctcagaatcaaagaactggatttggatccctttaaaccattttacaggggcctgaatgtaattaacttctctgaaattcagtttccttatcaatatgctggtgataagtgactattgtttgaagacagcataagcaaagcatgcagtacttaggagatgtgttcttccttcaattcctctattattaaaagatgggcacagggcaggggcttcagctcagaaggccttgttgagaatggaatggagagcaggaacaagagagaggggcaaaggcattgccagcattctctgttcggctgttctccacccactgcctttcctcctgcttccctctaagtccagggcattttcccttttgataaacttccccttttacaacccatccaagggtgaaaaacaaagtcattacttttttttcagtacctctaaggcaaagcagcagaaacaggcagtcaccactacgaataagtgactacaacaagagctaggccaaactctgccatgtgggctgcattttattgggccggcaagtaactttaaatcccagctcacactctactgagtgaaagtctgatgaacccgcatcttcttgtgaacaactgcgcctgagatcagtcatgcaagaagtagcacccccacccccagacaactaacttcccaggctgtgaccaacaagcagccaagaggccaggacagggaagtctcaggacctttctaggaaatcaatacctttctctgggtttgttctgcctgaaataataccaatctccctccaacagcttagcatgtgtggagcatttgatactaacagcaaccctgcaaggcaggaaggcagtagggagaggcccaagaggaattcagcattaaggcagtgagactgacagaggggaccccctgaggacattctggaaggtcttagccagggccaggatgcagacccttcatgtcactgtagctgagacgaggtgcaaggttcacagcatataacctaattttattacaagaataaagactcagagtttaaatactcctgctttggggctcattagtaacaagttctccaatattcaaaaggcaaagtggatgtgttttagtgtaaaattaacactagctgctgtaacaaataagcccccaaacatatgatatctcaaacaccgtaggtttatttctcactcacatcagagtcaaaatggatgtttctaacctgcagctggggcttctcccagcagtattaggggcactttccatcttgtggctccaccgtctgtaatgcaggactccaagtggtggaagaggacggagcagaggagtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatgtttctacattagtgagttggataacaatatagattgaggccaaattaatcctctgtattcaggggcctcaaaaagtgtcatgtctagtgccactttcataggcaaatcaggcaaaatgtatatctgcttatgatcaccaagtcgtagccacattctggcttatgagattcatgggaccagcatgaggtaaagaaaagaggcataatgtttgcctttgttttgtttttattttaaagcccaaggtctttgtttttgaagtaacagcttaatttttacccttcataatcaggagagttacttagatgctctcttcatgatttgttgaggttggaatgatttggcagtccctgaaatttattttggggaggaggtggcagaagagtggagtgtaccaggttatgagatttctcttaacccaccaacctaacttctgttctttctgcacctcagagatgaagaagagatgatgatttctcttcctcaagtccttcttattcttgctgtcctgttttttcaggccaagattggccttgtttgtttgcagtgtgatgcaagatgccacttgcataaatgtaacaactgccccaaaccacctgctccctccttctactcacccaccccacccttgatcctgccatctttcattattcatctgaaaattgcaccaattgaaaagcaacttagtggagaaaggaaggattatgaataaatgctgccaggacaattagttaactaaaaagaaaaatagataaattcaataaatacatgaatttttttgagatggagtcttgctcagtcatccaggttggagtgcaatggcgccatcttggctcactgcaacctccgcctcccgggttcaagcaattctcccatctcagcctcccaagtacctgtgattacaggcacccgccatcatgcccggctaatttttgtatttttgtagagctggggtttcaccatgttggccaggctggtcttgaactcctcacctcaggtgatctgcccacctcagcctcccaaagtgctgggattacaggcataagccaacacgccagccaaaaattgttttaattaaaaaaaattaaactaaatgcctagccaccttcatataacaacaacaaaataccagatgatttaaggaaattatataaaagtgaaactctaaacaaattagaaaaattatagccaaatgtttacataatcttgacatgaagaagaacattctaagcatcaaagctgtagaagaaaagaaaggattgagacatgcaactacataaaaagtggaggtttatatatgtcaacacacacaataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacactgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttgactcctttacgtatcagagctccttattctaacaaatacgagacaacttcagagaatgcttatgggactaaaggaatcccaattgaaatgatttgggagatttaggcaacacctcttttcccatcctaagaatgtaactgcactctactctctagcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggtaaggaatggtggtagagtttttgttccctcagagtgctttgcatgtcaaagtgtgggagcaagtgagaggaagattgttgaaactaacctgcaaaataggacacccttggagggcactcttacactttctttggagaatgacttgcctgctgtctttgcgccttttgtgaagaacaaggaagcagagggagtggggtccttattagctgagaattagtacaagccatctgtattcctggaagctgccatacattttgaacaaaatccccacccactacgtccagttaaccaatttagcctgggaccccaatggctgctgtctctaaggcccctttaagaagcacctttattggtgtcaggtatgcaggcaagtgcggctgtcctatgtctccttttccagaaggatgaagatgtctttgggactggaactgagaatgtgtaggaactgagacatctcctccctaaaatttgcaacaggggtgaacatccctctcatcatctcctgctctggcttcttttccttggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaccatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaatgcaatgtttcccaagcttttcttccagtatctcctaaaggttgcagaagccatcattcatggcaaatgcacaatgtacttgaagtcttgactttaagcatataaattcatgggattttttatactaatccatgctaaggctatgtttgtttcatcataaaaatgatgttttaaacatgcacttgttaaattacttactattctaggagaatgcccttggcagaaggctacatatccccaggattacaaataccctaatttgaaaagtactgcctggaaagtactaagcaatttccctgggtaatttgaaaatattcccccacttccaccaaaattagctgccagagttgctgtcagtaaagagaagaaataaaaagacaacacttaaattgggagtaaacaacggggttaaatttacttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctcagaataagtgggaagactcagtgtgcctgtgccctctgccattcacttcatctatcaatgttctctgatttcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaagaccctagctgcagtagggaactgaaataagatacacatctcagaacttctgggctccctggggctggagggcacagccagtggtcacttcaagtcttgaagtgtctcagaagctccagaagcaaagagtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaagatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaagacaggtaaattacccaacctcacacgttaagtcagaactgggagccataattttgtatccctggtataaatagacaatctcttgaagaaatgaagagatgaccatagaaaaacatcgagatatctccagctctaaaatcctttgtttcaatgttgtttggcatatgttatctttggaatttagtgtctgagcctctgtctgttactgtagtatttaaaatgcatgtattataatcatataatcataactgctgttaattcttgattatatacctagggacaatgtgtaatgtaagattactaattggttctgcccaatctcctttcagattttattaggaaaaaaaaataaacctcctgatcggagacaatgtattaatcagaagtgtaaactgccagttctatatagcatgaaatgaaaagacagctaatttggtccaacaaacatgactgggtctagggcacccaggctgattcagctgatttcctaccagcctttgcctcttccttcaatgtggtttccatgggaatttgcttcagaaaagccaagtatgggctgttcagaggtgcacacctgcattttcttagctcttctagaggggctaagagacttggtacgggccaggaagaatatgtggcagagctcctggaaatgatgcagattaggtggcatttttgtcagctctgtggtttattgttgggactattctttaaaatatccattgttcactacagtgaagatctctgatttaaccgtgtactatccacatgcattacaaacatttcgcagagctgcttagtatataagcgtacaatgtatgtaataaccatctcatatttaattaaatggtatagaagaaca

SEQ ID NO: 153 - DNA, 10008 bp, Homo sapiens
gcgcgcgcccccgccgcccgcgccgcagtccgcagccacccggcgcggtcagccccggctgcggctccagctccgcgctccgctcttctctcccgagccggatcgcgggagcgagcaggggaggggaccgcagccggcgcccgagggcaggaggagtccgcaggcgggcccctggctgcggtagcagctgccggtggcagggaggtgccagcccgcgcggggtggcccagccgcgggagcggtggggcgggggccgcggccgccggccccagggagagatcgcgggcagcatggcggggctgcgggccagggggggcccggggccggggctgctggcgctctccgcgctcggcttctgcctcatgctgcaagtcagcgctaagaggccccccaagacgcccccctgcccgcccagctgctcttgcaccagggacaccgccttctgcgtggactcaaaggcggtgcccaggaacctgccctcggaggtcatctccctgtgagtgtccagccctggccttgggggttggggagggagaggaggccgaggacagctctgggagaggacaggagaacccccgctccccctcttcagagtgcggggaccagggggactgcaggggtcctcagggctggagattccaggcaccagtcgggcagggagttctgcagttttgcaggctcagcggccatgggtggggaaagcaggagttcaccaccaagaatgaatcatcatcaccacgagcgacagtgagacctactgtgtgctgtgctccagacttgggggggttgcttacacgagcatgtgggcccctgcctgtgatgtcacaccaagggcaggagagtggcggccagagcaggatgagaatgagctatgccctcccagcaccctggcatggggcacatgcccgccactgaccagccacttggcactcagctcggccagcctgtcactcacaacagccagcctcaggggctcccccttgtctgtgggaccagagaggttgtgaggtccttggggaccaggatgccagcccccacccccatgccccatctctcaacagcacccagcccattgtgggtgtttggatgatgatgacaacggtgtgggtgatggaaccttttcttgcctgagagggaagctgagcctggggccatgggtgccccaagaggcaataggggaggaccctggtgaaggcaggcagtgaatttgggaggagaagggaaagacacacagatgggggctaaattaggtgaaatggggcatttccagggcaagtgagtacaaaagctactgccctccgtgttcacctctccctgcctcagcacagcccttgcagaccccacagtactgactcgggtgtccccgcaggaccctggtgaatgccgccttctcagagatccaggatggagcgttctcccacctcccgctgctgcagttcttgtatggatagggccttgtggaagggttgggggaactatggggtggtagcaggggacaaatcctgggctggggagagggagagtggacagaggcagcctctgcagacgaagatgcaggtgtcccttgcttttgttctgataggatgtacccaaaagacggggcagccttgagtcaggggagtcggggcagcaggaggacagctagggatggcacagagaagccaagcaagtgggatgcggggatgggcttggctgctctggaaaccccagagaattgggtgcgatagcctgggctagtgcccaaggtgggcactgtggggccatcttagagacaggtgatcccaggaatcagagttcccagaaagagctgggggctgaaagaaagggatggcaggagtgtctccaaccctacaagatgccgtccatgagggacagttgtccatgaggggctggaatgggacagaatgagggtgggggagagggagaggagatgccacccgggaggaccaggagctggcttgacaagagagctctgccttggcccatgtttaggatccaacagggaccctgggagcttctggggccagaacaggctcctgcctggccttgttgcccaggtggcccagggattccccatggggtccccaggggtagcagcagggcagtcatgtcttggggaagcccagggctgaggcagcgggctgggggctggggcagcaggcacacccttggaagctctaattccacctttgtctctgcaggttactcaactccaacaagtttacactgattggagacaacgccttcacaggactgtcgcacctgcagtatctgtgtgtgggagggaaaggggcaatgggaaagcagaagggagggggaccccaggcctgggaggccgagggactgggtagggagtggatgagaatgccgcaggaagggaaggtgatgggaggcgagagcccttgcatcccgtgatggcaggacctgagcagaaggtcgtttcattcattttgcctctaccctacctgatgctctatctctatggcttggtgatgccagactccatttggaaacctgtctcggggacacgggctgaaatctaggctggggcgtagggcgagtgctgctgggggtctggcatcctgtgtgagcactgaggcaagttcccgctttccccagcttcattgagaacaatgacatctgggcactatccaagttcaccttccgaggactcaagtccttgactcacctgtgagtacgtcacacatacacacactgcaccaaagccccacctctcctgtggcctttggccttgctcatgatcttcagatgacctggcggtctcttttgcagctcgctggccaacaataacctgcagacactgcccagagacatcttccggcccctggacatcctgaatgacttgtaaggcctgagtcctgcctcttccaacagtgccgcagagggcgcatccctggagggagtggtgtgggagtcagaattgggatggtcataaggtcttgagaggctgggaaggcttgggtggggggaccctgaggaggtgaggaggtggagttagatatagatggtagccttccaaattggagtttctctcaaagtgcacctgagacaccatgtgtgtatgttttcaaaatgtgtgtgtgtgtttttttttttttttaattatagacggagtctcactctgtcacccaggctggagtacagtggcacaatctcggctcactgcaacctccacctctcaggttcaagcgattcttcctcagcctctggagtagctgggactaagggactataggtgtgcgccaccacgcccggctaattttttgtatttttagtatagacggggtttcaccatgttggccagactggtctcgagctcctaaccttgtgatctgccaacttcagcctcccaaagtgctgggagtacaggtgtgagccaccgcgctcagccaaaaatgtgctgagccaccgtgctcagccaaaaaaaggctgggtgtggtggctcacgcctgtaatcccagcactttgggaggccaaggagggcgaatcacctgaggtcaggagttccagaccagcctggccaacatggtgaaacgccgtctgtactaaaaatacaataattatctgggtgtggtggcgggcgcctgtaatcctggctacttggaaggttgaggcaggagaatcacttcaacctgggaggcagaggttgcagtaagccaagatcatgccattgcactccagcctgggcgacaagagcaaaactcagtctcaaaatattaaaaaaaaaaaaaaaaaagtactttaaaaaattttttttttttttagacagagtctcgctctgtcacccaggctgaagtgcagtggtgccatctcaggtcgcggcaacctctgcctcccaggttcaagcaattctcctgcctcagcctcctgagtagctgggattacaggcatgcaccaccacacctggctaattttatatttttaatagagatggggtttctccatgttggtcaggctggtcttgaactcccgacctcagttgatccactcgcctctgcctcccaaagtgctgagattacaggcctgagccactgtgcgcggccaacatgtgctttttttttttttttttttgagacggagtctcactctgttgcccaggctggagtgcaatggcgtgatctccgctcactgcaacctctgcctcccgggttcaagcgattctcctgcctaagcctcccaagtgctgggaccacaggtgtgcgccaccatgcctgggtaatttttgtatttttagtagagatgggatttcaccacgttgcccaggctggtctcaaactcttgaccttgtgatctgcccacctcagcctcccaaagtgttgggattacaggtgtgagccaccatgcccagcctgtgctttttaaatgtatgtttgattggactctacattaaagtccaatcagcgggaggggattttgaaagtttcgagtaaggaatatatagcatatagtagtatatagcagagccacactcatttattgttatttataagaaaataaaagccttggattgtgggaggcttagaggagcagggatgcaacatacagctgtgcaggatgcacactgcaaaagccaacctagccaaagaagtcagcaaggactgaaactgattccatactctgctggccaagcctgtgtctgtggggctacatccagccagagggaaacttttctctaatcttacaaagatgcatgtgagcaacttgcagcagccttgaccagctctatttctgaaaacctggagggcctgggtaggcagagccctgagagcatgtctttctctgtgcccccctcctctgccctcatgatgcagggacctgcggggcaactcactcaactgtgactgcaaggtgaagtggttggtggagtggctggcacacaccaacaccacggtggcacccatctactgcgccagcccgccccgcttccaggagcacaaggtgcaggacctgccgctgcgggagttcgattgcatcaccacaggtaggaggtgcccctgccttgggtgtcagtccacgcctaccccaaggcagctttacagacacgaaaccccccaccctgccccacaacacccagcggcagcagtaaagcaaccaccatcacccaagcagcccttcccttctccctctggtcttcagtaacgcacctctcatcttgcagattttgtgttgtaccagaccctggccttcccagcagtgtcggctgagcccttcctctactccagtgacctctatttggctctggcccagccaggagtcagtgcctgcaccatcctgaagtgggactatgttgagcggcagcttcgagactatgatagaatcccaggtacctgcgcccaatctggttctgctggcccttgctagggggaggggggagtgggctccatcgttcaaccccattgagttcctgtaggtagagggatagatgagacataccctctgcccacaagaactttccagtctttgggaagaggccaatgtatacaccgataacatccatatgataggcaggtgttaagagggagatatgaacatgatgctctagcagcacaaaggacaagcctaccctgggcaatcagggaaggcttcctggtggaggggggatacccaagctgagtcttgaagaatagaggaaagggagaactcagaggtgatccccaggtttctggcttacgtaattagatggaccgggaaatgaggaggagacaggagtgactgttgagcagttttggatctactgagtttgatctgagtcttgaaagctgaaggagacttagctaggagcaaaaaagtggaaagagtgttttggcagagggaacagcatgaacgaagtcaaggaggtgtgcagtaacttagtatgtgagtgtgtatatgtgtgcaaatcataagcagcttgtatgaaaagggataaggttcaaggtggggagtggcaacgagatattgatgagtaccaggtcattgacagggtttaagcagaatgtgtgatccagtctgcattttagaaagcttcttgcatggaaaaaggctaggtgtggggccatacatgagggcagaacagtagggggatatgtgcctgtctgctagaggggtgctggagcctggacacgagacagtagcagtggggatggagggagatatttagaaaggagggttaaaccgccaggtgcggtggctcacgcctgtaatcccagcactttgggaggccgaggcgggtggatcacgaggtcaggagattgagaccatcctggctaacacggtgaaaccctgtctctactaaaaatacaaaaaattagctgggcgtggtggcaggtgcctgtagtcccagctactcgggaggttgaggcaggagaatgtcatgaacctgggaggcagagcttgcagcgagccaagatcacaccactgcggtccagcctgggtgacagagcgagactccatctcaaaaaaaaaaaaaaaaaaaaaaaaatagaaggcttaaactgacacaagatgaaatagaaaacttacattgccctgtctccattaaggaacttgaagtcagtattaaagaaaaaaacaaaaacaaaaacaaaacaccttctcctaaaaaaacctcctggcccagagtgtttccctggtgaatgctatcaaacatttaaggaggaactaacaccaatctacatacacactattagaaagtagaagggaaggttgttgggacttggggactgatcagggaagggtgagtggaggagacaaaggtgttagggatgactgccaggtttctggattgggagactagtggagccacagctgaaatcaagaacagaggaggagcagggcaggctcagcgatgggtatggagctgaattgtgagttgtgagtcctgactgagttttaggtgcttgtgtgggtgtgtgggccaggagagtctgagggaagatcaggagctggggtgtggcatgggggtcattagcatctgggcagggcagaccaaaccccaaagaaggtatttaggcagtgactgccagagcctgaggctctgcataaatttctcttgggggaaaggtggggtcatagtgagaaggaaagaggggtgaactggggatgtcaaagtggagatgccgggcagcagctgaagaccctgggacaggtgagcagtgtatggtttcatgtgcttggtgcccgagaagggctccaatgaagctgattgtgagtataggtgcacatgggcatgcattcttgtatataaaagccctttcaaaagtgagaactcttgggaggatgtgttttcatgcactgtgatgcaaacagcaaggtgtcttgggtatacctaagatttctctccccgctgtggatccactcaaattctccctcccttccctgccttgccactgccagtggggtagctttgggcaagtcacttgctctctctgagcctcagtttctttctgtgtgaaatggacaaaatcacagggtcctttccagcgtgatgaattcctcatcgatgtaacatgtgcttacattcagcacagtgactgcacgcaataaaaattcaattactgacattatggttaagcaacgagtcactatcgagggacacttattttgtgctatgtcagcttatatttgaaccctagggttatgggtggaacaagggtgatattaaaactggttattagctgtgaaacaactggaaagcattgagcgcttagtggatgaacttcagtgtgggtggaatggtatagcgcagagtcttagtcctggcccaagtttggaagggactggccttctccaagggggttggatggagtgggagccgccggcctgcctgatgctgtctgcctctgtcctggcacagccccctctgcagtgcactgcaagccgatggtggtggacagccagctgtacgtggtcgtggcccagctgtttggcggctcttacatttaccactgggatcccaacaccacgcgcttcaccaggctgcaagacattgacccgcagcgcgtgcgcaagcctaacgacctagaagccttccgcatcgacggtgactggtactttgccgtggctgacagctccaaggcaggcgccaccagcctctaccgctggcaccagaatggcttctactcccaccaggcactgcacccctggcaccgtgacaccgacctggagtttgtggacggcgagggcaagccacggctgattgtgtccagcagctcccaggcacccgtcatctatcagtggagtcgcacccagaagcagtttgtggcccagggtgaggtgacccaggtgcctgatgcccaagctgtgaaacactttcgtgccggccgcgacagctacctgtgcctcagccgctacattggcgactccaagatcctgcgctgggagggtacccgcttctcggaggtgcaggccctgccctcccggggctcgctggccctgcagcccttccttgtgggtggccgccgctacctggcactgggcagtgatttctccttcacccagatctaccagtgggatgagggacgacagaagtttgtacggttccaggagctggctgtgcaggctcctcgggccttctgctacatgcctgctggggacgcccagctactcctggcccccagcttcaagggacagacgctggtgtatagacacattgtggtggatctcagtgcctagggggtgccgaggcctctggtctcctcagggtggccactggaggatgggtgggggcctctgtgagcaccacgtatgcctgtgtgaagacaagcgaccaacctgcattcatgcccttgtatccgcacacgcccagtgtgtacaggcgcaccccgtggactggcccaggaggacgtgcatcatcactgcaatcagcatgaacaccaggcacccctgggacacctaacgcccagttcccgtgaccccaactgcaggccccccctactctgcagcctttcccatgctctgccccctgtctcatgcacgagtggtgcggggtgctgggagcgaggggggccgcatcctcctgtccttgtgcttctccttctgcccctctggtctttcctgttggtgctccaggcattgtttacctgctcttgctccccgctgtagcccacagccatatctgtcatgcttccccggggccactcacccctgccccaccccgtctgcatgctcacatggacgcggacggacacactcattacacactcacacgccccgactgcacccggtgtccatctataaacatgtcagggcacgtgtgcatacaagcagattcagcactgcctaccaggctctcctgttaccttgcctctctgcttggagggggccccctctgctcacccccagcgtgccccccccggaactgataaggatgagaatggtggtgccagcttctgagggcctgcttggcctcctgggggcaaagcccctctgcccgaagcaataacaacagcagcagaagcaatcccggggagctgccaggggtgtctgtctctgttctccttggcgtttccttcatggccgtgaatcccagctcacccatggacagaagacctcccctcatctgaaagcctttctgccttccttcctgtagctgtcgctttctcaggcttggactgtcccctggttcaccctgtctttgggatgtggcccttgagctgggcgggctccttgggtggattagagagctggccgagctgcaagcacctgagttacctgcgagggtgcccagagtggagcttggcctgagggcgtgttgcagccctggccccaccagtccacagaggcccccaggagcactgcctttcagtggaccgggtggggcctggtgggaggggccccactagctgagcttctgctgccctctgctgtctgctgagatgccaggctagtggagagggcacaccatgtgcccaaatggtgtgatgctccttgtagcaggataccagggtactggggggcaatgctatgattaacttgcttcaaataaaaagttcccgccccataaccggc

SEQ ID NO: 154 - DNA, 2374 bp, Homo sapiens
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtaaaacattaaatagatcttcaatattattgttctaggatgtgcagttgaatgcagaaaggtggggaaagattagggaatattttgcacttgtgagaatcagaggtcaaagtcaggatctaatattctaatatgaaatctgaagcctgattttattcaggcattgttcaattgtaatttgtgattaacaactcatggagcattatatttactgataatgaaatggtatattctgagagaaagattactagagtagatgtagatttagaggacagagtttatcattatgttttcctgtgcacgtgagttctcttgtacgtaaaccttctcatcaactctctatctcccctctctcagtgcctctttctctccctgcaggtttactgccacctccagagaagctcactgctgaggtcctaggaatcatttgcattgtcctgatggccactgtgttaaaaacaatagttcttattccttgtaagcatattcttgaaagattataagggaacttttcactataatgattggaagcgccttgaaacatttcataataatgaggattagaattctctgtttaatgtatatctctgaaccccaagataatatgctgcttctgaacttttcaaatttataaataacagaataattgtagaaaacatttatttttttgtgtgtactaaatatatatgtatatatgatacacacacagagagatgtattctgatttcatgactcaaagacatgttttaagagaaaaaatatttagaaaaacaaattaatttttgaaagtggttagatcaaatactataagagatggtgaagttttatgctaatggctttaaaaatatttgttttaaagatctcattatttttatagaaaagtcatttttatttcagattgttccaatttaaaataattttaaattttgtatttcaaagtaagcaactgaatttattataatttgtctagatattaattttgtaagaatcactttaatttttctaggtattggagtactggagcagaacaatttttccctgaatagaagaatgcagaaaggtacattatgattgtcaatgttctgatgttagtacagtttatattttgtctctaaagggatgcaaaatgataataaaatgttttgggaaaataaactataacaatgagccataaatgtttataaaataaagattatatgagggcatgtccttttctccaataataagtagaaatgctcagttaaaatcattataccctcttgttgcatttaattaactgaaatttcctactactataagatgataagagataaataattttactatacttaaaaagcagttttgttcagtgatgtttaagatgtgtagggtggatttttgttggcgggcttgttttgtatgggaacacaattaagggatgagaggtggaccttttattgtgcatgtgcgtatgagtgactcgttattttaaaatatatatttaacaacttatgaggatgcagatattgtgtacctgtatgtttatagctttgcaaatatataaaataattttcatttgtaaacatattgttttgcatagtaattcatatttttatttagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaa

SEQ ID NO: 155 - DNA, 5652 bp, Homo sapiens
gagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggtgcggcacggccagaaacacaggggggcgggggactcgagcaagggggggagttggtgcgcccagaaagtggagaccaggggtggtgcggctgcacgcagctcttagggatagggcttggctccttggccactgtgtgggaggggtggggcacttgaagggcgtgagtgcgggcgccactgtagtctgggagtgtgctccgtgctgctgcaccggcgttccgcattaaagctgcccagcccttgttgggtgggggaggggaagacgtgggaattgggcgttgcctccggcctgcagtgagatcagctctctactgacctgcattaaccacaagttactttgcagcaactatcggatcatctagttaataaatagtagagtgaacaactctcaattaattctgaaggattactgtgaccagcatgctttatgactagttttaccaaccactcccttcctttatttagtaggtagacaggaaaatagtcaacattgttttaggtagttaactagtgatgttcatagtaaaccatttccttttaccttttttttttctttttttctttatgtgtaaaatcttctacaacatttctgtttaaacatctccatcttctggggagtagaaaaaatacaattttaaaaagatctccattttaaaacatctccatcttctggggagtagaaatttttttcttcttctggggagtagaaaaaataatttagatacataggaaatatttcatagaaaataatttttttcttttttttgtttacatctggctattttcttctcataaagaaaggcattagtttcctggcatgtaacccagctaaagaagagttaatcagtgaatgagagacacagtttttctatcaacttagtctgtttgcatgcattttatgatgatcattaaacagtattaagtaaagaaacagaagaacagaattttcgtccatcttttttttcatctcaggcttcatgaacttgggtattttaggcatgaaggtttttcaaaagatacaggaagttattctaggagagattttatcaaaggtgtgcaccttgattttaatcgaaactaggcctttgcaactacactacagtaaaataatagaagggatttatgctcggattttttttttgttttatttttgtcttcaaacaggacacgatcaacaaattagaaaatgaattgaggaccacaaagagtgaaatggcacgatacctaaaagaataccaagacctcctcaacgtgaagatggctttggatattgagattgcagcttacaggtgaaaatagaggggcaaagacagcagccattaaaccttaggaagaaaatcagatcccatttaaagttatgttggatcagaaaccttcaataatagtccttttgaaataatgaagtgttagtttttggcttcttccaagaagagggtatttagatatataagaatttaaccctgtaattaggagtcctgtttttatcttgtcattacactttaaatctaataggatgatttatttatattttttctggtctccatcaaaagatccccaggcattaagtattgataaatcccagccctgctcctgcttgcctttgtgtttagggtactcagagcaagttgtgaaacacaggtgttttttaacctcaccttgcatctgcatccccaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagccccccctctgaaggagaagccgaggaggaggagaaggacaaggaagaggccgaggaagaggaggcagctgaagaggaagaaggtatgataagaaaaaacccctgcaacttcaagtgtaaactgggtgtggagatttgttaggaggtggataagacaaatgaagccttgctcatttattcatatatgacattagaatcataaataaattttctgtttgtttagcaaaactttcctaaggcatctactctgaatgaggtgattggtcaaaattttcattttttaatataatcatttaacacagcaggttggtgtcctaaagaacaaaaatagataccagacacataatgaaagaaatattgaggttaagtcttggagaggagcagagcttcccatacctagaagtgatctcattcgatttaaatatgtgttcagtggcaaattattcatggcaagctttgtctgttacatgtgcttttggagagagtggagctgggaggttttggtagcattctgacagttgtgtttgcaaataaaacctttgcagacatgttttgactggacttaccctggatttgcattttgtacattttctttttatgttaaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggaccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggagatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagt

SEQ ID NO: 156 - DNA, 924 bp, Homo sapiens
atggaaagcgagaacagaacagtgataagagaattcatcctccttggtctgacccagtctcaagatattcagctcctggtctttgtgctagttttaatattctacttcatcatcctccctggaaattttctcattattttcaccataaagtcagaccctgggctcacagcccccctctatttctttctgggcaacttggccttcctggatgcatcctactccttcattgtggctccccggatgttggtggacttcctctctgcgaagaagataatctcctacagaggctgcatcactcagctctttttcttgcacttccttggaggaggggagggattactccttgttgtgatggcctttgaccgctacatcgccatctgccggcctctgcactatcctactgtcatgaaccctagaacctgctatgcaatgatgttggctctgtggcttgggggttttgtccactccattatccaggtggtcctcatcctccgcttgcctttttgtggcccaaaccagctggacaacttcttctgtgatgtcccacaggtcatcaagctggcctgcaccgacacatttgtggtggagcttctgatggtcttcaacagtggcctgatgacactcctgtgctttctggggcttctggcctcctatgcagtcattctttgtcgcatacgagggtcttcttctgaggcaaaaaacaaggccatgtccacgtgcatcacccatatcattgttatattcttcatgtttggacctggcatcttcatctacacgcgccccttcagggctttcccagctgacaaggtggtttctctcttccacacagtgatttttcctttgttgaatcctgtcatttatacccttcgcaaccaggaagtgaaagcttccatgaaaaaggtgtttaataagcacatagcctga

SEQ ID NO: 157 - DNA, 125514 bp, Homo sapiens
atgacggaccccttcttcctgccttcaatgcctcagcggaagatccccaagggctggagcgaggagcgctgccgctggacatcctcccggggaggctgctccgacctgctgcgcggcgcgtctgagactggggactgagccaccccgccgccgccggcgccgccgccgccgcccgctccgtcgctgccgtcggtctggactggcccccacctcgctgcgccctctccccggccccggccccggctcggggcgtcccggggctcgccctgcgaccgccgcctcccgcgcgccgcgtcctcccgaccccgcggcggcgacgatgcccgggaggagggtcctgacggcggcggcgcggatggtggcggccggcgcccgggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacagtgagtaccctccccgccgcgcccgtgcgctcccggagccagccctcccgcccctttcccggggccgaacgcgcaggaaaagcctctgcgccgcgctccggcggaccctgcagtcccgcgcgggtcggggccgacgtaaactttctgtattgcagcatcgtggaaccgggcgtgggggcggcgcgcggtcagccgtcgccggatcccaaaacctgccggagaacggtctttcagtgcgcaggaaccccccgggggtggaggatagcgtgcagttcagggatggacacgtgcggcagagattggcccaagcgagggcgcaggtggaaagcgggagagcgcggatgatacctagtggggccagaggagtcttcctcttctaggggctcccggagctcggcgggcccctgttcgcagtacaggaggtagcagaaggcacacctgaagccagcgctggagggaagggcgagggtcagcttccacccctttccgccctggagaccgctgatgtcgctttatgggtgtgtggtaacgcgggcagtgtagaggtgggaaggaatgagaggaaaatagtatcacgagtcatcgagtaaaaggcagtataagaaaatgtgtggtggaaatgtatcattactaagcaaagatgagagtgttgatcgcgggccacgcagttgagaggggtttgctgctgagttaaacacagtacgtggtctataatgtgatttcatcaaaacaggaagagcggagtaaacaaatacacatcctgatgctgaaggatgtgcatacctgtgtgttctgggtgtgagcagaatcatgacaaattaaattgattttttttttcctgtggaaacacacagtaacaacagcagccagtgccttaatttaaaatgcaaatgaactggctagagcataaagtaacacacaattgacaatattttaaatattaatatcaagacctagatacgtttcttagagtgatgtttaagtataaatgtataagcctgtggtgagctttaattcaggaaatatttgtgaattgttctctcccccgaattcattttaagtgaaaatgtgaaaacatagaccttttatgtcgttggatgacaaaatgaataagaaaaaatagaagaaaaatcaaattatgaagactagcttacttactattttgctagtgttttgtcttgtaaaaatgttgattagatcaagaatacggaagtaaaacaagtttagattataatggcattgcagatttactgttaagttacagatcacagtctctttgacactggaaacctgacccaatataatgctttcggaaatcacgtttctcaaattaataatcaatttctatatattgatttggtattaaatcaagttaaggttagaagagattaatttcacagcttagaaagtgctgagggacggggttacttggaggttcagaacatttttgtaggcaacattccaataatggtgcttaatgcccacaatccacattaatctgtttcttgcttattctcctcctccacagtctgtaggatttgtctaagtatttattttctaaaatacagccacactgcagtatgtcaggaacagtcatggagctgttctcattgtttgcctctccttttcctcctttttaccttctggcccctctcttcattcagagatgctggcagagccattccctaagggtagtttagatacagtgtgactcctgtagtcccactgtactgtgtgtgacatgagtaaattgacatgttgcctttagagtgaatgatgtatttgccttaggagtttgggtctcatccattcttaacttgcattagttccttaagggagtcccaaggtttcctgatttgtacatttcaaattggtttttgcaagttctgaatcgacttctaacagttaacaatgaaaaaattaatctgctttgatattattttatcttgaaattatgttatgtttttatgggatttgatcatttcagtgtattttatctctaatttttcttttctgtttcagttgtagcaagtttaatcatcctccatttgtctggggcaaccaagaaaggaacaggtgtgtttacttagaaaaatgctagtggaagacctcgaattattttgtattttcctattttcctcctactgttaatattccagaatatctgaacctgttataatatgtataattgattggtttggctaagacaacatttaaaaattaatttactaatggatattataagaatgtcctctatttttagtacaatagaaaattggatgatggctctttttaaaacttttttttttttttaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaaggtaaggggagacagtgccagagttaagaaagcactaagccaaaaccttgccatctctgtgctttggatgaagaatatgcgtataggcattacaaaattgatctggagatcatgcgcaaaaatatctcttgagtgaatcaataactgtaaaatctggaatcaggctaattattgagattaactagtagtgggttatgaacaagcaaattctgtgcaataaaaacagatgaacaacttaggagtttattttgctgttggcttaattgatttagagttctcatgcagtagaatggacgcatagttggcacaatattaactgtgtaagtgtgagaaactagcatttttttagctcaacaattagtagaataacttgcatgttacatttctttagtattataaattacaaaaatcgtattaatgtcaaagatgaatctataatcacattttctaaacaccaatctgaaagatagttaccttatttgtgttaacaagtgacatctcattttgaagtcaaggtcaggattgtaaattatgaccctttatttcatgacttttttccaacatgaaagataaatggtgttggaaagagacttctctttgaacgtttcccatttacactaaccttgtaaacactttttttttttgagacaaagcgagagtcccctgagttccagcgattctcctgcctcagcctcccgagtagctgggatcacaggcatacgccaccatgcctggctaatttttgtatttttggtagagacggcacttcacgatgttggccagctggtctcaaactcatgacctcaagtgatccaccgactttggcctcccagagtgctgggattacaggcgtgaaccatggctcccggccaacacctctctcttaagtacaacgtttaaaatgtagaagcatttcatctggtgatggaagttttcagtattccaactgttagtacctaaatagcctaaaacctggaagcacccaccttccccccacacacacacacaggcaagactgtcttaatgataaagatagatgcactttctactacttataaatggggacacatttatttgatagatttttcaaagaagcaggctttctgttcacccaattttaagactctctatttagaaatgattttttttttggtaattattgggccaaagatcttcccccacccttactacttgaagttgaattttcagcaaagataaaccacactgtaagaaggcaaaacaattagctatgctattaaaaggataacactgaaaacctaaggtctggcagtgcaaattccttttacaactgatagaaaaggtactcgctacctgcctcataggacttaacaatattctctggggactatgtccctttttgtaaacaatctaaaggggccctaggattagcacaaagtagttgcgacggggaagccaaagagaagaatacagggaagaagagatgctcaccttcatttctgaagaatgtccagggaaggcattattctctacatagagcagcgtatgcggaagttcagagctatgatatggttggggaccttcgtggcgcatcctagggcttctgcagaatctgaggaaaatacagcaggaggctgaagagggaagcagtctcaaagaggtacctggtattccttctgtgcccactggataaaatcttgaacattatgttggagacaatgaggtgccattgaagtaatttaacttgaggaataatgtgagattttgatgatgaagcaactgaaggaaaagaacataaactaagaaacaattccaaaagtccaagtaaatcataataaatacttatactaaagaagcggcatcagtgatggagtacatgaaagaactgagaggtatttaagaaactggatcgccagacgtggtggctcacacctgtaatcccagcactttaggaggccgatgtgggcggatcacgaggtcaggagatcgagaccatcctggccaatatgttgaaaccccgtttctactaaaaatacgaaaaatgagccaggcgtggtggcgtgcacctgtagtcccagctactcaggaggctgaggcaggagaatggcgtgaacccgggaggcggagcttgcagtgagccgagatcgcaccactgcgctccagcccgggtgacagagcgagactctgtctcaaaaaaaaaaaaaaaagaaaaaaaaaggatcatgagtggctggatcaggggatcagagaatagggtatcctgggactgttctaatatttgttgctcgataacttgttagatagacggaattgccatcccagaaaagaaatatagacgggaaaaattggtttaaaggaaaaataatgtgtttagtttgtgtttatggagatgctccacaaaaagattggatacatgtagctctagctcagtggagagatagatgtgtgctgaaaatgtatatatgtacgtcataaatatagagattgttgttgagattgttagtatgaataaaattatccaagagaatatttggagcactatttttcaactgctcttaaaaatgcaggtgcctgggcctttccccaggaattctgatttaattaaccttagatagagccccagccaccattatattgtagtaaccttccattggaatgcccgtggcaccccggtgtcttcatctaaaatgagagaacataagatgtagaataaattttccagaaaataacacataagagagggacagagtatggggaaaaaagtaatggaatgagtaggagaagccagagagttaggcaggagggtcaggtgcgcacgatgccacagcagccagagtggatggggtcttgagaagcagggagtagtcaaagtgccagttgttacagcaaagaaaaataagtgaaaaacagaaatgcatctgttacatgaagcaattaagagtttgttagtaacaacgatgagcactcccattggcatagtggagatgggtggttttttctcttttaaaggggcagattgcacatatttaattctaaaatgaatattctgtagagaaaggtacatttaaaatagaagagaaagagggatacataagtggtcagatttctagaggtatgacccattgtgatgaagaatacaagcgaggtcccagtcacgaaaaagaggatccctttttgactgtcaggtggcctaaacattccctcaaaatggaggaaatattctgtatatatgtgcactatccaggtgaaagtgctcatagttctcagtgcgtctgaagattctcaaagtggttgagacctctcatgaactaacctcagtgttagatcaaatataacttacagaaatgttaaaaggaagggcagctgtgaagaaaattcttgaaggtgaagcaaattgaagttgagagagttagagagcttcaaatagtttctatgtgccataatcactcatttttaatctagcacaataagtatgtggcaaacttagttttaaaaagttatttcactaccttctaaaattcagctatgtaggtttcatttctggttgtgtgtcattaacttcaacatgctggaccaaaagaaaataaatcatccacatacaatgttgcctaccaaaagccataatggcggaatgtttcctggggaacatcgagaggttgactcagccacagaacttatgaaataataagagcgaaggtatggagaagtgaattcatgttagatggccattatttcttagtaggggaaattggtgagtgcgtgttaaaagatgacagatagagttctaagtaaattagctaaggactgtcttcattgctctatctttccctagccttacgttatttaaattaacctacaatccgaaataatttgtttcatcataaaacttgttatactgatttattgtgaaataaactggtacatacatactataggatgataatgtatgcaagcgctatacttagtactgatacataaatgggtctaactccttcagatttgcctttttgttttaaggctggcactttaagcataaaacatggttagtcatttctttgggtactttcaaatttccaaaaaaaagaaaagaaaaaaaaaaaccacgtcattgaaactccctcaaatctgtcattattgtggttactcatttgttcacctttttcatacaatttagtgatagataaaatatttttcttgcatgagttataaatgtctcttttcaatgtatgagtctgaaacttttttagaaattaaagattattcataaaataattcattttaaaaatgaattgcctttaaactgttgatatttaattttatacctggggagcatcagagttacattttattctgtaggtctccaatttccaagttatactgtgtgtctcaatcttacatacatttttgaaaaccacgcataccagagtttacattttaggtcatcatggatgatgttccgtgtatatttaagaagcaatggggtgtggacagccaccattctgcatagttgctgaccgtagagggagcaggcccgactgtgctaagtcttaactttcaagtgtctacaggggcttagtccctgaaaagggccaagtagcagggaagcactcagagggcttcaggcaacagctgtttactaaccgggatacatatatgttgacatttcagcaaattttatggccattctggagtatcctggctgaatgtaagtctgagatgccagaattttggactgttttggacgtaccaggggaagaatgaaagaccattagcaaaagcattcatgtggtgctgtatagagttgccagccctataaagctttccctgattctttagagagctgtaaaaacatttatgaatatacactcatttataatttactgaaagactttttttttttggaaattttcgatgacaaatactatgctaagctctgagaaagaaggtgagtgagatatggttcttgtctttcaagatcagatttagagaggaggcttctttaaagcaagtctttcctgtgtaaagaggagataatgttgggtatgtagatattcaaaaatgtaagaaaatccatgaaagtgtgaaggagcttactttcttagaagacaagacatgtctgaagtggtctgagctcaggctctctgtgaggggatagggtcctggacgcaggatattcttaacggataatgtgtgttgaatgcattgatcatggtccagctgctgaggttgaaacctgagagggatgtgatcaggtttgtgttgtagaaaaattactcttaatgtccttatatatgcatttggatctgatctagacacatggcttggattatttgaaagattatatttaatataactctatgccaaacaattctcaagtgatttgttaccttaaacctgagtattcctggaaatatgagaaaagagacagaaaaatattccttgaccttctaactccaagttaacagcctttcataaaaatactgtgctttgttagtcctgcgcaaaacgtcaaaatggtcatcttgtatcagaataatattttatgcaacatcatcggttttaagtttcactccttagacatttttatgaaaattgtgtcccgtagaatagtatcatatgctttctttatatttctatgcatatcatccataaagtttgagagaagatgtacaaataacatctgaaatagaatcagaaaacatcaacctgaagatgtaagaaatgacctcctagacacaatctttcttctttacagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctggtaagtaagtacttaaaaaaaaaatttctttttcttcctcatttttctatcttcatagtacaaaatcttgtgtaagacaacattatactttctcagagaatgttccagttctatttaaaaccaaatctacagtgctttttcttttccctacacaaattctgaaaggaaaagatgttttccttaaaacagcctatactagaggtaaagagtagtgactcaaggctctaaatgggcatcagccacatcatcaagtggacttttgttatgatggaatgtgtaattggagagacagtctgtgataaggaaactatacataggagctgaataaacttgaaaagacaattgtagtattataaaatatatccaccaaaatgatctttggggaacttgaatcaaaagtttatttgttctgaaaattaccgtgtttcaatcaaatagatcctactttaggaagtagtctgctctcttttcaggaaagcaaattcttaagagttttgatgaaaggaaaactgagacctgtaacagccaaatactcatttacaaggtcttgcagaaattgtgtgcaattatcaaattatgcaatctgtatcaattttccttttaactcgctagaattaaaaagatcctgtgttgttgcctggcccacttgattaagagttaccattcattacaataaaaataggatatcacattttttcactgcaagaacactacatgcattaatttaaatggaaaaatgattcaaattacataaagcccattttttatatagtttgttttcagtttgtatgtattgttttatttaagttaggcaatagcataatttcaaatatatgtaaagttggttgaagtttgtattccatgttaaagaagtaacatctaaatacagctttgatactcagttaaaaaactaaaattttaaaaattattaatataagtttaatgatgactttcattatgacatcatggggtatgttaaatcaagtatttactgtagcatatatattagctttaagcattaggaatgtttttaataatatcactaaaggattgtggttttaattatgctttgctgataatggattactcacagaaatcatgggtatttcatgtgctacagtcgaactaatttgaagtattcccaaaaggtacaaatgttagcttaatttgtttgttcagattattagtgctagagttgtaaatgggaaggtaggtatttttttcttaactgataattttgaatataacctgtacctagagacagtgacatacggcatgttctaggtttcataagttatattttcattctggttttggtgatcatgaaaataatgtcttggatttaaaattgtggtttcacaaagaatgtagtgtcagctgtcatgctttgtcaacataagcaatgctatccatgtttctggctctatttgagatgacataaatggtggcacccaatctgttcttctaggttttaaaaaacctttttgttccctgggttttgttctttgctttttgtttctttagagccaccatactgcatttatagaatgagatttcactgctgcgaacaactgaatcagaacggaactcttggagatttttccatgaagtaggacaggttaaggatgggctgaggcttctgtttttactcagatcaactagagcaaaacttctggggaaacctacatttggcatatgagggaaagctaggaccataaaaaggagacttggaaaacttacatgacagcaaaagttgacattgtgtggcccaaggccattgcctgagtgacgtaaccatctacacctcttctagaaagaggcagtattaaggaagccaattacttattgaaataggaagtgggaagggattagtaataatttagatagcatttagggaatctgaagccaggcaggctatagttgtcattttggcttaatttttatttagtagtgtcattcaactggtgacctggggaaattgaaggaggaagaatttctcaagtcagcttaatgatttatgttatgaagcgttacgagaattgccagggctctgcagtgaactcacattggagatgaaattccgcctaccagttcatcttagagagatgatggtctccaggacagctgcgaggagcactgaatttgaaactagatctgacttccagttctggcttttcttttctttgcatcacgtaaattttgaacacggtcctttatattctatctctcaatatttttaattataaaataaaaataatattgagcaactcacagaatagtttgagacaattaacaaatgcatatttatgaatttcttgagtgcctgtaagaactcaactatcgatagctgttgtttttattagttttatcatgtgctttttaaaaacaaagcatgcttggtacaggttattgggaaaacaagtgtctcagacttaaaaacagttcctgaaatttttaggtgggtgcacaaaattcctacctatactacgtcactttttttagtctatgaaatttagttactttagatgagcccagacttccgagtaggagttgtagttatttctaatgtcagtcatagaaaatgtcaaggcagtaatagcagcagaaaggcctggtggtccctattattttaatgaatttatcacaatctggaatctagatgtaatctcgcagtctcagaaactttatgtaaacacattgagagtgtacccatctcttagaaatgaatcacatttgccaagctaacaggaatgaatatacatatatacacaatatttatacatatgtatacatactaaatacacatatacattttcattaagaattctgagtattacaaagtccatttcttcctgcaagcaaacatacctgggtggacagattataatcaaaacacttcagagtagtatggaatccaggtattgaagttgagatgtatagcatgcatatttcataaatattgaaccaaaggtttgataattcatcttcctaacacaggttgtttcttccaatggtggtttagcccccacacagccatgggtcccagtgtccagtctcctggttccatcttgcctgactggcaaactaatttgtgtaggcttttatcgccagaattttttttctatttctttgtatctgagtctatgactttctttcctactgaacttaaaataatagcctttcagtcccaagctcttgctgttcatagtagctgtgcttctgaattcccatttgtacgtgggaacagcccaactggaggtcccgcacggatgtggaggatacggaggcagagcgagagagaatagaaatgggcttaaaggaggcccttctttttctcctggcacattttgatgaatcctcactttctggtttgctgacggttatttttacagactgtgtcattacccaggtccacagtgcagcggtgaatcacctaggattatagtctagcatgcataagaaggattgtgagattgagcagtaatcaaggagaaatcagctggttcaaatcctgggtcttcaaaggataagagtgaggcttgtagaagggccagggggcgcagagccttgtgagcaccctgtggatgatgccctgaagagttctcttctttctgtgtactgagcctctcctctgcaatatgctatcccagttcagaaaaagaaataagtgcagaatcaccaagaatgttaaaagttacgccatggaatatttgataactcaaacaatttaataaaaaatagaagacatatcaaaagtgtttattgtattagaattatattgttttctcatttaaaaagagtctttaaacaagttttaaatcaagtttggtatataaaatcaaatgactagaaaatatgttgtgataaaagcaatttaaaacaataacggttacctcagataagggatagcaggaagaggggaataaggaggattttagaggccaagatggagtaaaaattgactcaactttattgataatgctttaatttttgaaagaataagatattttggtattacttgtataaattatttaacatcaaaaaacaaaaaaatagaaaagactatacttgataatatttaatgaatttttagaagagggaataccactttccatatttcacagacttttttactcaaactaagaatgccttttgagcagaatataacacttccctgcagccaactgccttgcctaaattttctttgcacttgaaaatgtaaggaagaaaatgtaacagtatctactgtactcctcattccactggcatgacccagatcattcagatgctctgctcctggagaaggtggcccttccagtctctttaatgacaggtatcttttgttggtcttataatttacttccttgtggggagattttctgtcatttacagacatagaatgggatgtttatggacttttccttttcaatgatagttttcctgtactagttttaaggaacaaagttacacacatcccactggagaaattgaaattaaggaatagacctcaaagtaccaaataggtgaggactgagttaggcattgacattgaagtgagtggagttgttaaatatattgaaattattacgatattttgtacttaaatagcacctttcatctggggagctcaaagtgttttagggactttttgcccaactcctagccacctctcaagctgcatgctttgatggacttcaaaggcaaagggagaaatacactgcactgcagtgatttaaatggagtgttttaaacggatttctatgcatattaaatgaaatatattattaaaataaaatattgtcatggattcaatgttatttcaaatattcggtgcaatatttttcctctttggatcagaaacgtgaatatatatgtattaaccatttcgaaagtttctaaattttcttagctagataatcagagttctgataggtgctctggtaagaaagaaaaaaatcttcgtattatttattcaacaactaaagtttcatttaaattttgcacaaaaatatgaaaaattagaaagttttaaaggctgagattaaaagaagacttttttcttttttttttttttgacatctcactctgttgctcaggctggcgtgcagtggtgcgatcttggctcactgcaacctctgcctccgggtttcagtgattctcgtgcctcagtctcctgagtagctgggattccaggcatgcaactccacgcatggctgatttttatatttttggtagagatgggatttcaccatgttggccagaccagtcttgaactcctggcctcaagtgatccgcccacctcagccccccaaatgctaggatcacaggcgtgagccaccacatccagctaaaagaaggacttcgatttttttttccacataaaaataaaagattgaaaaaatttaggtcagtatgtgttgtctttttaactatgacttggtgcaaaagtacttgcggatttgccatcacctttacctttaatggcaaaactgcagttacttttgcaccaacctgaatgttctgtttatactactgactcaaaatattctcatttcagccctagcagaggctcttaaatggaaaaggtaaggagcataatcacatttattcttgaggcatatttttcaagaaatgaatttaaaaacttgaaaatcacagagaatcacagcactgagaaaattaccaatgtgtgacaaggtgcggtgactcatgcttgtaatcccagcactttgggaggctgaggcgggtggatcaccttaggtcaggagtttgagaccaacctggccaacatggtgaaactctgtctctactaaaaatacaaaaaaattagtcgggcgtggtggcaggcgcctgtaatcccagctactcgggagactgaggcgagagaattgcttgaatccgggaggtagaggttgcagtgagctgagatcatgccactgcactccagcctgggcaatagagcaagaccctgtctcaaaaaaaaaaaaaaaaagaaaaagaaaattatcaatgtattgatatttttgaataatcaagatattcatgtgaaggtgatttcttccatctctcacttttctggccagtccatgacttggcttaccttatctgtataatagtgggctcaggaggagggatgaggaatgaagagagacagaaatcttgtttggtctaggtgggtgttcaggagaaaagctgagagtgggagagaaaatttccaggattagctcccatctgtgcagagaatattgaaagcagtggcaaaggaaaaggaagatttttaagaagtttcccataaagaaagagtgtcttccggccgggcacggtggctcacgcctgtaatcccggcactttgggaagttgaagccggcggatcacgaggtcaggagatggagaccatcgtggctaacacggtgaaaccctgtctctactaaaaatacagaaaaattagccggtcgtggtggcatgtgcctgtagtcccagctactcgggaggctgaggcaggagaatcacttgaacccaggaggcggaggttgcagtgagccgagatcatgccattgcactccagcctgggccacagagcgagactccatctcaaaaagaaacaaacaaacaaacaaacatgaaaaggaagaaaggtgtcttcctcatcttgtttcctggagaggtggagaaaagaagagtacttaagtgtgtttatatttatttatcggctaatcgccggactatgttttaaatagagtacatctgagattggaacacatggggtcctagatatatttccattattgatatatgttttccttagattagaaaagaccttggaatttatttccttcaacctttctacttaaaaatcaagagagcagagtgctagagaaaatgtgtggcctgggttcaggtactctgtaaatattaaattactacttgtgtatcagttatataagcacggtgctgatacaccttctacaaagtgttgagattataactttaattacatcacatattgcaagtaattttagtacggttatattaagaaatttaattaagggataatactatatatatcacccgcgtttcaccattaactgatacatgattttaaaattcatcttctccatgttgtttgaaatgtttttccactcgcaatgtccaaagaaaggatggtttttcgtctctccttctacctcaattgtaaaattgtgccttctcaacccatctgagcctaaagtgcatgattcatttcctgttcttctcaaatacctattattactgacatagtcttctgtgtgtaccgtgctctcattagttgaaacttgtggctcacatgttaaatactcaaggggaaaactttagtttatttctcctagatctcccacgaattttgttttctttctttcttttttctttttttgttttgagggagtttcgctcttgttgcccaggctggagtgcagtggtgcaatctcagctcaccacaacctccttctcccgggttcacataattctcctgcctcagcctccctagttgctgggattacaagcatgcgccaccacgccaggctaattttgtatttttagtagagacagggtttctccacgttgatcaggctggtctcgaactcccgacctcaggtgatccgccagcctgggcttcccaaagtggtgggattacaggcgtgagccaccatgcccggccgatctcccacgaattttcctgctccctaacacccaggtttctttgggtttttcctgtgatgccggttcctttcgctcacctcccactccatccctctattcagggctgctgatcccagcagtacacaggaaagacactcagttgcagcacagaaatgagctcgttccatgcacattcagattccccagagcagggctccatccagaagtgggactgttggctaatctacaaaatgttgttttatggaatggtagaggccttgcttgggtcagtcctaaggttacctctatgtcgaatcccatcatcaaatgaccagcacccacacccctcactaaatttccctaaagataaattgtatcacttgacaagagaaaaactcaagaaacatgacaaaaacaaaacaaataaataattcttacactcaatctccattttgaactttcatgcatctcaatgtctttagttactgggcttcttggtaaaatcttctgaaatctctgactaacatttaactcattattgtattcaagaaacatgcttttcaaattactaaagccctgtatatttttcctaagaaaatattgacgagtctatttattctcctaaacatttcctttcataacaatttgcagacaatttgaggcttatttttatttaattatttgaaaactaaatcaaggaattataaacaacccatagtgttctttgtctagaccaaaacatttttcctattatattttataatttgcatgccattacaactacttgagtataactcatgttaatattcttaaagtgaatgcacagaagaccttgatttctactaggtgatattagccacctacacttatttaacaactgtttattgatccactatgctaacactgtagaaatatagtatctgcaagaccctagctttcatacagtgagttcatagtctgttaaaaactagaagccatgtatagtagccagataatataccctccccacaagatgtctatgtcctaatttctgcaatctatgaatatgtcaagttctatggcaaagagatgtgaaggtggaaagttgtattaataatgctaataagctgactttaataaagggagattatcttggattatctgggaggacccagtgtaattacaaggctttctcagtatgtaacgaaggaggcagtagggtcaggatcgggtgatgggatgtaagaaacactccagctgctattgtgggctttgaagatggatgaagtggcagcaagccaaagaatgtggacagcttctagaacggaaaagaccaggtatgacttgtctcctgcagcctccaaggaaaggaacacagccctgcaaatgccttgatttttaggccagtgagacccattcagatttctgacatcagaaccagagataaattcctgttgtttattaaggttctaagttgtggtaattgttaaagcaacaaataagaaacaaatacttgattttatttcctaaaagtgaagtgctacagtaaaataaataaataaaaaccttaaaatttggaaatagttttggaattaggcagttggcaaaagctggaagaattttgagaagcatgttagaaaaacgtctatattgccttaaacttactgttagtagaaatatgaatcttactgactctggcacaaggacacagaaggaagtgagaagcatggtagagaaaacatgcatgtcttaaagaatacctaaatcttcatcaacagactatttgtggaagtatgaagtttataggtgctgatgacgacagctcaacagaaaatggaatatgtgtttggaaaccgacggaaagggtatatctgttatgttgaatcacaaagcttagtagaattatatcctggagttatatggataaataaaaaagcagaacattatgcaattaacttggatatttaactttaaggaatttattgtcaattaaaatgtaagccccttggatgagattggaaaagcatgccttagagaataaactgagctggacaactttttgctgatcccctagaaagatcaaaagatcagagaattcagtctcacaaaaggctctttgaaatgattaggagtgtgactcataaagctcttcagtcagtcatctcagcagaatccaaaaataggatgagattatctagaaaaaaaattctatgaagaaaatctttggctaatggagtgaatctgaggacatacacaggagacacacatggttcttgagaatgttccatcagcataaaggttgccatcttgaactaaaggagacagatataaagattgaaatggaaaaagggcgtcagaactttcaaatgcctacaagcaagaaacattcttatgtaactattcagctgcaggtgtgctactgtgtcagtaggctgactcaggaggcagaaacctcaagtccacagggtggggagttaagtccagaaggtagagctcaaatgacagagtacagtctcagcccttgaaaccaactggaatttgtcaactgtatttcacaactgcttggaactggtgaatttctttctttcttttttaaattcttctactttttcttattttgagcaggaatatccatagatgttattgtttgcctgccctaccattgtgtttttggagccggtaacatatttcttgaattttatggctcaacgatggagagaaattgtgtctcagagtggatcatgcccagaccctcactcatacctgattttaatgatgtagatggtgtgatgtgggacttttgagctgatgaaatttggactttgagttgatgctgttgagacttttgggcaacatgggatgggtgaatttatttcatctgtggggttgatatgaatcttggtggccagatttaggattggtaggaagaaaaatgacacataatggtgtctgcattttgagtctggagcctgtgaatatgttatgttacatggcaaaaggaaattaatgtcgccatcaagttgacttgatgatagggacattatcctggcttttctgggagggcttagtgtaatataggcagccttcaatatggaacagggaagtagaagtgtcagtgccagaaggcacaatgtgaaaaagactcaaattatctctgttggctttgaatatggaaaggcccattagccctggaatgtgggaagtctcttgatcctgaaaaaggcaatggaaacattctcccctagggcctgtagtaaggaacacagctctgctaaaactgtgattttacctcagtgagatacatttcagccttcatatcactttgaggagtgatacagaatgtaaataaacaatgtaaggttttactggtggatggatggagaacataataatttgggtctaccagtccaaactttgaaaataccttcgttccaaatgcaccaaatgcaggatacacagttctccgttctggactttcctacacttagattaaaaatctatatctagataactgtatgtgtatatctttttatatcatctgattttatatgaatgccatttttatgcataaatatggctaaaaccccaacagaataacttgcaatccttcccaaagatgtgcatgggacagtggtgtttttgtttgtggcaataatagctatttgtagaacctggcactctttaaggctctgcctcttcatggcatatttgcctgatgcctttgcttcaaaagagctatgctgtctgttctcacttgctcagctggctcgcttcccaccattccacagctctgctgacttgcttgaaattcagcttcaatgtgtcctcatggcattttccctttccagctaccttcagacacctcacttccactatactaccccaagaatcacagagtgattacactaaagtatgactgttcacaatcagcagggcatgtgcccacgaaagaactatagctgactttttaaagcaggaggatatattagtcataaatatgtcacttctcttctgttttctattcatcataccccaaatcagaagactgttctattccctgggaacttttcttcagaaatttgcacttcaaagccccaagagttttctgtaagtaattcagagagaaatgcagttttacaggtgtgataacaaaaaccagtgcaaccttaaaacattctccaacttccgttttgcttgcccatgcagtctgaaaggaatgcgtacttcctttggcaaatttggcgcgcaaacaaagtagaatttgtggaatggtcagtggctgtcccgatgaaataggaaggcacagatgagggttgccatggcaatgataagtaagatctaaaacagagagaatttccatgggcataaaatgaactggtctttcagagatctgctgttgtaaataataggttaactggtgggaaaattatttctagcttttttgcacgtgcacacgactttctcctaataatcatccttaagtaatatctgcgtctcaattttaaataaaaaaagattataaaaaaatacaaatatgcttattttctgtttataagtgttttacctttgacattatttcaattttgtccattttattctttctttcacttacataagcaggggctatgcatcttcttttttttttttttttttttttttttttttgagatgaagtctcactccattgcccaggctggagtgcagtggcacgatcttggttcactgcaacctccgcctcccaggttcaagcgattctcctgcctcagcctccccagtagctgggactacaagagcacgccaccatgcccagctaattttttaatttttttagtagagacgggatttcaccatattggccaggctggtcttgaactcctgacctcgtgatccacccaccttgccctcccaagatgctgggattccaggtgtgagccacagcgcctggccgcatctcttttattgacaactcctaggctgtgcctcttccgtggtctcctgcttgctcctcttggctctgaatcaacattgtatcttttgacccagtcagccccaatctttatttttttggtttgctctcacattttctggaaaaaaatccagatacagtttctatctgaactgtttatgagccttcagcgtaggagatatgtagtgattatacgaatagacagggtatttagtttcctgttaaacttgctggcactgacatttatgttcattgtgctagacttttcagtctctagcttgaattggaaatagctttctattctaacaacaatgtatatattctcttctagactgcaaagtaatacgccataagggccaactcttaatttaagacaatatgattataaacatgtgatttgctctgttgtttgcaatatctcacatttagtgtatggtttggatgaaatattcttttataccatgttctagaaaagtttctcaatggtttgaagttattttcctgtaacctatacttccccagaagggaaaaatattactaatcatttgaggccatacttcactatacacattccactaaaaataattttgtttgagttttgccattaaaatatgttacatgatgctcggttgttttgagacatactgaccagatgccaaatcattgttgtggtctatttgtgtaggtcttcagtttttcatatttgtataaacttagatttttagtttcatataatattaaatattactatcatatatcatttatttttctatactgtatatgttatatatacaatagttgcatgaaacatagttaaacatggactacagtgctaggttgtctgaggtggaattctggctcagccactttctggctatgactttgagaagcagcaatcgacttaatctctcagagctccagatttctcatgggatcagcacttgacagatagcattacggatttttctccctaatgatacagtcaggctacttatattacttcacaggtggtcacatgagatcacattgaaacctctgcttcatcatttcacagattcattcaacaacaggttattaacccatacttggtcattaaattattactgtatacaaaatgttgagatgttagaatggttgagatgcagcatctgctcttgagcttacagtgtgtttatacccagtttggtgagcgccatggcatgtgcgtaatgtggggtgcacctggaggagaagtgggtaacacttgatgtcacgttaagacctgcgcttcagtgctgcttcccacagagccctcactgtgtcctcaggatggatgaggtgtgtgacgtgctcacgtagccacagctccatcacacccttgtgaagtgcactgcaatcaaacattctttctctatatggacaccaagcttcctgaaaacaaaaaaacaaacaaaacccaacaacctcggtttacatctttaaatttccagtgcctcatcagtgtttagccacaactgatgcttaatgaaatttacctgaatgactatctaaatgagtcaacgaatgaataaatgaataaaatgaaataaagcatgtagaatgagtgagacgccagatacgaaaaaatctgttcatgcgtatctggtagacaagaccatttgaaaagtaggtgtgtaactttgaaaggagaggaggttaggtaagactgaagtctgattcagattgcgaacaactctggaaatcatgccagtgattcacagacaattttagaaagtgtgggaagtatattaatgttttaaattgaatagtgatgtttgagacctccattggaagagtgcgatgtatcagaatgtggatgattgagcagagagagaacaaaggaacagaaaaataagacgattaaaatacaattaaaaatgatgcaataagaaagtgttagaagcaatcttacagtagtgtctgtgacaatgtagtgaaagaagaaacttggtatcaataaaatttggtgagatgaagtctgtgtgttgagaaagagaagtagaaacgactgtggctgctgttcttagtaatttggtggttggttaatgtcatatattttgctggaaaaataaaagaatgttctgtttgcttttaaagacgtttcaagagacgtaacaatgagatacctttgtgagcatgtcagatatttagaactgaaacagagaatagtgaccagaaaaggtggagagaggagcttgttggagaactaagtacaaaactgcaactactgagacatccgcatattaaaatagaacattatatgagtttgagctaatacgcttatctaagcaaattagaacacggtgttgtgtattttggaattttacattttattcagtcctagcctcttatcttacaaacaatcttagcgagttaccaattggcaccagttttttggcgggataggtagactgaccctaaaaatacgctttatattttaaggtaagggaagagtttttcttttgtcccatgcttgaagctttctcctacagagggacgtttttttctgaattatggcggtagctactttcctgaggctggttaccaaaaaaggagctttcttggtctatttctgaaaggcacaagggtacacatgagctacaccgcatatgaaatgaccagatcatgtactaatattgggtttagtagttcattttttttccggtataactttgtcatgcttccttttaggaatggcctcatttatttctacctacttttgaaaatatcatagtatctctattatcaggatgatttcagatgtcctgcaagatttgaggaaatacatttggttcagcttttaaaaaggagggtggtagagaaaagagtaactttttttctattcgttatttccttgtcatttagacaatatttgctttactcctctatctgttgtttgattctctctgctaggatttacactaattgcaattgcaagccatagcacagtaaagttaacaatattaatgaccgttgactacaatttaagtgatcggcataagaacgggtaaaatattttggaaagcatttttgatacatattcctacatgtttacaaaaataacttctttcttatcaagcatgtttggttttctttattagattaaaacatcccctcccaaatttccccataaaattttccagcagaataatatgtgataaattaggtactcaaaattaattcaagtgaaataatggtataatgaggcagtgatttctgctttctaaaaatgccgttataagaaattcatcttaataaaagtaatgaattattgagctcttattatatgccaagtattgttcaaagcactttgtacgcattgtttcattttagtttatagcatacctatgaggtatgctatacctatgaggtgtgctatacctatgacgtattattgccatccttatttgggattaaaagacttaaaatgtttaaatgaagaacccagattcatctctctagcaaagctgagatttttacatgttgagctatcccattgtcaacaagtaaatgcctattggcttcaggcttaacttctcaaagacaccaatttgttcaatctttgtgattctattgggatgatttcagttgttctcggtgattctagaatttatctttgctttatgctcttaacatctttgatacaacattaataattgtccctatatcatgatttaagcaaaaatttcccctggatttacaaaaccttaattatggtattattgacttcatcattggtggcatcatcatcatcatcatcaccatcgccatattagccatcaaaaataataatcaatattagcaataacagtgcttataaattatatcccatgagtttattcgaaactcgtaacaataatattctttgttgtcatacatgtgtatacatataatatataatatttacaacaggaaaataattccctcaatcgatgtgttgtcaactagtggaaaaaaatgaataacagtttcaaatactgaggtaataattgacttcagccttctttattttgaacatttccccccacaggcactactctgcatttttgcataccttaaaacaattaattttgaaataatattaaacttacagaaaagttgcaaatacagtgcagtatcttccctccctctcaggaaacttctgtatacattttatttatttgttttactaagtggaaaaatagcatcattcagctttaccttttcataaaatttcagaaagagctaaatgtcttttttcttagtcacatttccttggccatgaatttcaaggtggcacaagcccttggtgtagttgttgctggcaggtggcagagcatgtgacacagtaaaacaaacacagcagataaaggaaagcagatttggaaagcaagatggacctgtgattgttccatttcgggcatgctccatcagtgagaataaagtgactttttttttttttttttttttgttgaggtagagtctcactctgtctcccaggctggagagcagtggcacaatctcagctcactgcaacctccgccttcagggctcaagcaattctcttgcctcagcctcctgagtagctgggactacaggcgcacactaccatgcccggctgattatttcattttcagtagagatgggggttttaccatgttggccagactggtctcaaactcctgacctcaggtgatccacccgcctcagcctcccaaagtgttggggttgcagacgtgagccaccgcacccggccaaaatggcctttctgagcttgatttctctgccaattgctcgttatactgcttgatccaatttctcaaggattaaataagattctgtaagtgtaacctgttcgaaaggatcctgtgcagcttcttctctcaccgtggacctgtttatagactggtctcagaaaccatttcatcctgccatctcagaaaacacaaatataatagcaaagtcattgatccacaatgcaaattttgttcaagcttctcaagaacctgggttaggtaattacttcaaataccaaaaaacacatttcctaaatatattttttaaacacagtctggccatcagcctggcttcagcttcctcctctccattcccctgaagaccaaaacagcagctagaagaagagtagtcaccaaaacagaaacttggcagttaaataaacagctgttgttcttgaggcttgtgctgctaataggggcaaggaaagaactccctcttttgaaaattatgtagaagagtgctcaagactacatgggttagtgggactctgcaaatggtagttaacagccttacatttaactatctgatagttgacgttcacctgttctgcttagtgtgtactaagattttctttactgtactattgtgatcatttctaatatcagtcactctacctgaatccctaaaacaaacattgactggtctcactaggaaatttaccctacttcaccttactttaaacttcagttagccacaatcttttatctgaatggttggttaagtctaagaatataatttccaagaagttctttctttttaaaaaaaaaaatctctgaatttcctgttggagcaaattcaaatttcctgttgggttatataatgcatgatttgtggaaaatttctctaggctactaacaggctttttaagatctttataaatcaccctcagtaattgccctcctattgctcatatcgttggaaggatgatgcttgaaatgtgagatacttgactggcactcagcgatttgtttgttgcagtgtttgtttgcctttaattagtgctctgatcatgtggatgatagcttctgggctaggtcacctaactgcccgcatgtagcaaatggaaaggaggaactgtggtgagcccgtgggtagcttccatttctgcacttcctcacttgtctgccaggctttccttttcctcagttctcacctcagaatcttatctggtgtctcaatcatgcagacattattctgagctagtgtcctcactggagaatgtccctgtcaaccaatccttactgatgaggaattttacataatgaggacttttattcactccagctagggcagtctgcattttaaatgaggattcacaaagactgaaaaccatactgttttcaaaggaattaaatgtggaggatatacttctagactataagacaagctacagagaggcagaaacaactgaccaacagcatcgcagcgttctttagctcctatagttcatgcatttattaactggatgttcattgagtacctactgtatattaggcactggaagcaatggataaaaagtctgtccctcttctccaggagtagcagacaaacagaaaatataattatggtaaatacaaagggctgtggttaaatttaggacaaaaaacttataacatgtcttaaacatgcttgaaaatttggatcacaggaaaagtttgcctcttcccatttttctgttcctttcatgtagatattactctatttacactctatctataccttagggagggtgtctgcacctttcatgtgacaacagttaaaagaaataggcattttagaggcaaatgagttttattgaaataagagaaagttatctcaccttcaaagcccatgttctgataggccctggatcaagaacttgtccatgtgaccttaggagtcctttaggcacttaaacctccagttctcaaagagatgcatagaactttctgtcatccaagagtgttgcagcttcagtgttttaaaattgtaaaattgttcactgttccattaaaactgcttttaagaacatttatcccttgatttttcaaaacaaaattgtatcgtttttcctgtgttcctgttgtatagatgaatcattcaaattttggagtagttaagtggcttatgcacattgatacaactaataactggagagctaatatccaaacccactctttataactttaaattcttcttgcttctttttactcatactgggattcagattcttcatttcatactcagtagagtttctccttgatacccagttcttaacaacagccttgggataaaaaaattgatcatttattttattaactttcttttgacattaagcaacagtttaaatttgttaaaggtcaagcggttgtgaatgcttagtggtacagtaggaaaataataataacaacgggcaaaatctttttagatcatttatgctttatctgttttagcttctaaaacaatcctgaaggatgaataattatcatgagtatagcagagtttaattttccctgttgctccaaaattttaatgaaaactttacggttgagagaaataggtaaataaaaaaacttcctaaaattctaaagacaattgttgaataaaatttaagtaaatgagtttgtgcttcatatttaacttttaactttccaataggctttattaaatggaaaactgaaatttacaaagtcttagagtagaagcatttttatcctggctagggattctctaagagaaccagtagcaccaagatgcactggaacagtgcaacaagagagttcatgccttagggtttagaagcatacaagcaaagggaatggtgcccacttcttactagaaaaatttcacaggctggagtctgggcggaggagcctgggatgacagtagaagtgtgcaggaagcactaagtcaagcctgtactaccacctcttggtttaacaataatgtataagttacctacaagccaagtggtcactgctgaaaccatcttgaaagaacctgcccatccaggtggcatatcagggagatgaaacctagagatgtcacaagactcatcttaagatgtcagtcaaagagaattggtcaggaaggagtccaaagtgctcacataactatgtcctctgagtgagaaccgtgatgtaaatacctgccactcacaatgtattcatctgaagcctagagttaaccacagatatcaccagctaaaggtacaaactttttctcctttgtctttaacctctttcttagctagggagttgcagaagatgagaggggtgagggaaccaggaagaaggaggacaggcttgtttcctttttctttctgtaggtctctcatagagatacctgtcataggggatggtgatggggacggagaatgttttgtgtggctattgtagagatacctgtcataggggatggtgatggggagggagaatgttttgtgtggctattgtagagatacctgtcataggggatggtgatggggacggagaatgttttgtgtagctattgtagagatacctgtcatagaggatggtgatggggagggagaatgttttgtgtggctgttggctcttacgcagctttactatcagaaagtgagtcctaaaaggtttttgttggtggtggtgtttgttttttaagaactgaaaatctataggatccccccaagctctcattcaaggacaaggaaaaggaaattctacattagccagagcatataattggaaataaagtaatattattattctttgaataccatagagataagttcagtaaatcagttacatatataactatattcctatattataattaagaaaatagaagcttgggaaagctaagaaactttgaccaaaaatcagccactttaaaaattgcagcctaaaaatttccatcttgtgttgtctgactctaaaccgttgctgttaacttctgtgcagttcgtcctatgaaaatcaaaatgattaattaggtttagtcacagatattgtcaccgtaaggaagaataatactttgactcagtttttattttactgaccaatgcaatgattactttttcttatatccagaccacttggcattcgcttatttatcttactgcattttctatggaaattcaattcagaattcagagctatgtaccaggaattccctagatgtaccctgcacatgtttatgatgtccaaacttgcgctcatttgccccagatccccaaatgaatgccacattctgaaaaataccccaagcacaagttttttcctgtttattgaacaatagcacaatattctcttgtgaacaatagaatattattattctgttgaacaataatacatcttgatttattgaagattagcacaatatttacacggaaattcaagtccacatcacacgagacatatttgacttatccttttccttctatcttcagtcaatcacggattcctgggggatctgcattctaaaacttctcatgtgcttttccttttctccattcctacaggcattacatttgtttttgtacccagtatctcacctgatcaaatttaatagctatctcctttctttcaaacatcttttctattgatgtagcagagttagatccgagatacacgaaacaaaaatctgattgtatccatccccggattaaaattgctcagtagcttagtataccgtttcttaccatgacaatcaagggctttaacactctcatccctgtctgtacaaccagccttccttcagtatcctccctctgaaacaagtcctccattcatgcaaaacgatttgcaatataaatattctgtgctttggtttatgtttatcctgcctgtgatgtccttcttaactcgttcatttatttatacatttattaatcagataaatattatgtacttgttctatgtaagcttctactgtactaggtactgggaacacggtgaatatccagaccaatgtggacctcagtcttaagaacctcagttagaaatattaagtcacatatttaaatcattaattaaagttacaataagtggggtaaaggagaagaagaaaatgtataaggagagtatgacaagtgtacctgaactaacttatgagataagtataagacttccctgaaaaagagacttcaagttgaggttgataggttgatggaagtcaaccacgcagaagaatggtggatcacgggctggcagagaaagggggagcaccctgggcagtggaaacagcctgtgcaaaatttttgctcagaggtgagaagcagcagggcacgtctgggctctaaaagaaggcggtgagtctacagcatgggctgtgctcaaatccaagtactggaagatggcctacttgagaaattctgtcttttatgaattttccctgaatactactccttgagtcattccgttccttttaccccttccctcttcctacgtcaaggccaagaagctgccccgtctcagtgttatcactgtaagagatatgcatgtttcttgttgccctctcacactgtgttgtaattatctctttacgtatttatttgttttcctctcacgaccctgtgggatttctaaggaagtaaccataaatcatatgtgttttccaaacattagttatagtgtcgacacgtggaagaatatacatgaaatataattttcttctcacccatttatttctacagttactgcagtttttacttgaatgtcccatttcttcctcaaatttaagaatatcaatatttttgcaagaaggtaatgcttttgttctgcatttatatttggagtaatggttctgccaacttcgggctcaccaaacaataaaccgtagaaatacccatcattcttccttctcatttcacctctacatccttcagaaaggctttctaattattccttgaatctatgtcttagctttctacctcagcactaattcaggctttcctaatttcatacctgagttactagaatagaataaacaggagttttaacttgtattcctactttggatttgctcctcctgtattacccaaacagctgttaaagtggacttcctacaattcatgcctgatcatatactggtctaattaaacttctttaattacctctttgcctccagaataaaaggcaaactccttagcaggatctacagagtgtttcgtgatctctccttctccatcatctcatctctggatgctgtggtgcccagaacgttgatctaacaccatcttgaagcacacatgctgatctccaggtgcaccacgatttgtgcccttgaaaatgctgtttgctcaatctttctggagaaagtttgccacatattcggacttagtaaattagaactcctaccttgaaacccagatgaaggttcaattttccccaggattcctttcctcaccattctcctatgtgagggacttcttgtattataatcttttaatataatattatattttatgtaatattgtgttaaattatattgttttatgtaatatattattttaaatgttattttatatatgatattaaaagattataattatataatctttttcgataatttattcttgtattacaatctttttattataatagtctccactctccccaaaatattgtgaattcttcagctgaggagttttgctttagtttcttatcgccatggactgggaattaacatgtatttaacacattttgctcaaacaatcaaacagtaaaagctgaagagagcgtattattattcgcccattccgagagaaagttgaagatgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaaaaatattgtccgaagctctaaataccagagtattgattttaaagtctgccaagacaataatacaagtaacacaactaagcctttctttaaataataaaacgagtatctaaatgaaaatatatctgtctcttgtaggttgggtgttaaaatgttgtattcactttggacttgctaatttatcataggaatgttaaagaggtggaagtcgtaagtgtgaaaatacatattttcaagaaagaaattgagctagttaatgagatatataataatgttttgtatggggatgctacaccagctatttcgtgcagggacgtttagagtcttcagttgtacacagttgttttaaaatgaagactagtttagtaggcccccaaagaaggcattaatttttcagtttttgaaagtcagcggatatatgcacgacaaaaattccatgccatccctgagtcatatcctcttctggttctcaccccactactgagaacctgagataataggagagtatgagcaatgtggcaggcctgtagttgggttcggggatgtcgtgagagtcagaaaagcattgagcaacagggagttagtgagagacggtaatggagtcagaattcatttactaaaccagttttacttcagaattattatggtgcaagcatggttcaaaatagggcagattagaatgaagaagatagagcttgtagtttagtgggaaatgtgacattaaagtagaataaagcatttggggtcatactggagaaaataggatgatatcagagaatacagcaaaataacttaacggcctagaggtcagagaaagtcttcttgaaatattagcattcaagtacagatctaaagtaggaggatttaaccaggtgaagtgcttaaatgtcagaaatatctatgactcaaacagcttggcagtgaaaaacggtagattcatattttgggaaagctgttttgtatggatgtatcaatatacagatgcgtcaaagtttcctccagttctaccgatgattacagagaatttaaataacatatatatggagtctttaagttgaattcacaaaagtaataggttagagctgtgtggagactatggagactacagtccatctcttgaattgatgacccatttttcaactgagtgttgagaatatgaagagcattagagacatttacatagccttctaaaaatgtcatccattttggaaatagaagcctgaattctagactatataaattatgagacaattttttataaagtgtatctgtctgttcagaaaacatgattatgattaatttgtgtataaatctgtatgtttattacactgctctactatacatgtgaaaatatgcatataaacctcaacactataaagtttggtactaaaaagtgaattgtaatcaaccatacttcagcctgtccattaatagcagcctatacaaatgagagcagcaggcagaataaattgggttagtctagtcaaacatcaatcccttggatgacactaagaagccagaaaatgttgtgtaacaggacttagacacatcaactaccagatgttacctagaagctcaagagacagagtcgtaagatctgcttattgcaatgtatgggttaataaaatctaaagaggactacttggctattttttaattcttttgaagtattatttagaagtggtttttcctgagagataaatgtaggtaaataaaatctgaagggtttatatcactgagggggaaaaagaaaaaaacttgatctttatgagtgtaatgcacctttctctaatttcagacctgagacttactaactgttacaaacaataatgtttttcccaaaatattttgagtcatattaaattttttagagtgctgttgtggaatttttaaataaattttagggtgatttttattctacttttttaagaattacaaattattttatatggcctcaaattttaagaattaggaaattggagaattagcaagaattctgaatatatcatccaattcatctatcaattattcatttactaatgtgctaagcactagagttaacaaataattgaaaatcagacactatttatatcctacttagggaaacagggagtaccatgtgattttgtcataataaagataagtacatcactttaaggaagtaagggcctttaactcaaactatgctacaatatagaataacactttcaagagacaacaccaacacttatattgaagcacttagaagagttacctaggaagaaggcatgaaagggaagttctaaactatatgactacaatacccaaagacaaatactggcattgcttttccaccacaaaaattgcaagtgatttagtttgcgtgaaataaaagctttgcacagaaacgtaatgaggaatatgtttggaaaagttatacaagatgtatgtgagtgttttttatgctaatctaattgagtttagtcttgaaacaatgaaactgccaaaatattttagatacgaaaattatcacatttgagacatagaatcaccattggatcacaagatagaaagtatattgggagagggtggaattgttgatgagttgggaagctgtaaaagatgtccaggtgaattaaagtactagtggtagcattgaatatgcacagggagatacagcttcagaattacagagatgttaaaatttataacatatgctgtctgattgtctgaaggaagagacagtgagttatattgctacatctttcatttgaggtacctttgagatatggaagtggagttaacccagtgtcttttatctgacacaccagactgtaattctatgaagaaatagatcattttcattcattgttgtggcttcagttgttaaataggattttacattgttagaagatgtggtctgtggaatcagatgtgttagtcactggtatggaggtggtggtagaaatcatggatgtggatggtattgctcagctaagaaatatcgagaaggacgaagacagaccatctgagtaggtttgctggcaagtgaatagatgggctgttgtttgaggagccagaaataaatactgaaatggctggccagaagagcacagtgaagtatcaggtagtggggtaagggggtcttgaaaaccaagaggaagagacatattctgttaccttgatgaggtaatagtatacctcatcaagaagattttgcagtcagaaggcataattgacaaccctatcaagtacagtttttcctgcagtggtaaatgaaaactcaatgttcagagaagaaaataggggataaaaagtgaacaactggaacccataagtgtagcataatctttcggaaaccttttctgtgaaaggaatcttgtgatggaaggattaagaaagaggagatggtgaatttgagggaaaatgcagtcaaagtggaggtggttaaaattcatcttttgttgctttatgcaagactcagttcaactaggaatcaggattaagacagattttcatatgctttgcctgtaacctggagaaatccatcccctccccaccacatcctacctccacaccaaaagctgctcctaaaaaattctggcagtcttctgtaatacatctgttcattgaggaattgtaagccaaccctcagaccttatgatcattgttatttttgtcatttgtgtttgttttttggactccttgtttagatgccctggtccctttcaccgcccagcaaaggtgatctcacaaaatttttctgaaaacacatgtggcgctactgatgtctctgaagttgtggcctccctgccaacccgtttctggggtttggacgctgtccagggtgctgagtgtgtggctgcagcctcaacagcctttgccaattttgttagcaccatgcctactctcgcaagccggcaccaagatagcactgctgttcccgtctcttgggagggctgcttccttccctgtgccgccgcttcctctatgctgtggacggcttacatgcatgatcctctatgatgataaagccataggttttatagtacttccttcatatttcagccacataggtagatgtgggcctgaattgaggcaatctcacagacacacactatgatccaccccaaatccctttatcttgaacctttatttgtataaccaagagtctgtgtctctttttgtgagtgaagtttattattttcctctgtggatacactgcgaatatattcagaagtgtgccaacctgctgagtcaatcctagggtaatgcagttttgtctgaagccagaacttcatacttatatatggtgtgttgcctttagagatgcactgatatgacagaacaggaaagcaagagcagctctgtctcgcacacccagcttagagcaccagcgtgaacactgtactccctccatttaagaggtgcccccaaaatattattttgttacttagagtttttattctgttcttattattccatattctttcagtttatcttttggcaaaggagcagctaattagcttgtattctaaaaattaagcatatatttggggtaaaccaagcatagaactattttaacagctactgtagaacctaatgtgatatacatttaaatatacatttaaatttcatagtgttcagaaaatgccaggtgtgtccaggtaaagttgttaagattgtaaaactgctatcatagcagtaatgataataatgatacataatatcataataagattgaataactgattggagtatattagatatttttttctctttatcctgaaaacagttaataattaactttttaagtttctttaaggaaaatcaagattgagattttggttggtctatagatcagcttgaggaaagtttgcatttttagtgttttgagacttaaatttcatgaacaaagtagatggtatgattattcgcttatttagatgttatctaatgccttgcactaccatttaatcctaagtcttttaaaatgtcttcttcaatccattctttttttataatgattgtgtttttcaatttctgagtgaaattatttttgtttataatttctaatataagttgtgctgtaataaggtaattggagtgttcctttttcccatttcatttggtcactcaaatgaatggtctttcttgcatttgagactgttaaggggtaattttctttcttaagattttttttttagaacagttctcttggagactaaattctccagtgtttgcttattctctaaatatcttcccatttccccttcaactgtaagaaataattttgccaactgacaattctaggttgacaggtgttttctcccagatcttagtagaccttatttgactgtctgttggctttcgttttcgctgttgaaatatctgcagtcatcctgtcatttcctttaattgacatggcttttctttctgtggcttcaagattttatcttcatcttctgtgtttagcaattctattgccatgtgtctaggtatggatttccttttgtttatttcttttgtagaatacattataccttctagatcagtgacttcaaatttttaatcacttgtcaaaaaatgtagctactatttctttaaatattgccaactttcaattatagtttgaaaaattttattgaaaatttcactttgaatatctttgtttttgtagtttcttactgtgttacatttttgcaaatgtttccttttaaaacagtgcatgtatatctacagtagtattctgtgtttgataattgcaaactccaagatttattgtatgttgcttctgctagctctcatgtatgatgatgttgcttctgttttgggagctcttgatttgctttttttttttcttgagatgcagtcttcttctattgcccaggatggagtgcaatggtgcgatcttggctcattgaaaccttcgcctcctgggttcaagcgattatcccccgtcagcttcccgagtagctaagattacaggcatgtgccaccacacctggctaatttttgtatttagtagagacggggtttcgccatattggcctggctggtctcgaactcctgagctcaggtgatccgctggccttggcctcacaaagtgttgggattacaggcgtgagccaccacgcctggctgcatttttaatttattgctcttacgtggactaattttggaaaatttcctccaaatatggcttgttctgtttctgcaagtagcaaaagataacatctgaccaaaacaacttcaacatagctcacaagttttgatgcagaaaagacctccaagcccagcttccctttggagttcttttccaaagtgcaaaattctcacagaagtattgctgtaggagtcgtaagtcagagcaactgtccctttcaacatgcccaaacagcaaggacaatttcctgtaatccttttttcccctttctttttttttttttttttttttgagacagggtctcactttggttgcccaggatgaagtgcagtggcatgatcccagctcactgcagtctcgacctctgagtctcagctgattctccccactcagcctcccaagtagctgggactacaggcagacatcaccatgcccagctcattttttgtatttttagtagagaggaggttttgccatgtttccctggacagtttcttgcaatcttgtttctcaaattttctcctgctttgggcctggccccttgctgtgagttccagatactgtactgcaggtccctccaacccaggctacaaccctatggaggggctccacgtatggccatatggttgtttggggctggagggtcattctgcagttgctgagtacatggaggcctggactgtaaagagactacggaaggggcagcatgtgtgttttgcttctcagattcattgtcactcacgttgcataaagtcctcagttgtttttaagtaattgttttactatggatatattaaacatacagaataaaaaagggaataaacatacaatttggcaaaccccctactgagcctttaaaaatattagaaggttgatattaaaccaggtaacttacggatttggaaaaaaaaaaaaaagaaagcattgaatatggctgggcggttctctggggatccttgggcagacccagtttgccccgatttctcactgtagttttcaagaataactgtaggaggcggtgggagtgcagcatcctgagataagggagacaagccagaacagcgcgggcactgttccagcccccctagaaatgggttgatcttcagtgcttcagctcagtgtgtcatgcttcacccacgatgtaaaagcctaggatcggaggcttccccagggttcgtcagctgtggcacaatagggcccattgcaaataagattctattcctgtcagacagtttcctgagttgtgggggaacactcaccctaggcttctgttgtctcttcatgcctgtgtgttcctaatcaacttttttgtgtaacttgttgtttttgaaagtgtcaccagcacacagtgaacctgtctcacggaaacagaaatacagtccatagtttccaaaccatcagagaattaaaaggaaatacagaaatcgttatcaatcaaatagaaagcaagaaagagaaaaaaggaattgtgaaaaaaaagtggtataagaaaaacacaaaatatgagggtcaaaataactaacaaatataaacagaataaatctaccaatttaaaaaaacacgagaaaagaattacactgaggaaaaaatcccagcaagatagtgctaataagaaacatttgaaattaaaacctacagacacacatgtaggagggttgaaacttttaaatatgaaaagataagtgttaagtaaaagaaagctactaaaaagctaatatcagaccaattataatttaggataaaaatcattaataataatgaagggagtaactgcgtaatggtgataagaaaatgttcaaataaaataacaagctgtaagatatcaaaaatgcacccttaaaatatattaattaaaaacgtatttaaaacaggaaactagcaaaccacgataattgtggaacacttgtcatttctctaaatgtacttattgttttacactaatacaagtaagttatatgaaagacttcaaaaagataatgaatatatttgatctaatcaatgtgtttacaactctgcactcaataaaggaagtatatatgatttttaagaatacacaaattatatgcaatatttcaccatatatgtcacaaagaaaatctcaacacttactaaaaaaatctagtgttttaaatcacattttattttttaaacagaatcaatgaaaagatttttaaaaattctaagtgattgaaaactcaaaatttcacttttaaagatcgcatggttaccaggagaaagcaagataaacatgacaaaatagagttttgtgctaattcaagtattaacaaagatttgtgtaacacatcttttggcctgcactcaaagtagctgttagaacctaaacataattctcaataaataaggaaagtattgaagatttaggcattatctccaaaagtgagaaaaataatagtagaataaatgtttttagaagtagatttataaagaatataaagataaaagcagaaattaatgaaataaaacaaagaaactaagaaataataatacatggaaaatatggtattttgaaaagaattaataaaaattgatccaaaaataaaggtaaaaataaataatattaatgaaattacaatatatgagtacagttagattagaaaaggtgaagggttatcaacactttttgccaatatatttgaaaagttaaaataggccaatgtttaggaaaacaattatcaaaatcacttcagaagacatagaaaaccagcatcagctattatttgatgaagtagaaatcagtaatacttcaggtgatgtggaaagccccaggttagggctctgagatgtacattccagtctttgagttttcgcagattgtttttctttacgaagtcacttccttgtcttcctcaggactaactcttgctaatcatgttataacatcatatcctaaattgtgacagtttattttatatcctctgtttaggatttgtctttcttgtctatggtggttgatttatgagtccatggctgtagatttcttgttttattttgccttctacaagaatagttaataacttttcttgttctgttactctaaaatcaagaggaacttttatatttaatcccaaatctctttatttttaaatttttattattttttgtttgtttgagaccgagtctcactctgtcgcgcaggctggagtgcagtgcagtgatcttggctcactgcagcctccacctcccaggttcaagtgattctggtgccttagcctccggcgtagctgggactacaggcatgcaccaccatgactggctttttttgtttgttttttttttgtattttaagtagagacggggtttcgccatgttggccaggctgtttctgaactcctgaccttaggtgatctgcccgcctcggcctcccaaagtgttggaattacaggcgtgagccaccacgcccggcaccaaatctcttttatggcaattcaacttgctcttctagtctcaagtaatgaaataaatgtttgggaactattctcatgtgatgatagtctcaacagttaatgagtatttcccagaacactttctgttgttcaaaagggacttttaattctactgtactatgtatacagagccagataattatacattcaatttgggatcataattctaagatagaggctcacaaatgtattaaaagaagagacacacaataatagaatgccatggaaaggagactagaaatgaagtttacctgcagccaaattccagcaaaagatttgaatgtagtagttctttagtaattattcgataagtacccactaaatttaggaattctgggagctctatttactgagatcaaaacaaacaaacaaaaacccggcttattctcaaagtgtgtaaccaatctattagaagttgtggatgagtaaacattattactttagaacaaaatgctacaacacagacatgcagttgtacaagaagtcaagctcttgttcccaacactattttctacatagcagccagagtgatgtttgaaaacgcaagtcaggccaagtcacttctttacaagcccctccagtggtttttcattttgtcctgtttgtctaggacattgtgtatcgggagctgcaagcttctcctctgtttaggggcagagagtagatatttgagactttgtggccacatgtctctgtggcagctactgggctccatctttgtggcaagaaggcagaaatgagtgcccatggatatgttccagtgaagctcgatggacacaagcatgtgaattttatattcttttctcatgtcaccaaatatccttctttgactatttttaaaaatctattgaaaaacataaagaacatgtttagctcattaggtgatggagaatcagggagtcaggggaattttctgaccctggctcttcaccacctgccctgcccacacctccatccttttaactcccgtcttctcacacggccgcggccactcggggttcactgatgtccctttgttgaacgagccttgaggtcttgaaacatcctcttccctctacctggcaaactcttccccttgttctcaggctggttctccctcttcccttaggtccctcacgtgatctcagaggccttttctgccctctctgccttcccctgctccgctcatgtaagagttacctctttcacacctctcctacctactacctacctaccacccactgactccttaatcctagctaattttcccaaagcactcattgcttatcactgcatgacacttcatattgtctctcactaccagactattaatgccatgaggttagcaattttttttaaatattgcatcctcagtatctagcataatgtctggaatacggaaaacagccaataaatatttattaagtaacaaacaaatgggaaggacatgaaagaagtcagaagactgtgagatacgtgggaggctttttgggtatctgtatcttgtaaaagtaatgtaagcgcttaagaagtcaaaacatacagagatgcttgaaggaaaatattaaatctcccaaactccttgtactcccactcatttgagacattgtaacgatttggtaggtaaaatattcacactgttctttgtgctcaatagatatgagtacaatataaacatatacacacatgtatatgcctctccccatactctctcttttattattttagagaatttattgctattgcttctgctgttcttgtgggggaaatatgattatatgtacaaacttaacaatttataaacaagattacagaacagtgtctaccgcaagtgaagtcttcagcttttattcctatgacaatccacttgttttgaaaacaacagcacaattgatgtatgttttacaattacaagatgtgcaaaaccccagaatagaaaaatgtcattctcttttatgtctgagctcacgattttgcttggcggtaggaaagttaaacttatctagcgaattctctcgtttttcaaactcagatttaagctttggtgagttagattctttgaaactgcccctgcaaatggctcccgctccctgctccgcctccccacgtcctgcggggggacgggacggtggcggtgctcctgagctgtccttcttgttatctgttcttgtctgacctgtggcatggtgccgcccagtgcccgctttcccaggcagcttcctggctttgggagcccatatggagtcaggcttctcacccagtccacctgcccaccttgttggcagctgtcccactgagcccatcctttcccagcccctccaccctctgagacttgagccctagttaagctctcagataatttctgccatcctttctgtatccgtgggtcacacacaaattccactacagctgtaaggaaaagtcagggctgatccaagaccttcgttcctcactcttcaaagaagcctccatggttatctcgagtcccaggcaactgtgacaacagagctgtccaggaaaaatgcccctagagcatcacacctcagagagggaataacatgtcagcttctctgctcctcagtggccccactcccacctgcatagggcagtttttgaaaattaacaaaaagccaagtctgtaacccagttgagtgctgaggaagacatcccatgaaggccccaggctttacccattatgattcttttatgttaaattttagaaagacattttaataggtcagattatggcccttaggataagattacctgtattcatactctgactttgccacctgcttgctgtgtgacctttaccaattttatcagtcacctcaacgtctcacgttcttcaactctaaaaattgagatgatagccaccctatgcaatgagtattgttttgagattaatgagatcatcagtgttacatttctgacagagggcatggtgtacttgctaagtagtacatgattcttctggagaggattccttttttttttttttttttgagtttcacccttattgcccaggatggactgcaatggcacaatctcggctcaccgcaacctccacctcctaggttcaagcgattctcctgcctcaacctcttgagtagttggattataggcatgtgccaccacgcctggctattttttttttcttgtttcttttttgtttgtttgttttagtagagatggggtttctccgtgttggtcaggctggtctcgaactcccgacctcaggtgatccgcccacctcgtcctcccaatgtgctgagattacaggcatgagccactgtgcctggacccatttttttttttttttttttttttagttaatatgaagaagagaatgcttagaagaaaaaactgcttcaggagacagaaaacggggctaaggagaggacaggatataatttgtcagccaggggaggctgttccaagattaggaagctgaaagagctgtttcccaggcaagagatgggcagaagagatacgcaggagtagatcatgaaggcctttgtgccttttgtgtattcaaggttctaattaggagattttctgtctgcctatttgtctgtctatctatcacctataagtctatctatctatctacctagagatttattatgaggaattggttcacacaattacagaaattgagaagacccaagagttgcagctgacaagctggaggcccaaaagtgtagttccactctgaaaatcacccgactcaagacccaagaagagccagtttttcagtttgagtccgaaggcatgtcaagacccatatccttgctcaagcaaggagggaggaggagttctctgtgagtcattttgttctatccaagtcttcagttgaatggatgccgctcatcctcgttagagaggaccacttgcttcactgaacccactaattcaaatgttaatctcatccagacgcatccagagtaacgtttgggtacaggtccagagatcaccccccggccaagtggcccagtcaaggtgataccttttaccatcctgtaagttttcaaagctatagtaaagtagtctgatggctgttgaacaaacagctccaatagcaggagattgaatggggtggagtggagaagggaagagttggttttataatatagttatgtaaaaataacaaaggagaatgcgcacttgtatattccatcattgattttgctttccagtctgaatggtttccaacatgtgaatctcttcgtttaattgctctacatctgtgtacattgtaatcatttgaaactttagaaacgtgcttataaattttatctgcatacgtttattgttggtttttcctaaaacaagcaaagtaaaaattattcgtcctcctctcattgtctatatataaattaaatgaacattaaaggactctccatgtgtcaaaagaccattttaaaattttttagagtaccttatgaatttgaaatttctagttgtgtagctttcatacaaaacatattcttcatttcttttaggtacaaaagcaaaatagaaaccattttatctttctggtgccagatgagtgccatctacatgtttgatttttcattgcatgcatctctcaccaacaaaataaattttgcaacaaattgcaaattatttaataaaatgagctaacagaaatcaggtcttaatataatgtctgaatgtaatatcctgaaattagaggttcttttccattctaaatataaattaacattattttatgcatttaaaaagtatatattttttcacttttggtaagttttacttagaactttctctacatgtagtgtttctttttgtgtttaatattattttttggtatttttctcttactaggtggaaattttagaaagtttccaataacaaatttcaggagaagaattttaaacatgcaaattcaaagatgaaattgcattatattaaaagtttttatgctattaaatatttcaaatcaaagttttttaaatccagatttctttacatattttagtgtcggcattattagaattaattaaatgcttgatgactagggcaaagcttaggaatgttatgaagctatctcattttgaaataaatccagtatcaacgtcaaatatttttgaaatcatagaattatctaattataaaatactaatcagttctcagaatttcagcaattatagagctctttagaagcccatccttttttgtaacacaaggaaaggcagatatatgtaaaggtttgttatcaatatatatacaccattccaatgaaatgtggtacagttttcctgaataattacataggtggcagcactcccttatcctgaacatgatgccacaaaacagtcagaggctgtgggcttccacctaaactaaggtggaaggaagtttgagagagggagagagaaagagataaacagtaagacagtaagacagacagaaggtgggaagggaggagggataaaagggaggaagacatggacttagattcactcatggctttataaactaatgttagattaaaaaaataaaggacagctctatagagtttcttatgcaaaaacattttcatctgaaatttgtggaaaaatgtaattcattttaaacgtgtgtgttttaggtgtagaatacacatatacgcctaactatatttccattttgatatatttagctaatttttaattttttgtgctgttaaaattggaatattatacatataattgcagtgactattgtgagagttttaaaagaacatgttgcttgtttctataatttaatagataaacgaaaaaatgtttatataaagttataatgagcatgatattttatgatatgtatttttccccaagaaagattatatttcaagtacttttattatgaagccaatcataacatctcaataagcagtggattttctgggatgaaaatgtctcgtgcttgactttaaaatctggaaaaataaggttgcataaaatcttattttccaaagaatagtcgtgaaaatggtaaagtgaatatttttttctaaaaatgaaatcacatatgaaaatttcgaggaagaagcatatgacaggcttctacaccttttccactgtgctagtgtgacccaaggttagaatcctccacagtgaaatgtcctcagctgctcattgtgcctttgtagcgtttcttaaatataggaaagcctgttgccataggcagaatctgttttatgtgatactgtcaatatttttcttaatatcttgaaatcgcaagagtaaagcacacaaaagaatttggaacatttccacttgcaaatgttattactttaggattcttctaacagtgaatagacagcatggtcagattcattttatttagtacacttgcaaatttacaattatcactctatgtgtaagtatcttagtagttttgtttttactgattgtatgcatttttgattaatagtaactactgaaagtcaagcagtgcaaaggttacgaaagctgatcttatttaacaccaaaagaaaaaaaagatggatgatttcatgtgcaagatttttataagcccgagttgcaatcatctcaaggctcacctgcatgaggatccactttccagctcattcacagggctatagcaggcttcagtgctcactggccgttggtcagaaacaatatttccattctatatgggtgtcttcactgggcagtttaccgtgtatgaactgatgtcttttagagcatgagcatgttggggtgggaaggaaaaagacaggtctgagagacagacagaaacagacagagaaagaacaagacagaagtcacaatttttccaaccaaatcttggaagtgacatctaatcacttttcttactttcactggaagtgaagcactatttgttagaaatgagtcactaggcctagctcacgctaagaggtgattaggcattcggtattaatacttggtgctaccttacaggctccttcctatagggcggtttctgtctccatatgtaggtttttgaatatcagcaatcttttggtatttgtaccgaatctttactttgttggtttaaaaaaaaatctctaacatttagtggcttacacagtgacaatgcattatttatcacatctttgttggttgactagttggttcttctccatttggcaacagcctgagcactggaatggctgcggggccgatgctctcactcccatggtgggctggtgttcttggccatagctgggaattaagctgaggctgtgggctgtgggacttgattcgtttccatatggcttctgcatgtgattgatgaaatttcttcacggtatgtttgctgggctacaagagggagcatatcaacagtgaatgtttcagaaggtagcagcaggaaccgccatgtctagtgtcagaggctcagcatgttgctccattctattggtgaaagaagtcacagggtaaactcaggttccaagagaagaggaataaactctgcctcttgatgggaaactgtcatccctataaagggagacgaggaattgctggagagcatctttgaatatagacgtaccggagggtgccccctggctgtaataacccatatgcctcccacaggctgcatgcactcacccccttcgaagactctcacaagtgtcttctcatcacgacatcatcttagagtcttgtagccatcatccttactgggtccaagtgtagatggactccttggcagcagccaattggtgcagctcttcaactgtggttttctgaatgcagacttgagaactaaaaaggcaagctccccacccccagccagcccacaatgggaagatggtgggatgatcatagtagtcactcctaccaggaagagttaaaataggcccacagtggggtggggacccacggtgatgattctaaaatccatccaggcacggttgccttttcctttgacgctggcagcaggaaattctccttgctgctgcctggagaggttctccattgccattggtgctatgccctgaatacttggctctgctgtctgatttacccttcctccctttcccccgctcccaaatggcccatgttgcaggtcaggagctttcccagccttcttcctgactgtaggaggtggaatgctagggacttcttttcattttgaatggtctctgtccctttagataaacgctggtgtaacagcctttgaaattttgtggttttaccaaacaacataagtagtccagttcctcaggcattttccagcgtgctttgggatatctaagatttttcaaacctagttgagaagttgcatgaatgcttcttttttacacctttgtgtagctgtaacaaagtattttacagctttacctttgaattgtttgatttgatcttcctcttaaggccacactcagctcactctcagcactctgaaattcatctttgtccccaattccaggctggagagatagagaattgcagggggaggggtggaggagagggggagagaaggggacagagggagagagagagagagagagatcgatcctaattctgattaaaaattcttcttatgttgatctctatatgtaccttacctctatctgtacctgtctgcacctaagagaagacttttgacattttcaacattctgttgagtactctcattagtaaaatgtacaagtctattgtggatatttcctgtcttctacccaggagtattgccagactttctgccactaaataacacagctgtgttatatccagtaggattttcttacctgttctcccagccacaactgatagttttctcaggagtctttcaaaccctactcagtccaaaatctatgccaaaattcgtcctgcatatggttgcagtaatgtccactagtgtcagcagcggacaggagttttcattgttccacatacacgtgaaactcgatgtcgtcagtcttacatccttttctgttttgttggctgcttaatgggatcacacgttgttattttaattgcattttgtttattattaataagattaaatgacttgtattaaacgttttagaggctcaaatttcctcttgtatgaaatacctgaccaggacttttgcctgtcttatgttgtgttgtctttcttttgtatgctgatttatggtaggtctgtatatattctagatattggtgatatgaaggctataagtgttgataaggtcttgcagtgtgtggcttacctttttattctcactctggtgtcatgtggaggttgaaaattcctaattttaatttgtttattacttttatttttcatattgtgacttaatgaatcttcccttatagaaatcataaagcgattcttttttgttgtcttctaaatactatatttgcttacttttcagattttgatttttactgtgtggtgtgaagcagagattgagttccgttctttaaacacatgaatactgagttataccaacatgagtaattaaaaatagatcaccaagatagatgctgcccaaaatagttgagcatttttgccttttagcacagggatttaaaactgtaaatatccctgtaagttctgctttagcaacaccaaacaagttgtttttgtagtatttttataataattgttttactaaataataataattttaaatttttttttctttgataagctctgtccctatggtggtagatttttatttctctttgaatcctggaaatatttcattgatgcaatgataacattgtacctatgttattaggtatatatacatttaaaattcttgtatctctcagagagttgaatcttttggagtttaaaaataactcagttatttgtagtaatgcttttttccctgaagtttttctttattcctataattgccatatcagatctctttggttttgaatttgcataattcttttcctaacattttaaacagttacgtttccctaaattagagatgtttcttaggagcaacacattattagatttgtgttctagtccagttttctggtctttgttacttaagattgtgtttagttcatatatctgggtttagatcaatcctacattttatgctttctatttgttcctcctttgttttatttcttttttttcttttttagtttctacttttcttcttcttactataatttcctcatgcaatttgtctgcctttatttatttttggaattaaattactttttcccctgtcctattagtggttactcaagaaactacaacatatacattctcttctcaaaatctgctgtcattattcccttgaaaaacacagaatcttaagatgttatcttacattactgtctcatgatttatctgttatttttgccttactcttattattggattcagtgagtgcccatctgtttacccacacatttcttattctttattcctttttgcatctaaaattggggacctaatatcacttaccttctgcttgaactggagacttcagacattcccttagtgaaaatagatttttggcagataattctagttttcacttcagcttcattcttggatgttgaagtctggatgagcattttttttcagcttgctgaatacatcattccagtctcccgggtgccactgaaatcaggtatcaacctaattaccactcctttcatgagtgtgttactctttttctctgcatagtgtatagatttttttctttttcaacagttttgaaaactctaaataattatctctttaaatatttcatgcccttcattttctgctccctttctagaaacctgataagattagtgtctcactgtgtcttgccttttaacttctcctttattttctcactcttcatctgtctgtgcaatgcactggaaatttcttcgggtatctttgagtgcatcctttatagtcttattaaatctgtctattgagttttttattgcaattactgtgattttcatttctacatttatttagttatttttcaaaaacactgaggtattttttggtagtttcctattccctgcagatattttcagtctggtttgtaatgtcttaaaacatgataaacattgttcttttatggtctgtgcatggtagttctactatttggaatctttcaagattcatttcttctcttcgttttcactgttcttccctcaggtcttatgcgcctgtgattaactttttgctgtaaacaactcattttctttggaaaattatttgggggaattgtttcgggcctagaatgaagttatattcctgcagaaagtagttgtatttattgcagcccatgcataatccgtgtaacccttgtcacttaaatgtatggtttaagatatttggataatccgggtcttacgtatttgaggtgcagttctcctgtaatgacaagtgttgactgaaaattctctcgcacattgtcactcctcactctgctcaacagcaaggcatcgtccctcttatcattttccacagccccttcagtagagaaggagctggacagtctcacattcagctcacgtaagtggtggtgaatctccctgtttcagcttcatggagagtggctctctcatcagattcccagccttggttagacatctgaggtcctaaaaacaattattataaaagtactatataatcaatatcttttattactttaaagtaaatcctcaaaaattgaattggtagttatacacaatttatgtgtcatagggaatatgttatggtgatgagaggtagtttgttctgacagggctgttgactccaagagaaaacttaggagatggatcttgaattaatgttaggaaatgtatctagaacttcaagttttatgagttatttataggagaaactgaatatttcggaagaagttggcagcatcagaggtacattctagagagaccggattgaaaaatgttaagactgaaattaggaggactaggtggaacaaatgattggctctaagcattactaaaaaagaaaatataccaggaattgagaataaaaaaagtaataaaggtcaaaacttccaaagaaaggaattgatgtgaccttggtcattttgaggtagatgcaaggaactgttaagagtgaggaagaaaccaaaaagtcactagagtctaaagcctggatcacttaaaattcaatgatgacgttggcgaaaatcacagggaaaaagtggaagaaagataactgtgtaaattttggacgtgttggtcctgaagtggtaaataaatgttcaagcacaaatgtcaagactaactagcagtgaagctgctgcctcttttggaggtttattaagtccatggtcacagctgtgaacaattgtgcaatcagacagactgtgttcaagtactgactctccactgactaaacagtgcctttgagtcactttataatctttcgtgaacttccgttttctcctgccttcaatgagaataattgtacttatttcatataatgcagtgatttcaccacttaaacaccatacagtgaatgtagggaagttttacccacagttgttcctcaatgaagatgttagcatcacacttacaattgcggttttaaggctgcagtcactgtgggaacaccagatctcttaatgatatttgtgtgctcagagctgcttgcttcattcccacacactgttgaactaggagtcctctccctggtactgaaagcatggatgtaaacgagacagagagccaagagaaaggtctccaagaaccaaaagaaggtttcagaaccccaaatccatggattcattaatgagttactttttttttctttctttcagacagggtctcactctgtcacccaggctggattaaggtggtacgatcacagctttctgcagcctcgaacagttggcttcaaaccatcctcctgccttagcttcccaagtagctgggactacgggcacatgccaccacacccggctcgttttactttattttgtagagatgtgggtctcactgtgttgcttaggctggtctcaaactcctgatctcaaaagatcctccttttctggtctcccagagaggtgggatgacaagcacgagccaccccacctggccctactttttgaaatagtctgtaaaaatttttaatcatttaatttgtagcaatgtcactcattgaaattattgagatcaatgaaaggtagtttgtattccaaaacatccagaagaaagccatagctgatgggagtttcttttggaatatggaagctggagagtttctgagttgagaggaggctgtctgtgtaaaatggaaccgtaaagacaataaagagaatcattggtagaatgagagtgcagagatgagtcatgggtttcacgttacagaacaggtggtgccgttagggtgagtgggcacagagtgagatactcagatctggacgtcagaaaagtgagtgccaaagactgtaggatggaggggcaaaggcatggagacggtgagtactgtgaagcctgagggtgaggaaggccgtgacaaagaacaccatggcggatatggaaagggaaggaggtagtagagattttacaaagaataattgcaagctcttggtatctttctgatgaagggaaagtgtgaggaagtagtcacatttattttgtttttgcagtttccagctcaggttaatgatagaacaaaatgaaaagtctaaaagcagtaaagcagaaggcatcccataaatcttcctctctaactaaataagaaaaacccattctttccttctaacatcaccgaacctaaaaaatatgatattgatttatgttgctgcagaccattactctgggaaagcctcggattatttttctcacctcttaatgaaatcaccttccatgctcttgttcttgaatgacagaaaaacgagcgaggaactacagattgagcaggtatctcataaacagctgtgtcttaagcagaattgtaggagcaagtgcaccatttcagagtgcttttgtaatgcagtgccttttcaaaattacagattttctaaatgccagtggaaagaagtggtataacactgttaaaaattctaagacttccattttagcactatttccagttgtatttgatatgggctgtaagtggtctccattcttacagtccttaagagatgatacgtttgcatgccaaatgcaccctggcagttaggtctggaggtccaggaataatcattcttcacattccccaagatggagactatgctttctagagataattctttcagaggcagaatgtggtcccaaactagccagctgacatgattacttccattttcgagtagagtccccattaaaattactggtttcagatgcccgttcaaacctaaattactgtaataattgggaaaataagtacaaaggagacaaatacaagaaatagagatgggaagatttgaatattttggtaatcatgtacttagtctgtatttaaaatggaccaagattacttgatattgtagaatgcaaataaatcctttaagctctcagatagttgtacacttccaggagatgacctcttaaattgcaaacagtgacattagacacaatgttttatttttttagaaaaagtttcatacatatttagattagcttggttttaccattatttacactgaaggtattattttcgagctaaatagacgtaaaagggacttgcgcacctagcatatgatgctatatattaaaggaaaagtggctatcttggcatgtagcaagtatctatcatcactttgatatttgcagtatgcagaaaaaactatgttaggaaattttctgagggtattttcctactgatctcaggcatttgaagacatacagttaacttctctttcatctcaacattaaatgctatctaataaaaataagtgcagtgtgcagaatagccaatgaggctacaacaacagtatttgatttgtaaataaattttatagagcagtaatcatatttgagatattctttgaattaagataatttttattcatgtatcgaagaggttcgaaatctgaattgtacatgcatgggataatttatttttacataacattttatactttagcaaatccatatccactctattaactagttgatacgtgcaaatactactgctttgtaccaagcctggttgatattttttaccccagtctcttagaagcgaggcaattgatgccttagaaggtagaattctgtcaataagtgttagttacatacaggttcagcatattaaattttcctcgtcggtggctttttaagaaattaagtatttgacatacttttgattattttcatttgggttttgagtctgttttgtttaacataatatcattacaaaagctttttatcatttatttattgcttgtctggcatatatttttttgcctttttaatttctacctatctgcgtcagtatatgccttatgtgtggcttttataaaaagtgggtggctgagttttctagatgtgacgagcagagtgatggctagaacttacagattctgcccttggtaaaggaatgagaatcataacttaaaaggacacatttacttttacagaatatgataactttacctcttttccagactgacagaaattcatgcagtgcaaacagcttctccaggattgaccaagaggtgcctcatgcatgcacccgtgccaggctcctggcaaggcaccacttggcattctgcatttgctctcttggtcccatgatggatcctccacttgccatgtgtcccactgctgcctggcatgaaaactccagtgtccttgccaagggcaccaacagagaacactgctaaagtttccagcaagaggctgctccagctctatttagaagggtctaatattcatcaaattcactgggagcacaaaaggtcttgtcttgaagctccgttagcatggcttgtacagctttattgtgtccttatcttatttatgtggctgtaacacacaaggctttgccatgatgcttaaacgtacatctttaaataattttgagaaagcataacttttcttgtaaaatattttgcttcttgattttcattgacaccatttatttagtttacagtggcataattgggatggaagaggacaacgtgagattaatgccatctcctcaccacacacacactccacacacacacacacacacacacacacacacacacaaatctgcagtgccaccactgcttccaacctgtgtgtagcagagacagcattttcctcctctgcaacctatgtcacgcttgtaagcctgggtcccaaagactgcacttcgttattcctagacactcatgtagttcttaggagaagttatgtcttctcacttttctgggcataaaagctcagccccagtctaatatcacctgccttggcatcagctccagaaccttctgtagcctgctgtttctccctcctcctgattaattgccagtggtttctgtgcttatcaataagctggaattgatagtgggaaaacagtgaatgtggcataattgagaaaagaggataataatggaggcgttttattcactaatagcactggcaccacatttctgccaacaagaaatgccctattaaaccagttctagtgaaaaagatggctcaggagatgggctcatgtattctttgtgtgacttaggatgagcaaataacagcattctgagagaattaaggggcagggatattgctaataaccaatcaagagcgtccctggttgcccttggacagaaacaacaacagcaacagcaacatacaacaacaacaagaacaacaaaacttattctatgacagctaattcaaatgtgcaaactccagcatttggacagtatgggtgtgtgtgtgtgtgtgtgtgtgtgtgtgtgtgtgtgtgttcttgtcttcattgttctgtttctgcccatttttgatcgtctgatgatttcttcttcactctatcccccacatctttctatgattatgtttagtaaatgcatattttctctgtagaacagtagtattgccttgttactatctatcagaagtaaacattgtaaaagcctacttaatgtgaacacaaacaaaatccaacttctgtgtactcgtgttataagagttacgttttctcaatttgtttaaaaatgtgaatacacgcaccatgaggaaacttcaaattacagctaaataaataaaataagggaacaaaaaagctttacaagcccagcacatatcaataatattttaaagggcttgaaaattttcttcctgtaaatcttgtaagttttggtttcttaaatttatatatgaataaaatttatgttaaactagaaaagaaagtcaggttatatatactctgtgcccacatgaaaaccattaggtagacagactcaaaaagagaagctataattgtcaaccccatacttagagaaaagagtatacctttaaaagaagtttaaaacatggtgatatgaattttatactagagcaatgctgcttctagacgagtgaattaactcagagtattaaaacaatatgattatgcaagctattctttactctgctgttaagatttttctgccattgatatttaaaatggcacttaaagtttgttcaaatgatttcaaaaactacaaacactctggttttcaaccttgagtaaaaaacaaggggtccaacacctgttgcagacaagtatggaaggatggaaataagaatgtccccattgaagggtgtggttagtttcaaattagacattgtttcagtaaagatgtgtacacaaacatgatgggactttcaaaagtgagtaggagattggatgtgaagattgattatggatcgcaggtctaagaaatggaagtcagtcatctgggaattgaatgagaacaaggaagagtgagtggacagtgggaagcaaggtgaaggaggagtttgcgttgtgttattagctaagaagggacttgagcagatttattgtctgaaaggttgtagataatagaaggtagtttaaaaattttaggaagataattgatgtgctcactactatgaataggggtgatgagaaaatccagaagataggtagagaattcgatttagagagattaatttttcagaattggaggaagataattgatatgccaactactatgtataggagtgattagaaaatccatacggtaggtggagaattagatttagagagagaaagtgttggtagataggcagtaatgacagtggatctggatgagtttataggttgagagtgggaagttgaataacttcctagctcatggagtctttgttgatgttaatgagaaaactaaacattgtccctgattgttttctccttcacttcccacacccaatccatcagtaaacctaaaataaagtgattggtcattgaatgttaactgtagggtttgtaaatttgatcaacttgcttgaacccaaatatgatcatatgcttggaagaactaatcacagaattactgggcttcagggtgaaaaggacgtcgtaggtaatgtcgtctaccaacccaccccccacgaagcctacacaaatacttgtttcctggggcagcatttagtacacctcatcattagctttcaacacacagctctaatttattcctctgtaggacaaatgaaaaagatttacttacgtggatcttgatctctgaaattcatttttgaaacattttgaacatatttgtgtttttaaccatagctccaacatcatactcaaacatatttttcccctgccaaaaaaaaattgtattttatctgttttatatataaaattgctttaggttacgtcactcccaaatcaagagagaaggaagaacagccacatggagagtccagacaggcccagtagaccagatgacattcttagcatttacaagtctgtaatgaattcaaatagaatgtgacaatatggaaatctggaggtcgactgcctaattctgatttcaagtcctaccatttacaactgtattcttaggctagttacttaatctctctgtgctgcctgttttcctcagctataaaacaagcatagcactgttatctacatcatacagtgttaaggaataaaggacttactatatttaaagtaattaaaataatatctggtacatattaattattgcaatggtattagctattttcgtggatctaactaaatgaaaataagaattaaaatgagaaaccagaaaaaacccttttagtcacgtagatatatttcaaacttgtattcttttcatttgtgtagaatatttgagaactctgtctcataaaaatttgattcatttgtattttagtttgtattataggaaaattcttgaagattatagtggagtgcttaaaaatacaaattgattctaaagtctgcattctcttttgtaacataaatactaatttctatcaaaatactggattcatttttctatggccaattaataaatggtttgcagttaaatattggtgctgcatgttagctcattaaatttttgaggtttatgaacaacactgtaacatggctttagtttttccacattttacttatcatttatttgataaaaatgtaacagtcaagacaatttaaaaattctggccagttattcaaagccaatgcaaataatagagattgttaggtaacttaggaaattagtaaagattttatttgatgccactttcagtgtctacttgtcagtaaaaaggagaatattaaggatgaatgacataattcaggatgtctgagattgtggaaatttggggaaaactattgttttctaagactatcctgttaggtagtcgagctgtgcgttgaaaatatcacagtattaaagctgatttttataatcagaaggtttgtaaacatagttgtgtcacctggtcaggaagtgacgtgtgctcatgacctgttctgggaataccactgtattctgtgatataatggcatacatgagttgtaaaaacctaaaccaacaacattcttatttcagttaaggaaaataagactcagaaatatggaatgattggttcaatgttctagagacagcactgaagctgtttaggtcttagatcaaaacaagttgtatttttctaaagttgtcaattccctatttctttcatttataaaatgaggaggcctctgatatgattcagttataatctaatcagttaacagtagtttccagaaagttcatctgcaatgtggctagcagtgtgaaatttcattggattatgaaataaatacatcgtgcaagcctgagctattaaattgtaatttagagttcttttagaagaaggtacccatgatacaaagataaggttggtcggggcagacgttctgcagctttttagtctcaaaactcctttcctctcctaagaactattgaagaactcaaaatgcttggcttattggctgtatcattcaatatttattatattagccatttaaactgagtatattttaaatagctatttattaagtaatattcaaattataccaataaaccaataatgtgttaaggtaaatagcatactatattaaaatataaattaatatgaagatattaatgaatattaaaatattaattagaagaatggcattatttacatttttgcaaatcgagtgtcaggtttattatgctggattatcacccctgcttatgcattaaatctgttatgatgtgttgttatggtggaagtagatgaagagaacccagtctaacagagatatatatgtagttggaacagcaggaaagagtatctttttttttttttttggtacggagttccgctcttgttgcccaggctggagtgcaatggtgtgatctcggctgactgcaacctcaacctcccgggttcaagcaattatcctgccacagcctcccgagtatctgggattacaggcatgtgccaccacacctgactaattttgtatttttagtaaagatgaggtttctccatgttcgtcaggctggtcttgaactcccagcctcaggtgatctgcctgcctcggcctcccagagtgcgggattaaaggcatgagccaccgctcctggccaggagagtattttaagagccttttcagggaggggtgattattcttttgtactacaccaaagctcaacaagtgatagcttcttaaaggttagttgcaacagggaatatcaaaccgtattgatgaatttctttgtattctgttacattaacatccattagtgtattttcctcttcaaagggctctgttccacatgcatccttgtttaacttcatgcattatttatttggcagttattggattactattatgcagaactgctaaatgttgacacaaatcaaaaatcacatttgttcccatcaacaacaatctcatttaaaaattctctcagcgttgggaagctgtcaagtgcactctagcaaatacatctccttcccttgaaacttgaattttatcattggcaacaaatattgtcggttgtttttcttaaaaatcaacagattcattttgttcattttcaagaaaatatctgccaaacatccaaatctaaacaactgtaatatgcttttcaagcagaaatgatgctccatgagaaaaatgagtaactcacacaattcaaacaactacaaggtgcttgttcttaagaaaaacaggaaacaattcagtctgcagcaaaagtgccttatctgtacttaacatttcctcttacagaatattaaaactgttactctagacttcagaatctaaataattgtttttaatgcttcatcatgatgatgttaagtaaaattcttttttattttcctgctgtgcaattgcatggcagtgaattatgcagtgaacactagctgctaaggtttggtgccacagtcctgattcattgctaagacaccagcaattctctccaccattgtttttgcaccatcaatgcaaatgtcaatcaatccagatgtcccagtataaaccgtaggattggaaagttaaccaaaaatttgaatatttcaacactacttccatttgttgtcaagcattcacataaaagatgatccttgatcattggcccatgctgacattcagcgaattcaagcaaactaaggaagcccagccaagtttgtacatccgttcattttttagacaaaagtaaaattctccagacatggcattaactctgtcttcttgtctaagctgaaactttaatcagcaagttactgtgtgatgggaaagtggcagtgtcctggtttcttttaccgacttttcatccagtaggcattcagcaatggcaggtgtaaatggtttcattagcctcctgtgagcttctcgaccaaggtctcacaataactgtgagacatttcaatgagttcactattttgagtttgaaaagtgacatttggcttttagagagctaatgatgtctacgtttaaaaatatactgtttttttttttttagaattcttattttctcaactcttcaatcaaactttcagaataaaatcattcaaaaatgcctatttttctaagtcctatgaaattattaacatctataaagtggaggaaaagatacattttctcatattttcatttttatttacaggtttgtttgattttatttggaatagattcttccataagaaacctgtttgaaatgtcaggttcatcttttttcataatttagaaatagatggtgtgactgtggtggagacagtgagtcttttcatctcccctttctaagacagatgtccatccttcaccataagaaaaatatggtataactatattttcttttatttaagaggaaatattactaagccgtataattgttatatatctagataaaagttaaatacaaaagatttcaaattagatagataagtaaatagatttacaaaataaagcagcaaacatacttaattcttgctgtgcttctgtgtaacctcagtaaacattttgaagtttaagaataacattgtattgaacaaaaatcgggttactgggattgtattaagaactgaaaatagccagtaagtgtccagtaaaatcacggagaacaaactaagctaatctctgaaaatgtatgttatttacaccctaaacttagaatatttgaaaatacattcacatactttattagtcatagtagtgtgccattgtcatgtaatatctggaaaactcttccgtatatttttgagaaaatgagaatgcaaaaagacaaatagatttttagtattattatgaaaatagtgacctttggataaaggaacactcctgggctcatagaataatagttgcaataacatttaaaaaactttagtaatttcacataattggagtatattatttactgaggaagagtctaatcagagtcaaggaaaatgctgtctatactccacgtactcatttataaaatgaagctgacggagtttcgcatttccaatgcatggcttttgaggtagaccatggaagaaagacagagtctgtaggaattttttaaagaagattgtaagcacccagcctgcgagtaaaaattaacttttgtctgcatttatttgccagagttcacttccatggccacatacaattgcaagggaggctgggaaacatagtctagatgtgagcctagaaagaaaaagaaagacaggtttgttaaacatgaggctgctctctaatagagtgtctaatgtgatacatttactgtgagaacctgtggattggacaagtgttaagtataagccttgcaattatatcaacatataataaaatcaagttggggtaaagtaactgtattatttacaggaagagacatgttaaattcagtactgagtatgatcacctattatgcccaagcactgttctaggtcctagatagagagggtcaagagacacaaagtcccttatagcacatttttagcaccagggaccggttttgtggaagacaatttttccatgtgctggggtgggggatggtttccagatgattcaagtgcattacatttattgtgcactttatttctatcattattacatagtaatatataatgagataattatacaactcaccataatgtagaatcactgggagccctgagcctgttttctgcaactagacggtctcatctaggggttatgggagatagtggcatcagaagtgtgttgcttatgtccagtctactctctgatctcatttcggttactgtcactgcagaaaaccctgcttcacaaagataggatgtaggaagtggaagcaggcttttcagtgcattctgtggcaatctcaggatattctgccttgactttaatccagcacgtatggagatttgaagttgtctcaaacacacgtttaaagtcaccatcatttgcaatatcaggcatttgatcctcttctagcatggctaaagtccattcacctggcttattcacaaatgggtcacagatccattccttcccagttccggggccttctttggttaggaagtaacactcaagctcttctgaaagctgagatgggtgctcatgcaccagctgtgagaaagaaggccctggctccatctctctcaaaatctctgctaatgtttgaaagatgtcagaaattccgttgttcactcccataattccagtttggctttgaatgcagtcactttatttgctgacttgaacacagtttttgttctcccctgaagtgacagattgagtttgttgagcaggttgaatgtgtcgcacaagtaagcaagttttgtaactgaatctgtgttactgaaatgtgttgccagggagactatttgtctacaagaaatctctggagtggctctcttaactaaaaaactctggccagtgatctacattgggaaagccatctcacttctgtgtgtaagagaagacatgtgtgttcagcatccaactcctcagagctgcgcaagcagatgtgagttaagggcatgtactttaatgtggttgatagttttaatcacatcctgaaaaatgctaagtacacatgacattttttggctagccagcacagcatttctgtatggctgacacagtgcatagactcacattccctacctttgaccaaggtagggaaacaagaaagccgtccagtcatggcagccactccattcatgcatatacagacacaaaatgactaattcagttttcctgatatgtaatcattcaaagacttgaacagttctctagctgtgatgttggttggcaataaaagtgcacataacgtatcctcatgcacatcatcttgaaaaatacaccatacagaaacagatattgttgactcgttgtcagtactggtagactcgtcatcccagattgcataccatggtgactcattaatcctaacaattgtgcatcagtatcttctgccatttcatcagttcatctagttatggtgctagctgaaagtagctgtgttttgaactgcagcctctcctaaaagttcatgacagatatccttagcagcaggcaggatcaacttttcaccaataataaagggcttcttagctttagcaatgaagttagccactaagaatgatgctctcagtgcagacacatttgatgaagtgatggttttcaacaattgcttctgttcattatgtttttgttttcttttaaataacgctgaagttgtgtcttttaatgcagggtgcttggtcactatgtggcaaagcagttttgttggtttcatgacttccttggataactggtcaccacacattgtacagagtggtcttggagaatgtgaactatctgttgcaatgaacctgtaatttaagtaggactcttggtattctctttaaatgcagctttctttttgttggcaatcttagggtcttctgctgtctcatcattgggtctttaacccttttcaaagaagctctccgatgacatttgatttttactcattttggctaggcttagcttgtgggcttaccaaaactgtgactgagacaagtgtgcagtgtgggaaagacgcattgatggaagtaaataaaataatgggtgtgtcacatgcggactaaaataagtggcggattttgacttaaagcctgccaccacatgcagctgtacaactgaagtacattaactcacttgccactacaaagcctgtcaccagatgccgcttgtgacacttgccactcactgatagggttttgatatgcatctggaagtgattgctttattatggtctctgtgcagtcaaacttctttgctaatgttcatctgtatttccagctgctccccagtgctagcatcactaccccagatcatcaggcattagattctcataaggagcgtgcaccctagatccctcgcatgcacagttcgcaatagggttgaagctcctatgagaatctaatgctgctgctgacttgacaggaggaggagctcaggtggtgatgtgagccatgggaagctgctgtaaatacagttgatgcttcctttgctgtcctgcctctgctcatctcctgctgtgtggcccacagctggttggggaacccatccttagagaagttcttgattatggagcagtggaagtagacggtaaaaaaatatacagacaaatagttaaataattgtaaattgtaattgtaataacatgagggaggtaaaattagggacgttgctattttagagaggattgtcaaggaaggcgtttctgagaatataatatttgaaccaaaaaccaaagaatgagaaagatccagctctccaaagccaggagaaagttattgcagagagacaaaaggacaagttcctggtacagaggataggaacagcctggggtgtatgagaaataggtgaatgtgatcagagagaagagagtggaaccagcagcatggagccagggaccaaggtcaagaactcacagggcgttaagatgcattataaagattgatggtcttactctaagggcagtggaaaaccaggagagttccatgattcgatttacatgtgtaatagtttatttaggttgctaagtagagaacaggctgagggacagatccagagtggaagactagttaccaagtccaacgttatcgtgtgtctgcctaataattcatgtcctcatccacaaacaaccttggccaatcaatctttataatcttagttcaatttaggctgtttttaaaaaagaatattgtttatttgtttgtttttgcaggtcatatggcccatccattattgtgatattaatacaaatggaattacaaaaacatttttttcataaagttttgttttttaaactatcagtgctatcactattaatacaaagacaaaaataaattttcagttcccagaactggcatttctctctacattgcctggcatgagttataaaaatgacaaatgttagccttcaaactagaaaatagagtatcaactatattccacaaaaattgtagaaacaggcacataaggctgaaaccttctaatcaagaaggagataatgagtattaattatgaatataattaagcattattcttaatagtaagaaggatacaatgaataacaaaaagtctagataacaggtcatcaaggttgatggaaaaataaggaagaatagggaatcttgtcaatatcaatggaactgcttgatgagaacaaccaattttagcagtgctatgcaaaacatggcttttattacacagtaggtgttaaatatgtatttattgaaataataactatatatctattgatttagatgaagaaacaaatttctactaggaagcatcttgttccaaatgatctatgatgtccctattttttaaatggagattgcttacagtttttttttcctttttttctaaaaagattttttaaaatctattttcggccgggcgcggtggctcacgcctgtaatcccagcactttgggaggccaaggaggacggatcatgaggtcaggagatcgagaccatggtgaaactccgtctctactaaaagtacaaaaaattagctgggcacagtggcgggcgcctgtagtcccagctacttgggaggctgaggcaggagaatggtgtgaacctgggaggtgaagcttgcagtgagacgagatcactgcgctccagcctgggcgacagagccagactccgtctcaaaaaaacaaacaaaaaaaatctattttaaaaacagctttgcaaaggcatctgtaacttgtttcaaaatttattaacactttctaatagtgtctgtagtaaaataagtctaaatagttcatatgatcagattgtagcaatccaagcctctcagtttcaacagagcagttcacataactgtttgacaaagcaagaagcaaacaacaacaacaacaaaacctttaatgaagataactaaactaacaatcagcctgtagttacaggttttgcatatccaggcacacagacatacaaagaaacgcacttagatacccacatacatattagcacacgtagtcttaatatcctaaactaatctcttccagaaagaatgctactttttatattgcagtcctgaattgttgttgagcaatgtctcataaaatatttctaactttaaaagattgtaacttacagctgatgccatggtagtaggaacaaatgcatttcccagtcatcttttaaatcgtatgccaagttcctttaacatgtagtcattgatgccttcgcccactcataagtcaaagaaacctcaactcaaagtggcaagggctacaaggacgtgtgttattcaaaaagcaaaaagcccaatttcaggtaggcaggaagaataataagttcaagagatcaccatggtagctgtagttaataacaatatatcctataatatacttgaaaattgccagaatgtagattttaagtgttctcactatgcaagaaaatgatagatacatgtggtaagacgtgaattatcttgatttagccatttgacaatgtacacatatatcaaaacgtcacgtatcaaaacatcacattgtacaccatgaacataaacaatttttacttgtcaaatggaaaaaaaagagtataaatcttggagaaatgcaactccaagaatgtaacttatggagaataagttactccataaatatatccaatgactatgtacttgtaataattaaaaattcagaattttttaaaaataggaatatatgtgcatcaaataagataatacaatgtctcagtgacatcattaatgactcatagtcattatgctcttcatcacagttagccttttattatattaacaccttcaacattgaaagttggctaacgcatgattccacgacgtccgatacaagcatgactgcaatgagagccagaaaaatggtatacaccttgtctctattacgaggaaaactttctcagaagctctctaaaaggctcatctttatatttcattggctgcatacctacctcaaaatcaattccaggaacaagaacgagacccccactttgccttttcaccattagaaaacatcttagactcatgacacagcaggcttcccctgaaatacataaattagcagaggacaggtggctgagcctgggcttgactgcgaggaagacagggagagtgggtgttgagttgacaaactagaatactgaggaatgctttgaaagttagcatagtatgaaatgttgcagagaaagatttgatgaaaacaggattgttcagtccgccaaaggagaggagttctagattttacatcttaatttgtgcttcaaatattctagttaaaaactgtgttactacactttacagaatattttgaatcagaaaagaggatagtatctagaacaaagggaaattgcctcaaaccttgaattacctattgatactttttacaaaaacgtctgttctcctgttatagaggatagataatatgactaatttaattattctacctatggagttataggtaatgagtaagatttttatttgataattagaggcaggaaaggcattagaaaaaaaatttaaatagtgttttttgtattgagaaaaaccttgtagtaatactaaattaacatttcagtcccaacatcattatgcactttttatttaatcatttacttttccctaatgtgttttttacttttccctaatgtgttttttaaggtagatttctggaaaacttaatgataaataacttaaactcactgtaagtaataaatgtagaatgggactaattgtctttttctcaatttttaagatcctgactttaaggaccttggagctttgaaaccattaccaggttggtaaaatagatatttaatactgttcagaagactttgttttctgctatgaaatacacttttggtttattattcaagctccgtttttgtgtgtttgtttggcattttgttatttagcgtgtgagtttgagatgggcggttccgaaggaattgtggagtctatacaaattatgaaggaaggcaaagctactgctagcgaggctgttgattgcaagtggtacatccgagcacctccacggtccaaggtcagtcttaagatgaaacccacacttgacagctgacgttgagaagtgtctataacaagcattgctttgaagcaactggacgtgtctaatacatttcagagtgcagccatcaaaggctatgatttcattttggtttttgagatgtaacttgtcttctcttgtccaatctaaatttgatgtcgtaaatagcaatctagagagtgagttgaagaaatcatttgataatttagacaagagactttaaggtaagtcgacctctctgaaacatggattgaaatggtatgcaagagccgtggctcttagtgtaactacacttacgctcttattgtcaatatctgcagttggtttattttgtaaactaaaattctatctgtagacgtttttctggggcctacaaaatcataaatatctggcatgtaaaatacaagtgtggtaagggctggcagcaatggtaacagggcctgggagatcctgtgcccatttgaaggagacaggcatgagttagctgcccatgaagctccttgtgatgctgttatgagaaaatgtgggtccagcattatcaaaccctccattatttctcataacttgccaaaagtctagattttatgttgatcaccctgacttttgagagttggcaatacattataaaaattaaaagtattacatgtattaaactattgtgggctagattttgactcaggaccccattttggaaacacttccatagcacaactatggtgattctgtttatggaaatattttccaaaatacagaggatgagtcattttgtgccagcaggtgtcacaggtctaagatgttatttgttcattctcctgttttggtttatattcctcagttacaaagttataagaaaaaatattgacttactagatttgtagtcatttatttattgagattgaaactgtgtgctatttcattaattgattttgtgactctataaagtcgcaagcactctgccagctacacgaaaaagcaggccaggccctgttctcaggtgcttccgtttagttcttaaaccaatatgtaacagaataacctaagcagtaaggttagatcattggggtatttgtaaggtataacagagagagagaaaagaccccttacaccaggtaggggaagtcaatggtagaatcgtacagctgccaggatcttggtgaatcttaatgagaagtattttgtcaagaagacaagttgacaaggctctccagacagagggaatagcatctatgaggccatggaatcacaggagagaagagagcatgctttttcaggagtaatgtaattgcacgtgaccacatgaaagcgtgggttgagaggtggtgttgattgcttaagctaaagtgttcctcaggcctctctgaagaactcagccttcacccggagtgcttcagcgacatacggaaaaacaaagcagaaaagtgatatgaccagatttgcatatttggaaaattgttttttttcctgcaaagaagggacagaggagtcaacactgcaagcagaaggtcaagtgggaagctgtggcggtaattccagtgttggaaattaggccatggtggtccaacatgagggaaatactagagagagatgagatagaatttggtgactggatatttagactgaggggaaaagaagagcccctccgcaccgtttttgttgttttttattttgtttgtttttgagacagagtctcattctgtctcccaggctggagtgcagtggtgcgatctcggctcactgcaacctccacctcccacctcaagcgattttcttgcttcgggaattacagatgtgtgccaccacacttggctaactttttttgtatttttattagagacggggtttctccacgttggccaggctggtctcgaactcttgatctcaggtgatctgcccacatcggcctcccaaagtgctaggattataggcatgaatcaccacgcccagtgaagaaccttttttgagggcactggtctttcttcacttgacttttttcttgaatgtatctctaaggcttgcacataaagtggaaatgtggcacctttcccccagctttcagttacagagattcagagatcattctccagcttccagctttgatgcttgcatttctctctgcctctgaacaaatcttaaagttaattgcattatgaagaaagacagttatttttcttctatatttttttaagtcaaaagctgttgctcacatgaaaccataaaaacccactacctgtattacaagagagctaggttgcagtttattatgctgttttcgtaaggtgtggattcacatgcaagggctatttatttttcttagactctatgaatgaaagatttttaaagactttttaaaaaacaggattatatgtgccccaccttactgtcataaccagtacttttgtcactgcagtctcaaggagaaagttttcatgacagtgtaaatgcacacccttttcttccagctggtaaatagactgtcttttgtacaatcccagagcaacaataaccgatgtacctgtctgttacagaatttggcattctgtgacccaaaggggaagctgcctgcagagctggacaaagatggctctattgtaacaggctttctctgttaaattaaaggttagaggatgggaagtggctttgaatactgtggagaaaagcacggactggagattactgcctatgtggactttctatttttatagagttcctagcagcttatgagaatagactatcaaagcacaagttaaacttgaaatggctcgtggtgaatatttgaatgacacctggtgactgaaccatattgcacaaagaaagtgctgaatagcttacttggctctattaaaatgtatacacattatttactgctttaccagcttttgacaaatagaaaatataatatctgatgtctcctttactacagaatattaatctagatggtcccctttaattagaatgtgattaatctagatttcatagaattcggaaaaccagaggcagaaagaaccttgttactgactagatcatttaaaagatgaataaactgagtcaggataatgcaattcaataggcgttaacaaaggagtgtagacatatgcctctctgagcaaatactctggggtctaattcataatctggtctggaaaacagccaccagaatgaaatgatgggagaccaaatcatggtaactattaatttcatgaaggctggaccatatttatctccagatacccagtgccaagcacaatgtctgtgactcaagtaaaactcatggaataaataaacggattatttcttaaaataaaaaaggacatggcagcaatcttcaaacatttgaaggactgtcacatgaaacaggattaagacttaatcttcaggagtaagacttttaagtactgcggtttatttgaaagtttgaaactagagaaatagctgttaatgtaacacagagaagccttttattttaataacagagattgaatgagatttcaccggaggaatccaagcagagtctggcagagattttgtataatagttaaaagtcaagtaatattttggcacagataacatgaaagtcatctgaaaaccaaatttaatgaatctatgataagtgacttgcccaaatatttggctagttagcaacagagctggagcaaggttaacaactcccaattcctggcccagttcactctcacaaaaccacattctttgaggaaatgatcaaggtttttaaaaattaattttaaaatatttttaaaatttatttttaattgacaaataatacttgtttatatttatggggtacggtgtgatgtttccatcatggaatgattaaatcaagctaattaacaaatctatcacttcacattcttatcacttgctaggacgggatacgggacagagtcaaaatatgtataaaatacataaatgaaggtaatttaatgtttaatgtttttggataataaaactctagcttacacagtttactcatttcatatttaaagttgactcaatttgtggttaactaattcaaaaatactttcagtcaaattaaaataaaaaatataaacacttgacaaatagtctcttacagtaaagtggtgataaaagtattaaagttacttatctaatgaacacagatttccagccccaattgctgggattgtgaatatgataaatgtgcctatgtgattaaggttaccagtcaggtgactttggattaatcaaaaggtagactatccaggtgagcgtaatctaagcacacgagccctttaaaagtggagcagattctttagacatgaatgaaaggggaagtaagagaatcaggggattaagaaatgtgttctaggagtgagggtgaccccagtaagcagtcctcaagaaaatacagaccttggtcccagaactgtgagaaactggattttcaccctcatctgccctcaccaaagaacccagtacttcctacctacagaactattaatagtagatagtacatgggtgttatttaaagctgctaaaattgtggtgatttgttaccgagcaatagaatattaatgcaataaaccaagtgtagtaactgtaattgattacagagataagcatcaagggttctgaagattgagcctgcttttatctccaaaaagtaagaataaaatttgataaacgaagtaaaaattttaaataggtaggtaaataccaaaaaaattgtacagttcaagttttaaaatggcatttttatactctcatattttcaacagctactcaggtggactttaaatattttggtacttgtttatatatgccagaaaattattttttattgttatatcaggaattgtgctgtgcacatgtgtgtgtgtgtgtgtgtgtgtgtgtgtgtgtgtgtgtgcttgtgtgttaatattttataaagcattaagatgttctggttccttctccaaaaataaagggaacattgataccgtccaaacggaatattctacataagtttataaacctgacatgtctggtcaataataaaatagaaaattcagaaatcctgggctacatattttgtagaatttgattttatttataaaggtgtctagtagtattgaaaccatgtacagcatttctcagactgtgacagatttaatttttacttattaaggagaaaactgttctggcaagtggtaaataattgcctcaaataatgtctattttctgtatatcattttgatatgaggggagagggacctggttgagcaggtggtattaaattttgtttgtgaatatattacttagtaaattgttagctagatttatttgctttgcatataaaaaggggttctgctttccatgtgatttgaaaaatagatattactagaaattatttatatgttttgaagttttccatgtcctgctcaataaattatcttgtcagctccaactctttatgattgattaaaaagaatgcatcaaaatgattcactgagaagagatgataatctattttactagtgttatgtattactctgtttatcattttctctttttttttcagtaagtgactaaagagctttctgtagtttgctacattaaataattctttctattagtattattgtggtacaagatttaagctaatgagatagtcactcaaatcataatatatagagagattttacatgacatatactagagttagtatgggaaagcgtgatcacgttttctggataatggaatttggcttttgtactgacagctctggacccagtaaagtatattctctttttctatatgataaaaaatcattgccatcactagatcataggtaaacactactgaatgcttcagacgtgattacctgggatctagtgacggcagtgattcacttactctctaattagtgttctatttaataagaaggtcctttatagaagatacttaggtagcagtgattgcacttcatgtacaaatgcaagacagtcacctcttgtggaaaatatagaactgtcaaatgaaaaaaatatagggccaatatgcaaattgactttctaactatagcaatattcttatgtgaaatatttctatttttaaagaatttaaaacagccatttatttttgagggacacgtttattttctataaattttatttataacttgatagtcaacatcttttctagctcattagaagaagtggatagttttgctttgcttatttatttgattactcattttgtttttgattgttttctttaagaatataactttctttctgggctataactctgtgagcatttaaaagcattacataaggctgcatagtgtgatgagtatccgggtgttaggcacatctgacttcggtaccagtccgttacttcagtgacattactgtgtcactctgagaaagttacttaatttttataaacttcagttctcttcatcttaaatgattataacaagtatctattgttgttgagagatatgaaataatgcattagcagtgtcttaagctatcgtcaatataacacgcaaactttcttttcctaacaataaattagtattttaaggtgtgtttctacatgcaatgttagaaattttaaatatttgttgaaacaccttgagccactgaaacatttcaacttgaaaacatcaggtggtctaatagcttttttttgtattagccaaacaattatttaaatatttttcatcccgtgggcttagtacttggtttttataactttgtaagactattgggagagacgtgtcattttgtattacacttcaaaggagtggaacgcactctttacttaccctaatctgtgttctcctgcttgtgacaatgtttacttccaattataattgcatcttttttgagagctgattaacttgttgaatttattgcatagaatttttagagtataagtacatatttgaatttttgttccacttaacatgtttgtataatacctagattttagctttgatttttacagtgttttcagtttgtttacttttagtcaaaaaagtaaacaaaagtaaacaaactgaaaacactgttgtgacctgatgaaaagaaatttaaatccagagtgggaaattttaatcctttttaaggtttccacattaattcacttatgatcctggagcaagttattattttttttcttctttgctccagccttttttgtttgtttgttttggagatggggtctcgctctgtcgcccaggctggagtgcagtggcgcaacctccagctttctaataaaggtcatctgaaaaaaaaatcttttttttttaagtcatgttaacattgaaaaaacaaacgagttagtataaacttggaagtttaacatttttagatgcatatataccttcttaaactggatatttctgaaattctctgaataattttagaaatgaaatattgtgttgggaggagaaatcacagatggactgcatgagtaatatctgagttttagataaaataaaacaaaggaataacctgggcataccgaaaatgaaggcctcgttggggcatatgtctctcataaggctgtagcaatggcaggtaatttaaatcagcatcaaagtatttggaaattttagaatgacttccaacttcagtgctacaaattgctcatgtatgaaaatcgtcctaccttgcaaagcatactacaactcaagtgctttccactgttgttcagtttgattcatttgtccacatttctctgattttgttctttctcatcaaattgtgtctggatttcctcatttagaacttcacattctattttcagcatcttacaagtctgcaacatttcgtcttgtccttttatgtcataatttagatctatgctataccttgttctgagaattattgcatataatttccactgtatataataaaataagactattctatgtaattatcattatttataacgcttaaatgtctgtcatataggtgcatgataaatatgaatgctgaacaaaggaattcaataaagaaaatgaaacttccagttaatcattcacaaacatttctggagtgtttactatgtgtaaaatatatattaatgcttagaatacaaaaatatataccactgattcagcttttcgagaacacaaatttattagaagggacatataacctataactatggctttaaatatgttcaaaatcacatggaggctgtagagattaagtctgctgcgattggggagtgggagcagtgaaaacctttcattggatgtgcaaccgttgaactgtcttgacaaatcaggaagaggttcctagacagaagatggagaatgtgaagctaatgtcatgttcataaagggtggattttttgaaaatggttataatgttgggagataagaaggatgtaaatttgctagttgatgtttttagactttttaaaaattatacaccagttacaaatttcagctatgcctaacgttaaatgacgagttaatgggtgcagcacaccaacatggcacatgtatacatatgtaacaaacctgcacattgtgcacatgtaccctaaaacttaaagtataatgaaaaaaagactgtgattattagatttgtttcttagaaatataactttggctggagtaaactagtttttattagagtaaactttggggctgtaaggagaatctgtactttgcaactatccaggctggtcaggagagtgttgaaatattatagaaatgtgaatggacatggaaaacaactagtttgaaggtgaaattgacaggaactcgtgccctgttgagtacgaacatggaggacaagagatacattttcactaatttaaatagtgagattataatatttaggatagacgtactggatctggaagaaattgtcgtatcagtttcagattttacgaaataagaaaaaaatacatacagaatgatgaaagagatggatgtttgcttgaatgccatgtctttagtttatatccatgttaaattaagagaaatgcatttaagaggaaatagcgtataggcattcatattaaaataaaatgtaaaatattcaggagatatctgtatgaaagatgtgtctttattaggaaaccattctaggtatccctctcaaagtgcatgggtcttttggctttatataatttccactctttgacattgtatcttattgtcatggtttaattgacatacattttcggcactggccctcattcttttgttcactgtgatatccacaacgccttgaacagtgtctgcaacaatcacaggacaagctgtggatgccactgaatcgatggacgcatgaacaaattatttctttatagacttgtatttggttgaatgaattcttgtgattttgaatgcacattagtaaagagtcaaataatgtctgttgatggaaaagcagtacacctaaggcagcataatgttgtgaaagaattatggactaggaagtgaggatgctcatgtctaattttcaatttataccatctgagtctgagcttcttcatctgaatatgacaataaaatgggccactttatagagttgttggaagtgttacaaaataacatataaagcaagttgcacagtacattttactcataatttttatttatgtagcttagctaaatggcttgtctatatatggcatgaatggacagagactagcttggcctttttataaaaaattatacttcgactcaaaaatgaagcagtgtatttatgttaaataatttgattaaacaaatcagagagactgtctttcagtatcatttttgtttttctttggtattaataaaaatcacatatttttgtacatttttggaagtaaaaggaagccatcgaactgaaacaagaatgtatcaggaatacttaaaatacatttgctaatcaaagtaaaacagtgtgtaagtatgcaaaactagtaactgatttccagtaagttatgagaagacataaagcgaatttgggtaaaaatactcagctctagaaaatggtgcatttaagtaaagaaaggataatagcatttgaaaaaaaatattaaacacagtttgttcttatcgtacatcttctttctattcacaagggaaaataataagattgattgcaatcaagattgtcttgtgagactgaaaaagagaaaaggagttctgatactgatgtacattcatattttgatatgtggaaattattttatttttgttttatagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacgtaagattctctgcacttgactatttttccttcgtatatgccatatgatgccagtttcataagctgttaatggtgttttcttcacacagtgagcacagcaggctattctctaatatgttgtttaaaccactaaggtcctctttttctcattttgatccatgacaggaaagagttacatattacattttgctttcttatttcaacatatgcaccatagcctttcttaagacagttcacactattcaactgggaaatgatgaatttcatctgtcttcaatttagctcttaggaagcctgtggaactgatgcagcagcttctgatgaagtttgggtttaaatctttaaaaacctgcataaaaatatttggtaggttctttttagtaagcttcttttgcagtcccatttatttcaaataggtttctgacttcagagttccaattaaagtaggtaaggagagagaattgcttgggtagattgtaaatgagaaaagtttcagaaaatgtttaaaacagcacaatgggtgatatccagagtcaagggcaaatcacagaaacttcagaaagttatgttctaataaataatgattcataccaatagatatattctgaatatttgttagaaaccctgaatatttcatgtgttacaaatttatgcaagtgaaaaaggattctgagaaatttaagaaataagtaccttgtgacatgaacagacactgaaaagaagaacagacacttcatgtggccaacaagcatatacaaatgttcagcatcattaattattagagaaatccaagtcaaaaccacagtgagataccatctcataccagtcagaatagctgttattttatttatgtatttattattatttttttttgagatggagttttgctcttgttgcccaggctggagtgcgacggtgcgatctcagctcacagcaacctttgcctcccgggttcaagtgattctcctgcctcggcctcctgagtagctgggattacaggcatgcaccaccatgcacagctaattttgtattattagtagagatggggtttctccatgttggtcaggctggtctcaaactcctgacctcaggtgatcggcctgcctcggcctcccaaagtgctgggattagaggcatgagccactgtgcctggcctcagaatagctgttattaaaagtcaaacaataacagatgctggtgacgttgtgggaaaaaagggaacacttacgcactgctggtgggaatgtaaactagttcagccactgtggaaagcagtttggcaaaacagatctaccatttgacccaacaatcccaatactgagtataaatcgttctgtcataaagacacatgcatgtgtgtgttcatcacagcactgtccccaaactgttcccatagtaaaggcatggaatcaaatgagatgcctttccatgttagactgcataaagaaaatgtggtacatatatattgtggaatactatgtagccataaaaaagaatgataccatgtactttgcagcaacatggatggagctggaggccattatccttagaagtctaatatagtaacagaaaatcaaataccgcacgttctcaccaataagtgagagctaaacactgagtccatatggacagaaagaagggaacaacagactccagaacctacttgagggtggaggttgggaaaagggtgaggaccatagtacccctgttgggtactatgcttattatatgggtgatgaaataatttgtacaccaaactcccgtgacacacattttacctacatagtaaacctgcacatgtaccccgaatctgaaacaaaagttaaaaacaactttaaatgaaaagaaataagcaccttgtatttcacaactatgcatttttgtattcttagaaaagacaatacaatatttttgaaatttcagtgatttctcttattgtcagcagcagaggagccaatactgttttaaattcgtaaatgttaagtgtgttagacagttattttgcataacgaataaatcgtttgggctttaaattcccttttaattacccagttggggaattttatgacacagaaatactgaatgtcactcagtctttctaagtcttgacaccatcatctagcatgtcaaacatctctcccagctttatgtcagattaaaacagtatgctgttatgtatttggttcagtagttgattaaaatgttagaggtagtgcatttttatctcagcaaaatacttgaggaaaattttttcattttattgacaagcatatgagactcaggctacaagacaacacccttggtggctcactgctgattgatctacccaattcaatgaatcattccttcagtgagggaatttcagggttctatatttattcagtattcttatctgtcttcgggaataacataccaagaactcgtatttaatttaaatgataaaaatttggaagggcaagctaatatattaaatgatacagtccagattttaataaataacaaaaatctgtaatttttaatcaaaagtataccataaaatataatagagacatatgataaaagcattatatttcaaaaatcaataacatagaggaaccctgatgcctaggacggtcctgtggtcttatttcattcaaactcaatgtgagtcaatactttgattatgactgataaaaataatcttaaacaacattagcctgtattaaagttagtggagtaacaatgcaaaaaaagattttagttttataggaagctgcaccaatcaaaatgcaaaaggcacagtctgttctttcctgactcttattagtgaggagagtaaccacctagaagaggctgacaaagatgtaatgccaaataagaagaaatgtttactttaggatttattgttgttcaaaatgtgataactacctcacacctatgtctcatgggtctcaaaggtaatatttatgtttgaaagttatagggaaacttttgagcgcaatttagggggaaaaatgttcatcttgtgagttgtgatattcaaaatttgaaagaatgcctatgaaggatataaaatatggatagatgggtgattggatctgaaaatggattattatctggcatgaacggtatagaggaatcatctgtgtaggttaggtgaaaagaccggctaacatcaaagatccctttcaatcggaaaatagattaagctctatgagtctttaaaaatctgcatagataagaaatggtgaactgtatatatgttgcatatattattataaatatgtctatttgagactacaaaaaaatagagtttcaaggcatgtgattaaattatctctagaagtcattgaagtgggttgacttttcaatgagtaatccaaaagacacagggtgttcttcctacagaggcacccatcccaatatgttctttcacagtggacaaataatcactctcttcaaatgatgagttttacaacagcgttctctgtgatcatctcataaatttacaggaagtttccacggaaacaggtttatcctttagtcatgttaccacccatgttggtctgaatggttctgtggcgccccttcaaaaattcctgtgttcaaaatccagttgccaaggtgaggggataaggaggtgaggcatttgagaggtgattagctcataagtacagctctcatcataggtgttggtcctctaatgataaagagggcccagagagcagccttgccctttccaccaggtgagaacacagctagaacgtttcatccgtgaaccaggagatgggccctaaacagacaccaaatctgccagcaccttgatctcggacttcctaacatccagaaccgtgggaaacaaaaccctgttttttataagccacctaatttattgtagtttgctgtagtaacccaaacagactcagacgatgcctgtgtatatttgtcataatgttttactttttattgcattggctaaaattatgcagaattctaccattatttatacctaagatcaaagtcatcctatgatgacgtacatgggtctagactgtctttattcattgaagtgaaagtattccacgtaagagatgaaaacttcaaaacaatagaaagtgggcttcgatcagtgctactacttggaaatgggtgggtaggaatcattctaagggtacttaagaggaagcaaagatactttgtttagggagtttcaagttcctcagtggtattgctttattcaatattagtggctgagggagaattttggcttacatttttgttgtggctgatgattttggttcttgtagagggtgatagttaaacagactattcatatattttttatatatggctaatatatacaattacattaatgtatattagtgtatatataatctaatatataattatacatttaatatgtaactatatgtctaatatataattatacacatccaatatgtgccttatagatgtatatatagttatatgtattatctaacatttactccattcatacacccatgaagtaaaagttggagatataaaatcagtgatcagctttcgtcttattcaagtaataagaaagtacctggatatttttcctggtgcctacacatttatgaaatagtatccccagttcagtggtgaagtgcttcgagcgcgctggtgcctgaatgttatgtcccttcaaaactaagaggttggaatttttaatgttgtttacaagccatctagtctatggtattttgttctagcagcccaagtggacatacatagaaaatttatgctgatctgtggggatgttgctctaacaaatacctcaaaataggtggcagtggctttggaactgggtaatgagtagaggctggaggagttctgaggtgctagaaaacatttacgttgccatgaacaagaccattaaggctgatcctggtctgggctcagaaggggaggaggagaatcttgttagataattcctaagttattctgaacagaatgcttatagaaatataaatagtaaggtcgttttgatgagctttcaaatgggaatgaggaatatgtttttagacaatggaggaaagttcatccttgttataaattggcaaagaatatggcagaattgtgtttatgctctcgtgttttgtggaaggtattgcttgtgagggatgaaattggatattttgctgagaaaatgtccgggcaaagtgttgaaagaacgtttgactcctgactgcctgtcataaaattcaagaagaaagaaaagatttagagatgcaattattaataaaaatggaagcaaaaattaaagatttggaaaattctcagcctattcatattgtaaagaatgagaaaacatgcttacaagaaaacaccaaaggtgtagccaggcaggcatctgataaaataagtgtggattggccaactcggtggaaatcaggacctattgctgaagtcagtggaaggatgacactgaaggtatgtcagagatcactgcgcctgcctctcatctcagctccagagggccagtgtttagggggacagaatgagttgaaggagaaaaaccactgtccaccactacctcgtatctcaaactgttaacccggcactttctggcagtagtcttcctcactgcaccaagtggagggtgcacattttgatcagcaaagctgtgggggcatggctgccttcacctatgtttcaaaggatgcttggaacccggacagagagtatttgcaagggggcgcactgcagagagcccccactaacaatggcaaaccgaatcatggggtggggccaccccaggtcaagacctttagagacagggatatgtgacttcaacctacgaaggctgtggctgttcccagaaaagcagttgggtagacctctaccccagtgtgtttaaaggatagaacacgaagataaaattcttatttatttgtttgtttgtttatttgagatggagtctcgttctgtcccccaggctggagtgcagtggcgcaatctcagctcactgcgagctccgcctcccgggttcacgccattctcctgcctcagcctctgaagtagctgggactacaggcacccgccaccacgccctgctaattttttttgtattttttagtggagacggggtttcaacgtgttagccaggacggtcttggtctcctgacctcgtgatccaacccctcggcatcccaaagtgctgggattacaggcatgagccaccgcgcccggccttttttgttttttttttgttgttgttttgtttttttttttcagatggagtttcgctcttcttgcccaggctggagtgcagtggtgcgatctcagctccctgcaacctcccccctcccgggttcaagctattctcctgcctcagcctcccaagtagctgagatttcaggcatacaccactacaccaggctaatttttttgtatttagtagagactgggtttcaccatgttggtcaggctggttgcttactctggacctcaggtgatccacatgcctcggcctcccagtgtgctgggattacaggcatgagccactgtgcctggccaagaaaatgattcttgagcctcaaggttttgggcttgctggggacctgctgcttctttcttatgtctccctgttggactgggcatgactgtcctatgcctgtcccatcgtttattttgtaaggttcataacattttcattcacagatttacagcgtaagaacgatttgcctcagaatgtataaggagcctcactcatacctgctttagatgagattttggacttagagttttaaattgacactgaaacaagttaagacttttagggctattgggataaaatgaatatattttgtgtgtgagaaggtcaaggatttgggggaagaagttagcgttagggttagtctgaagggttatgtcacctcaaaatatatatggtgagatctgcacctaccgaaggtgatgatgttaggagtttagacctttgggaaatgattacattatggagcagagccctcataagtgagatgagtgcccttatgaaagaggcccaagagaaacccttcacctcttctgccatgtgagagttcaagatagttttccatgaggaagcaaaccctcaccagactccacatctgatggtgccttaatcatgaacttcccagtctccaaaacagtgagaagtaaatttctgttggtcataagctgctccctttatggcatttttagagcagcgcaaatggactaagagcatgccatggtttggtttctttgtctccaccaatactcctgttgaaatttgatccccagtgtggtagtattgagaggggtaaccttgtgggatgtatttaggtgatggggacaaatacctaacggcttgatgttgttctggtaatgagtgagttctcactctcaaaagactgaatttatctgctcaggaatggattagtttctacgatatgggttatgatagagccaggacgtccctcaggtttttcagctcctgtttgcacatagccacttccccttggaaactctccactgtgttgcaacaaagcatgagatccctcgcccaaagccagggccatgcccttgaacttctcagcctgtagaactctgagctacatacgtctttttttattttttgtttttttgggaaataaactaccccagtatgcctttatagcaacagaaattgaaacaagacagagcatatttgataatatcctaatatctctaaaaattgcttgtgataggaccataggatatttttaggggttagaagagagtttagagagcgtctatttcaatttttcacattttctgaattcaaacagaaaaaaaaagggttcattgaagttaattgactttccccacacatacttaaccccatgcttaatgatttgttaacagaactgaggcaagaattaaagacctgactcctaatccatgatttctcttgtgaatatctttactacttttgaggcacttctgagacagagctcgaatgctctaaagaggatgatgatgataatgattatgaaaatagataacagttattctcatatgtcagcattgttttgagtgattacagactgaattttgattcttctgtcctatccactgcattttatgcctacatactgtgctttcacaccataatcatatagcatgccacgttcacatggctctcaagtattaagacaaaagtacactataacgagaggtttctattctgaaacatgctattttggggactatatgaatgcatttttagccatcatatttttacatttgtatctgaataaattataggaaaaggaaataatgagtgtataaaggaggtatgaagttcttactaaaaaattcagcagacgtttaacttgcaagtgcacattagaagcattttataaagcttgtgttaaatgccaatatttctaacaaaatttatctaatgccagtaaaggggagagcataagggcactgaaaagggtaagtatttacttgctactaggcttgagaagtaccacctctgcagcttgctcccataggtataatactgctgcctcgaccgactttgctaactcttcacctctgcctctttcagtgttgtcaaagattgctgccctgatttatggcatcacaaggctgttggttgcccagctaaacttcatttttttgcttcagaaaaataatatacagacttcatcctataaagcaattttgaaacccagggacaagacaaagaaaatcaatattatcacctaaagagaactctcttcttgactagatggtaggcttagtaataagctaaatggcactttgcatttgaatcacacaaaatgtttagtctacaatttacccggtggagaagagcacatgcatgagtaatccaaaaaagaagacaaaacatttaagtattatctttagcatatattctttaagaaagagtatttgtttaacatttaaatgtattttgaggctaacagtaaaaacaattaattaatcagtaattaatttagtttcatagatgaagaagccacaaataccaagaaacatatttgcgataaagaattcatccaatttgagatatgccatacattggataattcttacattgattattagaagtgtgccgtattttactttatggactcaatttaagatttcttatattattatagctttatactttggcatcttttttgaaaatttattgactctaaagaattactaattttaaaggaatgattatatttagaataattttaattttgaatacacatagataattcataaccaattatgataggactgtgtatttgaataactgcccaatatgaataaacagagaccttcgtggaatatgcccattcaaataaatcacctgctaagttttctgagccaatcttattctttgtttagaatatgaatttgcagtaactggaatggatgaatgagttataactagttttgatttctgaagttctgcatttagctgctcttctgctcttctttacaacttttgcaccataaaatatgaatcacttaatatttgattgatgaatagcatatttctgttaaaaacagacatataaaatagaagaggaaaaaacaaattgtccacattatggtcgtatggaatttatttacaataatttgctaaaatgagataatgcatttagttttatgttaactcgtgacaaaagactatcaagtcttttgtctatattattataaataaataattagatttatttgtaataaagaaatatacatacagtaacatttaagttccaaaaactgagttgaaatactctgtggaaggcagattctgagatgaaccaagacattctcaccttgtattagtttgttctcacgctgctaggaagaaatactcaagactgggtaatttatcaagaaaagaggttaaattgactcacagctacacatagctggagaggcctcagaaaactcacaatcatggcggaaggcacctcttcacagggcagcaggagagagaatgcatgccagtagaataattgtgagacgcctataaaaccatcagatctcctgagaactcactcactatcgtgagaacaggatgggggaaactgaccccatgattcatttacctccacctgttcctgcgcttgacacctggggattattacaattcaaagtgggatttgggtagggacacagagccatacaatatcacaactcttggtgtagaacgcttatgtaatcccctcctcttgagacagtcagaacttgtgaatagcctgggatatcatttggttattaacttacattctttctctgtgaaaacttattttgcagatgtatataaaggctcttaaagcttgattgactttgatttaatcaaaagaagggggattatcttgggttgacctgacctaatcaggtgagctctctaaaattgaagaacttgagagaaaaatgcccaagcttccttggacaggtggttagtagaaatctggatttggagaactacaggtgatgactcagatgcaagtgaggaggaatatgttattaggaactgggagaggggggaatccctgttttgtaatagcagaaagcctagcacaattgtgttctgcaggtaggtgggaaacagaattagtaagttactaatataggctaaatataggctatgtagctaagtaaattactgagctaaatgttataggtgtaggctaatttcctcagcagaaatactgtgaacttggacaggaagagacagagtaccagaaatactggaatgccagaattctcacagcatgatcaatctgatgaaactgatatatatatatatatatatatatatatatatatatatatatatatagagagagagagagagagagagagagagagagaactatatagagatctgtatatatatatatatatagatatatatagagagatgtgtgtgtgtacatgatacacacacgtgtatatcatatatatatgccaccttccatgagaaagaaaggctgtctcagagaacagaaccaagggcaacagagtagtcaagaagaatttgagtttaccctgatggacttcagaactgttatgaattcattactcctgtttattctccattcttccttttttggactagaattctatgcctctcccaccactgtgttgggaatgttggagccagacagcttgtctctagtttcatgaacccatacacggagagaaactgtacccccagggtctgcaccagatttagatgattcaaacaaggagactctggactttgaaccgatgagacttagatgagatttgaactttatgtcatggggtcatggggttatactcttgggatctttataatcacagtccccaatcagttcactttgagttaaacaggaaactatcctagtgggtctgagccagctaaataaagatctaatggttagagatgaaagaaatcagagatttttaactgtagtgaacactccacctggccataaagaagcagcctgccatattatacagagaactacgtggtggggaattttgagcaatctttagaagctgagaatgtcctcaggttgccagtcagcatgaaagtggggacctcagttctactattccagcatactgaaacattccaacaacttgaacaaacttagaagaggcctccacatttttcatgagaacccaatccagacagactcttgattttagccttcagagacccaaaggaaagaacccaattgagccctgcctggacttctgacatacagaactgtgagatcataaaaagatattgttttaagctggtgggtaaatttgtgataatttgtgactcagcagtagaaaataatgcatagtattcctattgcaatgatgtgggttttttcaatgtaatggatgatccaaatatcaattttaacatattacttaaaaacatttttaatatattgctatttattaatatagtactagtcctactttcggtagttcaggagatggggcaagatatactgtaattgtaggaaacaatcactccagcatcagattgacactaaaagttgagattccactagcctaatcattaataacttttcattttgatacatatttatattcctcctttcattcttttattccttcattaaactttccaggcatggatggctcgaagatgaatatgatggttgcttctctgaaggcaccgcacttccacactaactcagattcaactcaagtgtgtgactcacttcagatgttcatttatatctggtattctgtgccacactcccaccacatactccctcatttattttagtaaattacccacggaaggttgtactctaagaagcctaattctctttgtgtgtagtttttctctgcagcgtttgtttacgttagctggatatttgctctactgacacagtgattgattttatttcactgttcagttttattatcttttcctgtctagaacaagatatagcctgccatctgccttttgttcacataattttcattctgtcttggataatgcaaattcttaattttgtaataactaagtaaaattgtcatataatctcagtaactaaatttaatggatcctaagggaaaaaattataaattataactcaataaccctctgagattaaacaccaaaatatcttcaaaataatcaacttactttaatcctttttaacttctttcagatttaaatgggatgagtttaaataactttgttagttatggaaaaataaattaacacattttccaatttagagttattttaaagaatcaaagagaagagggagttaaaaatgtaaatcctctctcttaatatttcacaacactgtttagtttttcctctagaataagcaaggccaaacacaatttacaagtttggtgtaaatactaagatcaaaagacattctattcactatatatttcaccacgaaaagaaaatgttatgtactggagaaagcagtgttaccaaccgtaacttaggccaaagtgtaaattgaagtcttactataaatcttaatgccgccaccttgtgaattgccatgattgatgtatcttaaaaggattaagaccactttactaatataggaaatatttatttatgtatgtcatatagtagcataaataccagatggtgcagatttaaatataaacaatacacaacatatgctgagaaaattgctgaatgtgtgttaaatattggcaggtcttcctaaaatatacataaagcacactattgataagaaaaaaatcaccatattcaaatatacatacatttcaaatagttattaatacagaaacatcataatcaaaataaatatggaaaagttgacctggagaataattggtaagacaacagcaggcaacaggtacatatttgtatcttataaaaaataatgattatattcaaaaataagaaaaagataagcattctaatagaaaatggggccaaaatgtgcataattaattcataagagaagcataaataccctgtaagcataagaagcaaacatgtaaacatattagtaaacaaatacataaatttataatttaatgagtcattttcatctatcaaaatgttaaaaatatgaaataatgttggagatggaatcttgaaataaaagcatatgcactgcttataggaaacaaaatatttcctgaaggacaatttagcagtatatataaaaattccaaaatagggaacaaagatagaatatcacctctgaatcagaaatactacctctaggaatatatactgctgatgagtccatatttataagcatggaaaaatgcttaagtagattggttaaatggttctgggaatgtacatatactctttattaagatgatgtggtagattgatactgatattttactgtgttaagaaacaagaggttagaagcaagtagcgaacacgtgtacattacatttatactcttgtaactacatgggataaacatttaatacatgtcatctattatatatgtaatacatatatgtaaaagacaatgggatgaagatattaatggttatatttgggtgacgatatttttgcctgtattttctaatttttctaaaataaatatgtactggtttggtaaacacttttttacaaagcaacaaataggaatttctgaaaagatgtattaagtctaggaaagcaagagtatgtacattattttctatgttgggttaattgactcatctataatatcagaaaagaacccatcagtagagttttaatacagttttcgaggatatcacattgccatatactgacatgttgttttcagactaaataataactctgctctgtaatagaatttctccaccatttatcttccgagagacattcaactgatgactgacttactgcatgacagatcctgacggtaagcccaccagatacagtattggcctttctctccccttgatatgagtgcgtacacccttgaattcactttggtaacttaaagacagataataattagaaaaaaaatgtagccttggattcattccaggactaattatgacacgagttgtcagggtatcctggctggaaactgccactctccatcagcagtctcatcttaacttttctcatcactgccctctcctgtccctgcttgccgcgctgtacagcgacggccactttggcagaaggctggttagtcaaagtcagattgcctgagaaatctgctacttggcatttagtttcccattgctgctgtagcaaattagcatatgtttagaagcatcagataacacaactttattatcttacacttctggagtgcggattcctaaaacaggttttactgggctgagaccagggtgtcagcaaggctgctgccccataagaggctccagtgtagagtacatttccttccttttcccgtttctagagcagtatttcttggctcatagcccttctactttgtcagagccaccagagtagcatctttgtgtgcctttgtgatttgctgttacatcacctctgtgccttcagtctccatctctctttacttgttattgcattgggcttaactggataatcccgaataattcttcattttgaaatctttattcacacctgcgaaatccctttttccatataaagtaacattcacaggatgtgggactaagatgtggacaacttggagagccattatttatttgaccacagtagaatttgtatttctgtgttgtttttgcttgtttgtattaagctgatggggtctttgactgaaattctgaaagcaattattaagttgactttaaggccaaaggtatacaatgtcaactgataaagatacatcttaacacaagtctgccttcacaccttgctattgaataagtgttcttttatataaagaatttatttttaatttaaatattttattactgtagaaaaaaataaaaaagttaatctgtcctaaagatttaaatatgactttgggcaagtatagatgtgtttgaaattttaaaataaaagataaacgtttttagaaccagaatcacaaagtagccatttcagaaaattgttttgcttttgaaaaagatctgaaatggaattacaatgtgtaagagcacatgttcagtgtcagccagttcttccactttcttacgtgtgatgcctggactttaatcttcaatttcctttctgtaaaacagagaaaacatcacagggcaactgaaagttttaaatgtatgtctggaacgtagcaaatggtcagcagaaggtggctagtattgtatccgttagtgagataacaacatactgaaacttgggtagttaacactttcaaatacagtgaggctattgagcaaaggaaaatgaaataaaattgtataatctaccagaagccaaccaaccctcctttcctccctcatttctttccttccttccttccttcctcttacctcccttccttcctgttttttttaaagcttttgattgagtttgatggcaccataaagaaaacaactgtcaaaagtattctaatatttgaaatgaattatcgatggacttttattactgatatggttacttaaaccattgaagaagtattatgtgtacagacatgtagtttgatgaaatacttaaaatttaaagttaattttcttaagtaatttgaccaaaacaagtatcttaagtaattttgcttctttgcctattcattgagttactgagaaaatattgcagaactttccatcgaaccatttagaataatttttttaaataaagtgtgtgggtctgcaaggaatcacttggacaagaataaaggcaggaaatttcctgtaatttttagtagaatcattgggaataatacatattaatgtgtctgattctagctttacaaccattgtggtttatgtctgcccctgaaaatacacagcatatgtttgttatatggaaacagaaaattattatttttaattgatagcctctgaactagcagatttttaagcttgaggtcatggtgatgtgtttacgcttggctctaatcttcatttactgcaggccccctttgtgggacttggcatgttcaatgagagcaagtattgcacctttataaaagaataatgtgtctaaactagccacctgctactgacatgtacatattatgaaaaccaacactggcccacatgtccagggcctaatagtaatcagcatgcagatgccaaagatatttaataccctccttattgtaattgtaatgtctaactacacacattgaagagatcattgtggggctgaatcaaggcagacataatggaagtataaaagtatgtagtaatttctagggaagataaaataatggatacattatgataataacggataaattcaccccacatacaaggaaagattttttatatatggaatgtaagtttccaatgaagatgtgtttcttaatgtaatatctctcagaacagtaagaatatgtaatttttgcacaaagattggggaggaatctcataaatatgtgtgagatcaaattgaaatttgtgaacagaatttcttgtataaaaacagattaatatatgtacatcttgataatactggatattttcaaagtaaaagtcatattggaacagagttttgaaaacatattgatttttcaaaacaactatgaaggtgataaaggacatgaaaaaaagatacacaaatctatttctggcctcaagtctggtcaccatttttcaaataaaatgtcatttcctctaattacatagcctatgggccattttaagtttcaatgtgctgacaagggaaatttttccatttgttttggaaaaaaattgttttgtgggaagttctgatggccaaatatattttatatattttttatatttttgtttgtgtagagtaccacaattaaaaatgatagtagcaagctacacacacacacacacacacacacacacacacacacatatttttttttttctgagactgagtctcactctgtcacccaggctgaagggcagtggcacaatctcgactcactgcaacctccacctcctgggttcaaacgattctccccgctcagcctcctgagtagagggattacagacatgcaccaccacaccagtctactttttgtatttttagtagagatgagttctcaccatgttgaccgagctggtcttgaactcctgacctcaaatgacccacccacctcggcctcccgaagtgctgatattacagatgttagccactgtgcccagccaagctatgtatttttaatgacatttttgaagtttttaaaaatttgcatcttcagttgattactcataattgatatctctaatgttttattttctttcaagtttattttttaaagttttgctgttatttaaaaatttaagatcattgtcagacattaatgagaagatggcatttaatattcattgtgttgcttaaataatttttattctggcctggcactgtggctcacgcctgtaacctcagcactttgggaggccaaggtgggtggatcatgaggccagaagttcaagaccatcctggccaagatgatgaaaccccatctctacggaaaatacaaaaattagccaggcacagtgacaggtgcctgtaatcccagctactcgggaggctgagacacgagaattgcttgaacctgggcagcagaagttgcagtgagctgagatcatgccacttcactccagcctggacaacagagtgagacttcatctccaattaaaaaaaaaaagaatttttattgtgatatatagtctgtcaccaagtatttatgaagcatctacaaagtggtacatctggttgccagactttttaagaggaagcaacaaggcacagataagttaactcaaagggatcagcccaagccctagtatgtattgtgggaaaaccaacatgggtgatgtggtgggaaggatgagggcaggatgacctggtggttatggtgggtgacatctgaggttaggaagaattctataaatgtttagggtgagcagaggctgtgagaatataaatcacttgctgtgtactaaggggtacaaggagtttggaaattaacctaacattattggaaagtgttttggggtgtcttcaacaaagtgaaatgtggcctgatttatactttcagatggccaaggtccccatggtttctgtgtccctgaactccatgtaagattgctgtcagtgaatggtggcctggctcattcacagcagtggagacctcaacaagagctttgtattgagatagagccatgcaagagatggccactggctcaacggtatccggggaagaaaggacccaaggatggtcttgagcctttcgcctgaacacctgaggggatggttgtgccctttgttaatgccaggaaggtgtgggaggtgagaattaaaaaggaaaatgtggataagaggaagagggtgataatcattttgcttaggcccatcagccatattctgtttgcgatggtaattacagttccaaatggagacgttaagtaggaatttcaatattcagggtaagtctggatctcacacagtagtcagagctggggatgtaagccccctcgttagtgggggctctgtgtctgatgaaaattgccgagagagaggacagaggaaataagggacctgtgacagcctcagggggctcagctacaggggtctgtaagacactagcatagcggcctgagaaggcagggggaaaatcaccttagttacctgaactgataaacattagtaataaataaaagtaagtatgctagattttgctcttcaatgtgaattcatgacctaactatagaatgttgatatgtgtcatatttacatattcatgtaagtgttaagctttgcttccatccctcaccaaacagagtaatagattctagaccatcccaagggttagaagttttaatttaaaaaagtaagctttagtaaatattcaaggctgataaaagttgaacccaagaaataaagcaagaagatgtaaatgtactctgatatggtttggctctgtgtcgccacccaaatttcaccttgaattttaacaatccccacgtgtcaagggctggaccaggtggaaataattgaatcatagagacagtttcctcccatgctgttctcatgatagtgagttctcatgagaactgatggttttataaggggtttcccccttcgctgattgtcacttctctctcctgccaccatgtaagaagtgcctgttttgccttccaacatgaagacactgtaagtttcctgaggtctccctagtcatgtggaactgtgagtcaattaaacctcttttctttataaattagctagtcttgggtatttcttcacagcagcctgacaacggactaatacatactccaagctgtttcctcccccagctgcttttccatacgtgtttgtgagcatttccattcaaattaaagatcagggaatgatgaagaattaataaagagcagaagtaggagacctagaggtgtgactgtggctgtgtggtgtgtgtatgactgtgtttgaatgtgtgagtgtgtgtgtgaatggtgtgtgtgtttgtgagtgtgtgtgtggtgtatgagtttgtgtgactctgtgtgtgagacagcctgtggctgtgcccacacaggccagcacagagctgggtgttttagacgaagctcaaaattaaagaagttaaaataatttgaggaaagcaagaagcaagaatgtctgaagagaacaagatgagtggactggggaggggaggtgaagagagccagaccctaagtccagggaacatgtgttccagtggtgtaatgagtctttaggagaatatgatcaaggatcacttcgttttccaatttttcgtgatgtaatatgatgacttatttgacgttgaacaaattaccaatgatagttttattaaccataaatcatggatagttgaaacatcagtgtctcaaatctgcctgtttttatttcaatgtgttttaatatttcttgaatattatttagcagatttctggatttcaaaaaaaaaaacgaaatctaatagaataagcgtagtggattctgcattaaagtagctattataaattaaaaacctttaagttacagaattgaaacagtgttaatccacatgagataaacactaaaatcggaggtacatctataactagacctttcacattaaaaaacaatgtgttctatgattctttattaaatacattatgtaaatctacctttattttgagtgttgtggctttattttatcttctcctacatgactaaaatatgtaagagatttgtcgtcccctgctacataatttgcttatttaaagaattagtaatgtataggtttaggagttactgcacatgctttcatggtttattttaatcatccccatgagggagtcaaaagctccttcactgaagtctgatgtaagttcgccaccttgtggtaataatgggaatagatgagggtttaaaaacagaattcaagagtaatgaagcaatagagcaaagcaaaggtgctatgtaaaaactattttcctgatttaaaaatctgaaagagaaaattaacttttttgattaacatttcgtattttttcatgcaaacttatgagttatcctttaattacaaaacttttttgtgtgtttttaatgtatatatacatatacttatacataaaagtatatatggaaaatttctccaaaaaaggtaaatataatttcagtaaatcctagaaatcatcactgccaacattttggcttttgcatttctgaaataatttacataagtgcattggtatgtgagttttcataaattaaaaagtgtattctcagtttagccgggcgtggtggtgcatgcctgtaatcccagctactctggaggctgaggcaggagtatcacttgaacccaggaggcagaggtcgcggtgagtggagatcgcgccattgcactccagcctgggcaacaagagcgaaaatcagcctcaaaaaaaaaaaaagtgtattctaattttttacccaactttacatgttaataatctcccaccctattctatgttcttttaagaattaagaattccatcactataatgatttctggacacaatggaacactttgccaagttttagtttttaaaattttaagtggtaaacaagtaagattggaaatatttggattaaacaaagttaaacaggcatattttacctcatgacttctttgaatctttcagtgggtgcaaggccctgagactcaccaaaactaacataccatatttcttagtcttaaaggtcctctcctcagcaaaatattgtactaaattttgtttccaaagaatttattataaagtatttgaataaatgttaactgaagattattttattggaatttttaaattagagttaaggtacccatagataacatcaaaatcaggatgtatctactaaattactgtgaagattttgttactaaaattataagctgatactgtccctgttatccaagcctcaattctatcggatcatttacatgtctgcaaaaacatttcttttagattgcagcccaaggttgagagctattctgttctacatatggcctggcttgcttttccaagatgggatctgaatgtctctcttaacaattggatgttagaaaatacctgttatcttgatggtctcattaaactgttaaaaaaagagtatcacagctaaatatcttacacagctaaaccttcctcctattaagtagtacaaacacattccaatacgtatttgtattttatttaatatgcataatttatgttttctgcttttcttgtagaattgaaacatagtatttcatattagacttggttgtagcaaaggcatattctccaaggtacaaagataactaggaggtcttagcttcagagaactccttgacgcgactttcaaatatgcattctcgtgtagtcttaacaagggatctgtgaatgattttcttcactttacaaattagaaaatttaatgtcagttaagtcacgtttatatcatacatcttaacattttatatcatacatcttaacattttatatcatacatcttaacattttatgtcatacatcttaacattttaagttttttgttttgtttcatttgcttttgttttggtaacggtggtggtagttcaagaacaggtaacattcttttgtcatacaccatatgacagtatctgttatggtttttaaagatctatcacatttaattcttaaattttatgtaatagttataattatccccattatatagatataaacagaaactgaaaaagttagtgaatttgctcaagatcacgtaactcacgttggaaaatcaggcatattgattccacagtctctgcacagtactctcctaaaacggtttacaattctgtcttgtaatgtttgtattcatgctgctgacactatacggcattctgtgcattattaagtcgcttgggtaagtattatctttatccccattttacagatgtggtaactgagcaacttacaggttaatcagctcaagggcaaagagtgtgaaagaggcaaccctgggagtcagagaccaggtggccaggatgcaagggacttaatcactgcacaccacacactcttataaacctgcttttgctcacgaggaagcaatctgtccttaaggattatcgctcctgacagcccaaatcacagctgggctctctgtcctgttggcaggactcttcaatcccaggctgatgtgtgtggagaagtactctctgagctgtgtttaatctacagtctattgcacagccacaaatgaatgctttgcacaaatgcatatgtattggtgtatgtgggaggaggaaacagtgaagaaaggttcattttgaagtgttgtagtgtctactttctaggtgagtgctttaaatcaagagcaatgatatgcttatacacaggacattattttggctgactagaatattttgcttcattaatagaaatcaatttccatcttctttgggtcgttagatctggatgataaaatggtgatgtcaataaacccaataaagtgaaatcaagttagttggagggtctcgtgtctaaatacaatttcaagtagttcagtgacaaaaagcaatagcaaatcgttccatctatgttcttagtgttttaacgtcaatgggaagctctatttgctattctgatagaaacaagtataaagttgcgtgtcccctcttgtgaccctggaaactgtgtgaggtacttggcatttggattgttacttctttggctgccactttattacaaataaattttgactttccttgaaatcactaggaaataaagcagctggtttataagggacaatagcttaaatgatgaatattgaatctcgtaagtagaataagtcttatgtaaattggtcgaggaatatgtgctttgtcagaaatagtgaaagaagcaaagacaggatgctgagtttagtttctgagaatacatgctgcccatagccactacatgctgcgttggagaccgtggccttgattggaagaccatggccttgaaggttagttctcaaccaataaacacatttgtcagagtcttctgctctctggaatactaaggtatgcaacccagtcagagttaaccttttgctaagtaatattaatcagttaaaatatctgttgaatatttactacaagcctagtaagcttaagccattatgagcgattaaacataaacattaatttttaaaaaagcatagtcacaagcctcaaatatatacaaaaaagatgataaaatatactcttaaaactttaaaaattacatgtgaaataggacttaaggaacagctaagttttctgatagattggaataatattgtaagactgtttaagacaggtttatagattatagggttccgatgtgatttggatggcagagtggagaaggggtatctggggcaggtagaaggagggagtggtgtgtggacacggtgccggataggtcaggagtgtgctaggagcaatgggctacacacattggtgcaccgagtgcacgcaagtcgtcgaaagagcaatgagaatgtaggcttgatttggtctattggtgccattgtagttcttaaccaggagagaaatgagagtctttagtgcatcattgcatatatgcatttctgagagagagattcagacaataacgaggaaattcggaacccaatataatattatactttgggtgtctataaaacaaaatttatttttgccaaaggtatgtacaattttatacattgctacttttttgtttgtttgtttttgtttgtttgttttgagatagggtctttctctgtcacccagacccaggctggagtacagtggcgcaatctcggctcactgcaacctccacctcccaggttcaggtgattctcctgcctgagcctcccgagtagctggaattgcaggcatgtgctaccatgctcagctaatttttatatttttagtagggacgggcttcaccatgttggccgggttggtctcgagctcctggcctcaggtgattcgcccacctcagagtcactaagtgctgggattacaggcgtgagccaccacgcccagcctctacattgcttcttaaccatatcaggatttgcttacttgtttttatttttcatttgcacagcaattctttattagcaaaagtaaggaagaaaatacatggagaaatacctaggatattacaaacacccccacccccctcctccacacacacacacacacacacacacaaagaaaaaaaaagcaccacaaacaaaagggaggctaactcctaattaactggcatatttgcataattatttaatgtgaaaaagcatgttaaaatgtgatttattgacattcctgaattacttattgcattcttggtaaaaccactaatatgtagtaactgatcctggaacattgatagtttcacaactaccaagcagcagaaacagacacaatcccatttggattatttggaattcaaatttcagtgctcttaccaacatactaatgcacttcactcgattaccagaatgcaatgttatttttatttatatgtttaaattttaaactaccccttcctatttaataattataataatttttccaactcatagaaggtcggtaaatatataatttttaaaggtatttcctacttgatgggtaattatactttcaaaacgtatactacaatttgttaggtaataagtattttaagcatttttacaaaagcattttacaaccattctaatataaactttgccaaaatctcctttatatgctgcatacaaattttgacaacattcactatctaattaacagaccttatcaattctgcaaaagccattatagtcagctacagaaattcaaatttagttgcttactaaagagcaggtctttacaataatatactggattgttaaattttacattatgaaaggtttatacagaacagtacttaacaaatcattagcaaaataaagtgttaagcgtgatactttttttttcaaaatgactactacatattttctactcttaattttcattttccaaaattactattatatgctttttactctttaaccaggaacataaagtcaaaatgaacagagagggaactgtttgggttgggggaggaggtaggggatgaagaaccaggaagaatcacattgcttgaattagctatttctttgccttacttttggttttcagaatttgagtgtttttttttaaaggatttctctcggagtattaaaatacagtaagttgccttaagtatattaaattgcaaagtattgttttgacagttgtggttagtgtagcaaatatagtaaagaagctaactctaaaacttatgtaatatacagttttgaaagtgaaaaataaactcattataacatgactgcagtgtctaaatagtactgatcattaatatatcttcatttgtcaatcattggaaattcatatgtttcatgtgcaatagattttgctagaatgcctgtccttaaaaggattgtagagcctttattgaaaaaaagaaacactagaattgcattttatctgatacatggagtgaatacaaaggtaaaaacaaaagttagctttaaaagcactttctgtaagcaaccatccacaatgcaatattactataaagactgatcacttaaaatattctgtcactccaataatgaaagaaatgtatttttccttatattgaaatcatatctaacattttacattgctatattaaactcatgttttctcatcattatttagccatattttataccttcttgaagttcatattttacctctcagtcccctcaatgtgcattgtaatctggagataatgatcattgtacatcaaatcactagaatgtatgaaatacatgcgtagtaagctaattttatcaccatatatattaaatgtaataagcataatatattttttatgttgttcaggattaattttttcatgattctgaatttccatggcattttgttttttcgtattcttaagtaatgttacagggtttgctttagtgtatgttattcattagtacttggtaagtatatgtttttcaaaattatttaaaaatttctattaggtgtttttgcacagtaaaactaaatttatacattctttctgtataaagtataatttatgcccatggtagatgcttcaggtttgctaaataaatatgcctacttaaaaaaatgtggataatgttcttcattttaatgatggaaaataccctatggcatttttacaagctgagcctctctagaggaatgccagcactcttagtaacacaagaaataattaccactacggcaccgtttctgaaaatcgcacggcagatcatttatctcagtttgtggcaaattattctaatcttttttttttagatttgtaatgtgagtgatttactactgaatgtcagttataactttcctcctttgtcttgttcttcttctttttagctccttgtgaaggcaacacattcttctgccatagtaacatgtgtattaataatactttggtctgcaatggactccagaactgtgtgtatccttgggatgaaaatcactgtaaaggtaatgattagtgcctgaaatttgaaaaaaatttcctccctgtggagtggggtagaagtttatatgtatcaatcagacagtctttaaaataagagtgtatagtgccttttatgaccaccgcatatgtcttataattgatttgtaagcgtttttcttagcctttactcatgctctgtccagatgttccgttattagtgcacagtggactatcctcagtacttgaattctcattaaagacatcaccttattagagcctgcagagctatgaaaacgggagctttcaggggagcacactactttcctgtcatgtgtgatgctgtctgcttgtggctacacgtctcattcattccagtttgtcttgattggactttgtgtacatactctagagataaaatgtcttgaactagcatttgtactttcagttacttccagctacttcactccacttcagttttgctacgaaaatgcttttcttcctttcccgggaacatagctcccaaagcccttgcctccttcccttgtctatacacaaaggcttgtttatgtgaacagggatcgttggctggattatggatgttgcatgttttagttaagatgaaactgccatgtgaagtattttactgagatccaatattaaacagttgacaaaagaagataggcaaataactctttcatgcttgaagtccagtattatctactaaaagccttctgtgcatagaagtaaagaagtaataccacagtattcattgtttcatacagtcagtaggagaggcagttacactatcaactattttgttgttgattactttcgtaatccattacttttgaatggattagaaatttactaagtgatcttattgcagacctgttaataattcgtggtcaccactggctttgttttgccctatataaacgtggtcccatgtgtgtaagaaatatttgacatgcaacaaatgtgaatggatgtgcattatgaaagtccatatttatttttttcagaaagaaaaatgattcctttagcctttaattcattctcttgtgataggggaaaaattgcattcatttctagtttatggaggttatgcctatggcgagcatgtagtgtagcctaaagtttgtcccatgtgcacttgaaaagaatacgtatttgctgttgttgagtggagtgttgtatagatgcctgttatgtctgctaggcataagcctataaacttaaacaagctataaagcattgttcaagtcttctgtttgcctttgattttctgctatgttttatccattattgaaagtgggtgttaaatttttcagctatcatggttgaattgtctacttctctcttcacttctgtaaaatttttctttcatgtaattttaagcttgggtgctaaattcatatatgtgtgtaattgttatatcttcctcatgacgcttttatcactacaaaacaatcttctagagtttagtgcagttttttgtcttgagttatattttttctggcattagtatagccactacatctttcttatggtttggtttccattcttcttttccacgtttttactttcagtctatctgcatgtttgaatataaagtgtttcttttgtagacagtctatatttgtatcttattttttatccagtctgaaaatctttgcctttacattgggttctttaatccattcacatttagtactgtcattgatatagttggacttatatattccattatactttttgtttctaaatgtctcatgtattttttctcttttccttctttattgctttcttctgccttaagttagtatattctagtccaacattttaattattttagagtttttaatgcattgttttactttcttagttgctttaggacttaaaacatacagcttagcttctcagaatgtattagatttctactaacttaattatagtgagacatagaaacattcttcctatatagctctattctcttttcctttttccaattatatttgtacctattacatttttaaacgttacatacccaacaatacattgcaataattattactttatataactgtatgtcttttaaagtggttgggagaagaaaggacagcaagtatattagtgtaactttttatataatccttctgatttactatttctggttctcttcatttgtttttctagatttgcattaccctggtgtcatttcctcacccaataacattttagctcccaccttgtttatactatattgtcaccaaatatattgcatttatgtaagctatagtccaacattacgattatatacatagaacattgcttttttaaaagagttaagtgaagactgcagaagaaagatgccactctactgtcctttgcaattatttacatattcactgttacagaccttacttgcttccctgtttaatttagtatctgttcaattttttcatgtggatttgagttactgtctgaactcactggttttcaacatgaactctcttccatatttattttaaggaagctcttttatcattgaattatcttcatttttgccagtctcacaatgtctttcatttgtgaaggcaggtttgctggataatgggtttttggttgacaggtatctgctggggttttgttgttgctgttgtttggttttattttgtattgcttttgcttgcagcactgcatgtgtcatcatgttgccttctggcctccactgatgataactcaggtgttaatttgattgaggctcctttctatgatgagttttttttttcctctgttgctttcaaggtgttttatttatttattttaatgttttcaatatcatatgcctttgtgtggatctctttgcatttatcctacttggaatttgttgaacttggatgtgagttttctaattaagtttgggaagttttagctcctctagttttttgttgttgttgtttttcctgttactttccatctctcctttgtttcttatactcccattacagtatgttagtgtgcttgttgatttgccacatttttttttctgaggctctgttattgttctgccttcttgttttgaaactcattttcatattgcactattcgcatgcctctgtctttataaagttagctgatactttcttcttccagctgaaatgtactgttgaggctccaggaagttatcatgttagtaattgtactgttcaattctagactttacatttttatatgatttatatttcttcattaatattctctatttgatgagcattgtcctcattttctttagcttcttcagtcatagcttgctttagttccttagacatattgattatagctgctttgaaatctttgccaactccaatatccggctccccaaagggtcttttcattgcctgcttttttttttcctatatatacacttcgctttactgtttctttacatgtattataatgttttgttgaaaatcacatgttagattagtagcatctctgaatactaactccttcctcccaggacttgtagtttttcttgtttgtttctaaatgtagacttggctggaccattttagtgaagcctctgatgctgcaccacagaggccaccgccttggacttcgcaccatcagccttgggcaacacggttttaacagggctctctgtgcctctctcatttcctgttctctctatttagctatcacctctgttggtattgcagccagttgttagtctccaccaattgccggctgattgctctactgcttttgacagtgcccaagatcataaatttttctacagtctagtcaattaaatttaattaattgcaagggtagtccttgagtctagcctttgtgagttgttataacccaggaggactctcattagctgttactctcctagctcgttctgttaaacttctagatgttctaaggttcgtcttatggctcttaagacactaactgtctcttaattgcatacttaattgcacactgcctcttaaatgcatacagcactcggtattcccaggtggtctcctatccaagtaccagccaggccctcataaaacactaagaggcagttagtgtctttagagcaataagacgaactttcgaatgtccagaagcctgtgcataccacaaaatctccatagtttttgaaattatcattaggcttaagtttctccacacaccatttcaaataaactaactttatttaggggaagctataatgctttctgtactttcagcctgactctctttctgggcacagcttcttctgggtcggggcaggaacagtggtacaggtctgtttatgcacagagcacttgggtgaggttgctaacatgtggtgttgtcaacttgccactccaggcagctctcctgtgtcagcaaacttgggtaagcatgatccaagcctggcattctccactggagacacctggtgttgagctcctgccctccaagtgaaggctgagaggaggaacctcgggagccccagacatctcagccactcaggccagaaaagaagcatgtccaacatggacctggttgggcattgagaaatgctggtagctttccccttctaaggagattccataactcacttaactgggagctgcagggagagggtgccctgcgttcttgtccacacctccctgagtagggttcccatcgtggtgaatcaagagtggaggaagcaagtcatggctcaaatgccacagactctcactggtcctaaggacatttagtagattggtttatataaatatatttccacttgatgtacatcattaggacaatttcctgagtttcattaaaccaggctttaattggttgagtttttaaaataattttctaccagttgtgattatttcatttgggaaagagtccatgccatcattccaaaagtgtgtgtcttcagattgaattgaattatcctttggtatcagaatattgttgttactttatagatagattgtgtgtgtgtgtgtgtgtgtgtgtgtattttaagatgagatgctggacgatggggaggggggctatttttaagactggtcagtgtattttttgtgaaaaaagagactttgtatttattttaaaatattttcttaacctacgatagattagatagatagaggattgtgtgtgtgtgtgtgtgtgtgtgtgtgtgtgtgtgtgtgtattttaagctgagatgctgggcaatggggagggagggctatttttaaggctgctcagtggatttttttggtgaaaaacgagaccttgtatttatttttaaatattttcttaagttattataagcctgtaaaaattctgtgctcagcctgctttactttaagtttttaatacacattttgactataatattaatgtttgctgcgttgcttcttcttttgtccgtttgttgttttcactctctccaacctatagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacagctactcgcaagatgctgcagatgcctgtgacatagatgaaatcgaagaggtgccgaccaccagtcacaggctgtccagacacgataaagccgtccagcggtcagtatcaatagattttttgatgacaactataacctgaagactgaaatacttccagagtattgtcttctattttgtcttcatatttcagtttccctttaattaatgatttaaaccctagttttccaatagtttccctcttctttttccttttcactgctatccatattcttcctaaacctcatacatgtgcacgatatgtatgtgtgtgaacacacatgcacacagagaccaaagatactttatttatttctaaacatatacacatatttattttataaaatgatggcttttaatttataatacagatttataatgcaaacttacttccatgtgaccattgctcccatcaatatttatatattttgagatatgaaatgatatttgaaaacgattgccttaccaagatggctcacccatcttgatggacaattttaatcccaaaataacatatttttcaatataatgtatttatttttggtaggaacacaaaaatacttttctttcacatattacataatatttatattaggaattgcataggatagtatagtatattcatcatttacacttaaatgttgtaagaaatagtagaaacatttgatttattttccttcaactataaatgcaatattatctgtgttgtagtattagccttaaaatgagtaaaagttttgagaaaaaacatttaaatttaggaaaaattattttaaattccaaaatcttgtcaacttatacttcgttttgcatgtttactagcatttagtttattttataaatcgtgacatactttctccattcattacattctcaaaacctaaaatacttcagttgatttgatatgttttgcatgctgacataagtctatttccacagttttctgaattttaaaaatgcttttgagtaaatatttgtatacatatttttttgtgcaaatagtactttgttgaatgaaatagccataacattccaggttctgcctcattgggtctctaagcaaacatgaatctgaatacaacacaactagggtctagaaagaaaattcaaggtaagcagatgcccttggttccttttcctactttgtcgtattctgttttgttgcaactgtcttgtagttttttagggaatgtgctatttatccattatttcttgagatatgtgtttcatgacatttcacaattagaaatacgatgggttcagtgtttataggagagatgattctcgggatacatacctttaaaacaaatcttagtattcttaacatcaagaattgtactaaaatgtaatttagaaggacgtcaaattaataatctaaactttacatgttttaaggtaaagttttaatgaactatctccaaagaaatactcgaaaaaaaccaaggtttttaaactaagaaaatagaatattcagtctcagtatagctgaagttaatatttaaaactggtaactactttctttatgtaatttggcaacaattgtactcaaaattcgtacactaaatatttttggtactgacacaatttatagactcttatttttgcatgaatatgtagctcatctcatcaaaattaaatgcagcatgttaagtcaaattttatactataaaatttgaatgcaaaaggtttcattaatcccagttgtctacgtgtacatcgattttgtcatcagatatcacaatggctttactttttgctcttgattgtttatatctatattagcctaatttgtctccaattgaatctgcttgacagctaatctcttctaaactcctcaagcctatcaactattcttgaactaggtgaatgcatttccatgctctatattaccttaataaattggtgtatttgtatgcatttttcattgggagaaaatgttttaactgttttttattttcagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctgtatacccctgatttcctttttgttttatatcaaagaaagtactgagtttcagaaatcctttttgaagtcaggtattttaccattcatactctacagtagaaatgtttttgattaagcactcagcaatatgaccaaattgacagtttgagaaaataccctgcatgtcagtactggatatttgagttgggaaaatatcctttttgttagacacattgtgaaaagcatgcattgtcaaatactgttgttactcttccatttctttatgtcatatgcttgctacttacgactttttatataaatatatataaaatgtataataatttcctaatttgagttaagagaaatgttttcttccattagagtgattaaaaaactgactcacataaatacacattttatgtcaactctttccaccttttagggtacaggatgtccttcagtattgaggtttacttcccaaaatatttggcttctaaaagtttaggggaatattttcttcttttagaatagggaactctttttaaaactgctttaaaatcacaagcccttttatgaattaaaccaccattatgaattattcttattctcaggtacacataatacacctgaaagcttagtgattatgatgtgtttaacataaagtaaaatcctaaaatatattttactgctattaaattatatacacactctgtaaagtttgatttggtgagtggttattttttaaaatattcaatgtgtaatcttacaaaataaatttttaaaataagaattactatcagtatatatgcttcccaacattttcaaaactactgaattctccaggtttaaagaactctgtccttccactaacagagcagtctggtctactaaaatttggactttgcaattcaagcaggctttgcaaactagatgaattactgttatacttccctactaggaatacaatgtcatatatgttaaaaaataagcaaatagaaaataaatttttataatagaaaagtcaaagagttatcatagccattataaacactctatcttgaaaaaatgtcaagctacagaatcacttcaatgaatttgataaactagggaatcagaaaaggttttgaacatgacaaagattatttttcattgttatgctacatagttttatacacattgcttatgataaaatgtacccttttttatttggcttgactggtttatttattaccatggttccttttttgccctttaatttaaaattaatacaccaaagatttttttaaaggattaatcatatcttatattgctttctccatttagaaatcttcagaggactcctttccctttgaatgataatctcaaaagtatgatataactgtcaagattttttatttgtaacagcaataaaaatagtgaaataagttaggtgaacattttactattaatttgttctataactgtccggcatgtccgtcccctccagtttctcctgaatatacagaatgctgattccctgcttaaaaggtattttcaccagaaatctaccaatgggactttaaaaaaaaacactaaatgaagtataataataagaatgaatagctcacatatatttaacacacagcagcttcatgggaaaacaactgtattttaaatgaagaacaggcctcctcagtgataactctaaaatttctcaacaatgtacagacacagactaatcatgaaagaagataatgacgatgctgggcagtgtctggaggtagccttttctcctggcattcactctagatgctcaaacttgggagtgcagcgctctggcagagttgggagatgttctctggagggctctggcggtgcttatttatcagccagtattgaaatttgtcaatatatcaaaaacgatttagtagctatatcagaccttatcacctgaatgcagcctttggcccacattctaaaggtggtgacacacatagataaggaatgagatgtctcaagacttataagacatgttattttaataaatgattatattttttgataaagtgaattcaaatattaccaacccaagtgctttattgatttaacaagatgatttcaaataatgcattaagttagcctgctgtgttaatttcataaagctattctttttcattttattttttcaagttttcattcacttttcaaaataatggtagcatataatcacatgcaatgccaatgaatccccatattaagcttcgtacttctgtccaaatgtattgtagttgcctaatttcaaggttctaatttggaaatctgatttattttgtatgtttttatatacataccaattttaagcattatcttgcaaagtagacataggtggtgtttgatttgccataattaacttgaatttgattttgtaaccaaaatgtggctgtccacataattggagatcagtgtctttgggcttttaatggagaacaaatcacattgtggtgttgctggtttttctgtttcacatttacttttgctctagaagtatttccgtgagtctgatgactccataagttatgatcctcagtgttaagtaacttagacggttggcattactttaatattcacttaagcttctgtatcatttttttctgtatttttcccttaggaatttaattcgggtcttcctcaaattttacagctttaaaaaaattccatgaatgggttttcctcaacctcagaatatcataataaattacaagatatgaccccctggttcctattaccttgattaaagtggcggcaattaatttactgatgttttgtcagtgaaataaataatagcatcttatgaagtttgtgtatctctgatgaaaatgagtcatgtcagattccctctctgaagggaagttaaataaacaacatttttaaaattctttgaattctaaataaatatgctttgaaaagtgagttagggttttgtctaattgcactgaggcgagctagcttcggtgccatttttctctgtgcccttttccctccatggattcatttctatctattgcactctagcgtaaaggacccagccaagaaattgtaaaatagattcaacaacaaaataaacaggtcttgagttaattatcaatctctatgcacttaattaatatttcccaagcccatcttaaaggtgtaataaggtagaaaaataaaagtacactgttaaaatagccagaaatgtttttataaataatcctgctaaataaatctgaggccctttgttaatttacaattatgattcattttattaataaacttgtttgaattgtaccacaaatttaactgaattgtatcatcaaaataaataaaacagggtaataaaaataacaattagggtgactgatgtcagacactcatatcaactcatcattttcttgtagcctctgattctgtactttcttgtgtattattaaagaggtaaatgctctcttaaaatgcctctagttcctcagaggtaggaaaaataaactcaacctgctttggacttgtgtatttacttgggttggtttccagaatctccttattcctgaaacagtatgatcatgtagttaaactactcctttatatctgtaagtactgtgcagccaacatgttcttttttgtccccaacttctgccatctttccaacctctgaggcatgctattttatagtggtttgctctttgaaaaattgtttttgtgccctctcttaatagtcacagatactgacacaaaacttaaaaatgaccagaaaacaatgtataaattatttaaaataaaacattctttttatatcacattatcaaatttgtactctttattcacttttccattaagtgtgatatcaatatagctaggctgttttgagcttgcacagtctgtctaccaagctccttcctaagtactttgagggtaaaatgaagaaggcagtctaggaaggaacacaattacagagccctgtagaaggcagactgcttacaggagctgtataaggaaaattaagcccaacattatgtgctgtgttggccatcatgcaaagctgattgcaaagccctggttacctccttcatcatcttccatggaagataaaaataaattcaaatgttaattcaatagacatgatgctttataatgaagaagtttgtagcagaaacctgagaatataggtatcttcttaagatcaagagaggctttgtgaataactgaccttctaagcaggtcttgaagaatggagacaatggtcaaatagtagtgcagggagaaatttccacctagagtaattaaagcagatgtaggctcagaagatcatctaattgagctggttggaacatagacaggagacatactaagtatatttgacagagtaggtttgagtttacatcatgatttctgagtgcatggaatactatccaaaggaatttacactttattcaagggagaatattttaagatctcagcagaatggaacttaagatttctactttcagtagaagcctctgacaggtatgtttgctaaattgaatgggagtgaaatacagtagaatcaaaacagtgtagaaacaagacatgagaaagagtaacgggcagattgttagatgtccaggaatatttgtctggcttttttacttctactatactttattgtttcaaggtgatggttgactagcgaacatactgagggtcacatgccaaacaccattttgagtgttttacatgtaatttttttccttggtcatcttagcaattctatgactaattaataatatttgttgttatttattgtacagatgaggaaactgaagagttttagtaacttttttaagattacacaataaacaatgatgaatcaagctttgaagccaacctcaccaaccacaagatcaaccaacactcttcaccaatgtgtaatataaccacgttaatattcaacatagtacgtactgctgaaagaagttgatacttattcatattaaccccgtagttttgtgtttcctcatctgtaaaagtatgtattataacaccttctctccaccttacagcgtgtgaggttcaaatgaccattcattggaagatattttttatatcctataatgcattataaaaataaatcatttttcctaaa

SEQ ID NO: 158 - DNA, 198293 bp, Homo sapiens
caggaatttgctgcactgacaaaagaattaaatgcctgcagggaacaacttctagaaaaggaagaagaaatctctgaacttaaagctgaaagaaacaacacaagagtaagtgtaaagcagcctttttggaattaattctatttgtagttcaatgcattacatgtaacacacatataagaagaaaatatatgcattttaaaactttataattactttaagcagatagtaactcagttacttaaagtaaaggaggatatactataaaactcaaaacaaaaagacaggaaacctaaattatagtcacagctactaaatcactatgttgctttacaaaatgttcacattccttctggcctttactttatttggctttaaaaagaagatctggatttcaataatgggtttcaaactttcaaaaggttgttttgggggtagggtaatccctcagaggttggaaatgggcaaaagaggagagttttggaaaagaggaagagtttaaattaagggctgctacaaaagagtggcctgggtttggttctcacctcctcccagcagaagatttttttaaaaaggaaaaaaaaaaaaaggccggacgcgatgcctcatgcctgtaatcccagcactttgggaggccaaggcaggcggatcacctaagttcaggagttcaagatcaccctggccaacatggtgaaaccccatttctactataaatacaaaagtcagccaggcttggtggcacgcacctgcagtcccagctacttgggagggcctgggaggcagaggctgcagtgaaccgagattgcaccaccacagtccagcctgggcaacagagtgagactctgtctcaaaaaaataataataataaataaaataaaaaggaaacaaaaaatagtgtcaagaaaaaaaaactgaaaaaaaaatctgcccattaaaagaggagtgcctttatgttttaataaatttccaagggaatgtccagccatgatattctgatttcatgaaactcatggaatttgctagattctacttttggaaacccatgtattttcatcaagcatatgacatgccatgtaacattaaagttcagaatttgataaacatgctatattttctttgagaaaaaaaatcactaaattttataaacatgtaaattaccacattacccatagaggagtacagtttactaaaaggaagtagaaaaaaaccacttctatgtggatgtaagttcaatttaaatacaactgaagttggtgaaaaatagtttaaatgttatagctataatagatcaatcctgaaaaaaataggtatagctaatggcctattcactttatgagtcttagagagtaatataaaatacagttctactaactgggagcttgtgcctttaatgagagatagggttgcttgcataatggttacatgatcaaactgaatttatgtccttatttatcaaggtcttatttcatggtaaagagaattcacatacatgcatacattgaattggttttcaatgatactctgatgaacctgtcaaatggattgcctcaaacagggcataacaagggcagtttagatcatattatcaggtatcagacaatttttttcttttgctgtcttcctctctatatatttcctacccttgacttttttaacttaacactgtgttttcgtgcaaatttaaaatttatttataccatgacatttattctgccctattccactatgttatattttagtactttagactacattccttgatttaacacagcacactcaagtgtaaaagtaggagcagaaagctgagaatgcagggaaatacaaagctttggttaggtttataactaatgctcacatttaaaatgcaccagacactcttttattagctgtgtaggttcatctagccttttttcttcagccccttactcctttctacacccctctggagatgttataattatctcaattttacagaccaggtaagtgagctcagaaaaggtcagataacttgccagaagtcacacagttagtaaatagcaaagaatgaatttgaaaggtaaggcagtctaaatccagagcctgtgcactaaccatgaggccatcagcattattactcaaagacttactacagctagagaggacattgcttaacagtcagaccaccacagtatctaattgtgatgaattttagagagctaagagatttggtgacagaatccgtacaattttcatcatattgaaccccatgagaaccagaaatacccgaggctattgtgtttgcaaaggagtcttggataataaagggaggaaggtgagccacatgtgaagtacctatttgggagtcaaaattagaaaaatacaaagttcctttaaaataacaataacagatattgaagccattgatttcaaccatgcataatagttactttgaaaatatgaataaggctggaaaatacatttctaccttctttaaagcagtgatgtggaggatttttgttgtcgactgcatcaaggaaaacagatttatgaaaacccccttgtacacagtattaattatataataactccttaagttacataaccacctctcaccctcctccatcccccagaagtagtatatccagagctgaaaatcaaatatgtctctcttcacaccagatgccttatcaaatgttgctaaataaaaccatttttatagattttatagttgtttctctttctagatgttgtgcttttcttcttgctataaatatctgtgtgctggtcatagagacaaagcaacaagctagtgtttccttctcacatgtaaagaaactttaattggtgtcagattgtgagcaaatttaaagcgcaagtgatagctgggcatggtggcacatgcctgtaacctcagctgctcgtgatgctgaaataggataatcgcttgaatccaggagggtgagattgcagtgagcagagatcgtgtcactgcactccagtctgggcgacagagggagactccatctcaaaaaataaatacataaataaatatataaaagaaaataaaatataaagtgtaattgagcattccaatttccaaagttctgatcaacttgtggctcactttacatcgagtagttaggatatgttcatgaactgagctaaataacataaaaagccagtccatgaaaccatgtgtggatggggtcatttgtattaattttgaatgttatcaaaaacaatagatcagaaaaagtccttctgtataatgatatttggatgaattataccatcttccaaaatagaaaatagaagttccagtgggaattgaatgaagatagagagtaataatgataatataatagctaacattaaaatctaaatgtttttatgaatgttttacatgtttaactcactttattctcacagcaatctcattattcccatttaattcaagagaaaactaaggtagtaagtaacttgtcccaggcctataaatggcttataaatgaaacacccagagagtccactacttccttctcagtttacccacagactatgtatttaagaaatcatattcctatgtcacccacaattcacatgtgatgcaaaggtattatgttcaaagaagaatacagtttgttcaaatttatttttttctttttttaattcttttgagacgaggtctcactcttgctcaggctggagtgcagtggcacaatcatggttcactgcagcctagagttccctggactcaggtgatcttcccacctcagcctcccaagtagctgggactatagccacatgccaccatacccagctaatttctgttattttttgtagagatggggttttgccatgttgcctggacttgtctcgaactcctgggctcaagcagtcggcccgtcttcacctcccaaagtgctgggattacaggcatgagccactgctcctggcctatttaaatttttgtaattcaatcctactttattttgtgttagtcatgtggaaagtcaatctgctatgtttttattctgaggtcaaagctgaaatgtatgtcctggccatgtattatgttttctccacagaaacacctcgttgacattgcaaaaatttgagtgaatgaaagaaaatcagtcatcactgcagttgttcttaaatccaactgcctcaagttattaaattaagaatatcctaataaaatcattataatattataaacaattatacaaaaatagaaatttcaaaaaattatagtggatatttatagaaacatacaaagaagtttttgttcaatatttttatactgataaaaatgtagaaaaaatattgaaacaaaatttgttattcctaaaactcctctgaccatactttggcaagtatatatttacagaaggttatatttatagaaaataatttattcctgatgttatttcaactcaaaatgatcaataagacatgttttgacaaagttatctgaactaatgaagaggtaaagaaaaactgggaatttttgtatagttattgcctgtgaatgtcagcgtgaagaacatttttattgtcggagttgtttcaactatttttatagctgaagatctcaaaggatgttttaaattgttcataatgttttagaatgtaactattgtgtgactttgaattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaagaaaaacgttatggttttgagaaacagtattcatattgttatgatttcaagaaacagtattaatacctagttataaataataaagctgtaacttaatctcatggatcataaacttaaaaagaagacataattgcatttgacacatttcttaccatgccctcacttttgttttgagccaaaggaattatcttaacagatattgagatacaattagacacccatcactactaaagaaaaattttttcttattgacaaatctctgcctgtacgagttaataatgtcatccaaatgtatttcatcaatgggtagaaaatacggtccaattcagaaaaggaagaccttctcagctgaaaacagataaagattctacatatgtgtacatgcatgtgcgtatatagttatttatgaaagttctatgataggatatgatcagtacaagagtaaataggataggacatacgccctcccaacagctatttcaatttcataatcaaacatgagcataagaaacatgggattttaaacgatatttgagggtaaaagatatggagtgggttgagtaagaaggcaaccaatttaaaggttttcgttttcagatgttaatgtcatgctatatgaccatattacagcagccacattagtctacagggaagaatgtgtttctgtttcagtgccatttataattggaaataactattcacaaggttttgttgaattaagatctaataggaagttatatagttttagaaatccttacagaatcatagtaaaataaaagatttagattacctgggccatcttgcttttcaaggcaaaacttagtccaaaaaattcccaatgacgcatgatgtgtgggtttgtgtgggtgtgtgtgtgtgtgtctgtgtgtgaatatatgatacatatgtgtgtatacacatagaacctgtggtcatttaaagaaaattcaaacataggattcatggccattcacatagtctctacaatcctttgagtataccaaagagagttccatttgtactttctgtgagaattattaaatattaggctaaagttgtagctcccagtgaaggtgtgtaattagtagattgttaatggtatcttagctaagtatcactttttgtactcttaatttatttacttttatttttaaccttaaattaggccatatatatatgccagatgagaacatttttgtccatattcttcaatctgaataattgatgtttatcattaacccaattcaacaagtattaagtacttattatgtagaatattttccttggtattggggataagtgaaatcgttcatcccttaaggagtctgtttatattaataaaaacatatttggtttttattatcatgtagatgagagttcctaattgcacaaaacagagtatatagcttggctgtttaaataaagacattaattaaagcatataagaaatctctaaactgagctttcagacagtctctaggaccacatttcttagctttgtaaatttttctcacaagcccagtcccagaaacacgcagcctctgccactaccccttcccagcatggttcctctctgccccgtcaggctaactcccagggtggtcaggtctggttgactgatcttaagtcacaggtctgccacctagtggtaaacattcccaagaaatgttactgggaagatgggatttggattgtgaggaactatcaaacagtcagggggaggggtagaaaatggggataattaatgggtaaaagatggtaacagggtacagaaaacagaaaagagaataatgtattaatgtacattatatatatatattcacacacaaacatgcatgcgtgtgtgtatatatagtgtgtgtgtctgtatgtgagcgtgtgtatgtgtgtcaacaaaaaaggaatgatcctcttttctccactagtcacaggtcctagttggcagttatgaattccaattataaaccttggtttctggacttacatacatggatccatagctattccaagaaagaaactctatcttatttctatcagtagttctgaggatatactaattccaggatgatagaattcctacttagcaatgtattatgtccaagcttgaattgtgctgggtcaactggctagccacatgtagaaagctgaaactggatcccttccttacaccttatacaaaaattaattcaagatggattaaagacttaaatgttagacctaaaaccataaaaaccctagaagaaaacctaggcaataccattcaggacatagggatgataggacttcatgtctaaaacaccaaaagcaatggcaacaaaagccaaaattgacaaatgggatctaattaaactaaagagcttctgcacagcaaaagaaaataccatcagagtgaacaggcaagctacagaatgggagaaaatttttgcaacctactcatctgacaaagggctaatatccagaatctacaaagaactcaaacaaatttacaagaaaaaaaacaaacaaccctatcaaaaagtgggcgaaggatacgaacagacacttctcaaaaggacatttgtgcagccaacagacacatgaaaaaatgctcaccatcactggccatcagaggaatgcaaatcaaaaccacaatgagataccatctcacaccagttagaatggcaatcattacaaagtgaggaaacaacaggtgctggagaggatgtggagaaataggaacacttttgcactgttggtgggactgtaaactagttcaaccgttgtggaagacagtgtggcaattcctcaaggatctagaactagaaataccatttgacccagccatcccattactgggtatatacccaaaggattataaatcatgatgctataaagacacatgcacacttatgtttattgcagcactattcacaataccaaagacttggaactaacccaaatgtccatcaatgatagactggattgagaaaatgtggcacatataaaccatggaatactatgcagccataaaaaaggatgagtccatgtcctttgtagggacatggatgaagctggaaaccatcattctcagcaaactattgcaaggacaaaaaaccaaacaccgcatgttttcactcataggtgggaattgaacaatgagaacatttggacacaggaaggggaacatcacacaccagggcctgtcatggggtcggggggaggggggagggatagcattaggagatatacctaatgtaaatgacgagttaatgggtgcagcacaccaacatggcacatgtatacatatgtaataaacctgcacgttgtgcacatgtaccctagaacttacagtataataataaaaaataaaaaaaagtcttggcttatttaaccattctataagttcagctacttctaaatgatgtaatggtgtgataaaatccggggtccctgggagcacccatcaattgcattactcttttcactgtaaaatcagatttttttttgtttttttttttttgtctgaagtaatgttgtatatcataacatgactgtaagcaaaaactcggtaagatggtgtttctggtagaagtatggtcattagagaaagcaaatctatatccaaaaagggggtttattatagtgaggaaaaactgcctcctctttaataaaaagtatttgatataatatgcttgcttcatggtgaatagctggtctccagctgtactttatcatgacagggctcaagttagattgctgcagcttgccactgggccgttcagccatggtggtgtctccatcagtcttaatcgtgggaagcccattttgtcaggtttataaccctgaaaccatggtcacttctttatgcacattgagaaatacgacatggtggcaagggaaataggctgatatctacaaggtgaatcagtttgtccaccaggttactgaagactcttacagagtgaggatcagaaaattactcctagctcagaggtaatattcaagaaactttgatattttattgtccatagtactatgactctaataaatagttacagatcctttgggagaaggttttctgattacctatcatgatatgacaaactatccaaaaacttaatgacacaaagcaacattttaatatgctaggaaggagatatccaatgttgtaggtaaccagggaaagcctcattgaaaagtggcatttgagttaaaatatgaaagcgaaggtgaagtgagatagtcatacagatttctgaaagagaatgttttagttagagaaaagaagaagtacaaaacccctgttgtggggacatggatgtttagcctgttaaaagcaaaactaacaaaactaaacaaacaaaaaactgcaaggcagccaatgaagctataccagaatgagcaagaagaaaaataggagataagttcagaaaatttagatccctttgggatgtataaggactttgactttcacttgagctcaataagaagacattaaaaatttgagcagaggtataaatgacctaactcacattttaactgaaatagtgttttgagaatagcctgaagatgaaaggctgaaaggaggaggaccagttaaggagccattataatccagggggagattataggtcttggacacaaatgtaagcagtggatgtagtggcaagtgatcagattctagaaactgagggagcatgaaagagagtgcttacaaatactgaattgttaactttaagctgggtaaagagacaatgaggacatgagggtagggagaagcagttaaaaagttccacttgccaaatgtgaagagtgtgatcaaaagatttaggtagtctctaataacagatatcctttatagcatcattattgtgtttcttttcctagagggtggatattttatatttctaaatcttacactgtattgtgcaaaattggatgctgatatgtttattgaacgactatattatgcaagatgactctaatttacaattagaaaaaaaaacagttttcattgtgttgtaaaggtttcattatttttgtcatcagattgaaggatagatgtacataataatgttaattagcctaagcttttaggaaataatgccaattaaccatggccacaggcttagctttcatataggccaaatctgtatgagatatataaaactatatgaggtatgtaaatttaactcatttaacatttcagttcactcaacaaatattaattgcatacctatagatgttgggaattgagctaacacccaaatccagagaggatcaagaggattaaggcggacactgtgccaactctcatggagcttttattgcaatgggaaaatagaatgaaatttggtagaaaaatttgtttaaattgcatatcataaaatattctgaagaaaattagtaagggattgaaatagagacttgcggaggtggggaaaaggagaaacttactttagacagtagtgagcaaatgccttgttgagagatgatgtttaagctgagacttaaagaatgagaaagagctggttaaatgaggaaccaaagaaggagtgctttgggcagagggtacagcataagcaaaggcttgacatactgaggagctaaaagtaggtcagaagtctggaacatagtttgccagcgaaagattgacatcagatgccactggaaaaacagacattattaagttcatgcaaatctccacaacctatgtaaaacagcttggatttatgcaatgaatacatgtatctaaagaatttgagagaatagaataccataatataatcagagattgataaattttaaagggctccttgaaaatttcaggttattttcatactgaaaaactactattattattattattattttagtagagacggggtttcactgtgttagccaggatggtctcgatctcctgacctcgtgatctgcctgccttggcctcccaaagtgctgggattacaggagtgagccactgtgcccggcgattagtttgatccttaaatgtgactcttatctactgatttatgcatgtttagtgtctcagatactggtgttctttgtgcccaataatggcaaagttttctaacattttgagtcataattagtgacagcaaatgtagagaaatcaaccaaaaaatatgatactaatacttgacaatgaatctaacagtggtatagtgaaaaccaaaatttttcattacagttaaacttttagaaaatatcttgaaaagaaaaaaataaagttgttttctttattctttccaccttcagtgtcttatatctgtttttaaatcttttgtttgggtaatttctgctttattttcttctttattttgcataagtagacaccacttgttagcctatgcttttcactatgcttccgaagacctttcctataatgctcaccaactgtgtgtggttcttcactagtaaaattataataactgaaaataatcaagcaatttctgattttcttctcatgtatctttgttttttagcagtagaacttccttttgaaatgaaagcaaatatgaaaccccaattcacaaaacatttcaaagcagaactcctctggcaaaagctaagagtgtaaagcctgaaacagcctggaaagtcttcagggactttccctccacctctgtcatggccccagaggctactctgggaaatcatagattctaacacaggcaatttaaaactgtatccttaacttccttttctgaactgacaattgagaatctcagttactatgttctaattggttgcatatatttttctataattaatctaaagactaattgtgaataaaaccatgtgattaagttaaagtaacattttaatgattatgctcattttattcaattcaaattattttaatggccatatgtaaatgaaataaattttgactgtcactatgatcctctaaaaagatcatgatgcatcaagcaatgttctttcatcattatcatacatatttttccaagtgttctatttctgctgaattcgtactgaaattattacatttgctaaaggactgcattacatttgcattacatttttaaattcagtaacttgttaaatgatcaaatacaatttatctttaatgtattttataaaccctgttttaaacaggtctgtgcttctttgttgctgcttgcagtgtaacctgcagctaacattagatactatgtaagcctgcaataatttaagggggaagtcatttgtaagtatttatgacttgtattcataagataattgcattttctgttaaacccaatagctattactggagcatttggagtgccttgtgtcacgacatgaaagatcactaagaatgacggtggtaaaacggcaagcccagtctccctcaggagtatccagtgaagttgaagttctcaaggcactgaaatctttgtttgagcaccacaaggccttggatgaaaaggtatagtatggaaaaagagttcaagcttaactacacttctgtcatcagcatcaagctctttgtcttcatccattgactcacctgactcctaaagtcagtcagttgaggaacacttttgagttatatgaaaaatcattttttaaaagtgaaaatggattactgtgtggatgttggtaatattcataaacatcttctttttctaaaccactgaatctatggcttatcagaattagacttctattatggtacattataaccctacttcagatgacattcaaaatgttatatcatttaatattattattgagcctctctctctctctctctctctcccccctcccccccccccaccttggtctttctttatagattccaaaataagagaccactaactgaaaattatgtatattttgatatgcaaattgatgtactttaacttttagacatttattttagaagcatcttattttctaatgtctctaatatcatagttttaaatattcatttgaatattctctgcatgtaacatcacaaagtattagtagaaaaacctgtgtttagatatttttaaaagtagctgtaagcttctcttagctgttactcgaataagttctactgacatatataaaccaatatgatgataatatccttaggagattaggaaggcttatgacgtatttcaatttcgtgaaatttcaaagactgaacttttaaaaattagtaaatctttaggagttagagtggaaattgggacacttcattgtaaagtatccgacaagttctgagcattaaaatccaaactagggattatttcccagttatatctagtttttaagcatgcaaatatttttgttctatttaatatttatatacatttatatttttatcattggtctttcagatgttctgagaacaggggattatgtggagtgtgtatgtaaggataactataattctgtcttctagagtattaagaagaaattgtatctcatttttattttagcaacgagaggcaattagtataagaattattttgaataaaacagaaatgaatattatataaaaattcttgctaaatatgacatcaaataattatttaatattcaatatttagtttcatattatatttcctctctttttataaaagtgctaagaatttgcaagagtttatatgtatagaatttttagtatgtgtcaggctccatagcacatgtttgacacacagagataaataagatatgctcattatgactgagaagttcagagttagtgctaggaattcacatatcaatgaaaaacaactcaaaacagatgtatttccatcacaatatgtagccacagaaaaagctgtgactgtgtgagtaatgacaaagacaaggatgtcttcaagaaaggttggcatggccgggcgcggtggctcacgcctgtaatcccagcactttgggaggccgaggcgggcggatcacgaggtcaggagatcgagaccatcctggctaacacggtgaaaccccacctctactaaaaatacaaaaaattagctgggcgtggtggcgggcgcctgtagtcccagctactggggaggctgaggcaggagaatggcgtgaacccgggaggtggagcttgcagtgagcccagatcgcgccactgcactccagcctgggtgacagcgagactccgtctcaaaaaaaaaaaaaaaaaaaaaaaaaaaaagaaaggttggcatttgatctaggtattaaagaatgattaagggttttttaagcagagaaagatactctaagcagcaggacccacacagaaaataacccagagctgtaagaagagaaggacctatccagagaaaattcaagagttttgtgacttaaatgaaggtactagagaatgtatgatttgagatggtcccataagcattcccatatcacttgagggatgcttttacaaaagaatgattctttatcagaatagaggtaataaacagcatttaagacaaataacctggtcgtgtgagtacatttaagaaaaaaatggttgttgtacaacgtaatctagaaataatttactttatagaagttcagtgggtttagcataactatatgagttgttccatcgtatgaccctaggagctataataatatgtattaactcaccataggtattctgaacattggtgagttcagggacaactggactgattatcaacaagtaatgctcagtggcctaaagaagaaatgaattggggctctggagtcagacagatctggataagtgacttgatcattcattctcaaagcatcaattacctcttatcttgaattaagataatcctagtactgacctcagagtcatcatgaggattagatatgatctgatatgcaaagctttcagccagtgcttagcatatggcaagtccttagtgaacgtttatgaatattattattagcaggagtaagcatcagcatttgataaaactttcaaaccaagtaaacatgttggttttactgttgatccagatgcttgtttacaatagcatttcatttagttgtcgagggactcatatgtgtctaagtgccttcatagacaatttccctaagagtaactcacagtttctcatagggatgaggagggatgtggatatagatatataaacaagtaatactatatatatatatatatatatatatatatatatatatatatatatatatatgaagtcagaaaaagatgcaattaaccatgccttggggacaggaaacaaacaactttatcatagagggattagtacatatgcagagctaaataaactctacaaggattgagcatagctgtagagagttgcagtgattcataattttcatcattaatgtccaattatttatacagccaccaagttgtagcatagaatattcataattagctaagaccatcagtaattttgaaattactctacaatatatttaccaattccaagggttggagaacatgagaaatatacttgtgtttttcaattactcagaaatcattgactatttaaaaataacatatcagacatgtatgggaaatgtaaaccaaaacaaattaaatatatatgccttccctatatatttttattatcaaatatcttagtgtcaaggaatgaattagagcttctggtctgaggagatttccacaagaatattttctgttgtaggagtgataattccccaaatgcaaccctgccttatattaatttcagtttgcattattgatattcacagcatcaatttttcaatttataacataactcaaaatatattcagaattttttattttcttgtaaaacagttttagatttattacttcgtggacaacataatctcaatttgtaaaccactattctaaatatatgaaagatgattatttcattttcatattgttggataaattcgataacttttactccttaaaaactcactataatgaaaatataaatgcttaacttgtagtaaatagaaaacagtttggaacagttctaagagtttaagtttaaaaaaagaaagaaagatatattaacctaccatgtagcctagattcaaccatttcttatattatgcgaatgacttttagaaagattttaatgtgttgatattttaaaatatggtaacttcctctctctacagcagcttaagtgtgatatgatcagcgttgtgtatggagagattattaacatatttagattgcttcatattgctgttctcatcaactaggtttactaggccttcttcaggacacccgtattttacagttggtattttagaatatgggaatccctgttaaacatcacacgtctgttgaaacgttttttgatatatgcattccacacatcagctgtcctgctcattttcatggcttcgggatatttgcttctttttcatgtattcaaaattcataaaaaagtattctccaaatcaaatcatcgaagatttcctgctatgtaactagtgtttggttattaatcagcattaatcctatgtattttgttaacaattggatatttgtctaacaggaatgatacttggcagttaatctctagctcaatatgatgaaagatcctgtgcaactcttttagaaatcaagtctccatttatgtgtgtattattgtttttagagaatttaagcataacaaaatataattaatattaaaacccctacttggatatttttattgctgattcaaggtctatttcaggaattaaatgcatccattcatctgaatatacatggtattgtaatacaatactaaaatgtgacttagattcttaaaaattcctaataggattctaggttaataggacattactgactttttgtttgtttgctaactggaaaaataatattataattccaatttaatttttatgtatctgggtttttacatattttataaatttaatctatattcccagttaaatcttattagaggagaaaaataccatttattaaaatatgctgtcagttaataaaatgaaagctcataggaatataattatatgttaaaacacatcttaactgcacaaatactatagcattcccaagaaaaatctaagttaatttataaataatcgaaaacccaccatgaattgcatcttaagttaaagctataaagttttttgattttttaaggaaaattaaactgctatagtcattcattttaattcagcaatatttctttctctgaattgttttatatatatatatatatatatcaggacatatatatagatctaaacataaaacaactaaaacaaagttctaagaaagcaagaatcaaagaaatacttcttcgagtttcagttatgtaagaaacaagcataaattatgactttcaaactaaaatatacagagatttttgttctataaaatacaatggtttaacctttggtatctggaagctagttggaaattccaagatacttaagtagtttacaattcctcaaaaacaaagtagacctctaattaataaaaaacagagaagcgaagaacatttttcaggttctaaaaggcctttccttcaggcaaataatttttgaaattagatactaagtaccaaatgaaaattcacttgttattttacagaagtagagaaaaaggtggggtatttttttttcctatttgtcatgcttaaacagtgactattttttagatgaattcataatatacttttaaactttgtctccacttactatgaatcagaattcagagcaagacaagtcaatctccaaccccacctgaagctctatcagggaactaccaaaagcatttgcttacaaggaaatcccttgatacagtgacaatacgaggtgacaatgcattcattgtatttctgccagatttagtattctgagcacgcagggatataaatactttaataatttgccaaattgactgtctctgatgatgttaattatggattcagcacagtttaatatgtatgggatgtacattactgcacatattttgatttttcttctaggtaagggagcgactgagggtttctttagaaagagtctctgcactggaagaagaactagctgctgctaatcaggaggtaacctgccacactttctcctcttttgaggtgcaatatcgctgacattacatcccttgtgtttcacgtcacttttattataactgtcacaaaaaataaattacattctgtctatgccattgaacaaggcttgttgaaattagttgccggagtcttgttttctgatttttggttatttatatgtgtcactactagaccaaaggaaaattatcaaaagctagtgacatgtgagctagggagatgaagatttagaaagactacaggcagaacgtcagtcgtttcaagaaggaaaacacagctcaaaattggaacacatatcaaataactgttaaacttagaaaatgctacaaataaaagtgaactccttggagagatatacttgccctcaggtcctgcctattcttatcttctaaaagcactgtactcatatttagtgacgtcactgaatccacttctgctactattcacaacccccaaaaaagttttttcaatcatctttttaagatttaaagagttattttatcttcggaagattttacttctcttgggttttaacgcacaaattatcttggataattaggtatatatagagagtacataaatttgtttatatatacatgtatctatctatatttatctctctctaaatatgtatgtatataatacctaagatataaaactatatatatatatatttatccctgaagtattattatagtctcctatagacagtgtggtacattttattgatattacatagataaaataaaattatatatatatatagagagagagagagagagagggagagagagagagagagaagtttaacctgtgtcagccattaaaatagtcccatctctctttttctctgacatttataaggctgcatttttcctacaagtttattccagtaatgtaatattggtattactagtattggacatactaatataaattagcaaaatcttcttactcttaaataaccaagggtagaggggagggaataatgaagagggttgattaatgggtacaaattttcagttagatggaagaaataggacctagtgttccatagatctagatcagtaggttgattatagttaacattaatctaatatacatttcaaaatagctagaagacagaatttaaatgttcctagtaaaaagtaaagataaatagttaatgtggtggatactccaaataacctgctttgatctttacacattatatgaatgtatcaaattatcacaagtacccccaaagtatgtacatctattatggatcaataaaaaataagtaaatataaatagatttataaaaatatatgaggctaatatcagtaaagataagtcttataaagggatttataacaagataatgtttacatatacattatgcatacagacaaatacacattttcaaaccactcaataaatcttctcagtacaaactcctttgttttttgttttgttttgttttgttttgttttttgttttgagacggagtcttgctctatcacccaggctggagtgcagtggtgcaatcttggctcactccaacctctctctgcctgctgggttcaagcaattctactgcctcggcatcccaagtagctgggattacgggcatgtgccaccacccctggctaatttttgtatttttagtagagacggggtttcaccatgttggtcaggctggtcttgaactcctaacctagtgattcgcctgcctcggcctcccaaagtgctgggattacacgcgtgagccaccgcgcccagccactcttttgttcttcaaaataagctagattaattaaatgagtgtatatatgcttttctttgtcccagccataacaatttaacctttagaaataatggactttcagctagtaggagagtaaactctatgtgaattaaaggctagtagtgttaaaaccataaatgatgaaatagccatctttaaaaaggaaagaaaactttttgatgaccagattcagcttagtaaacaggatggtttgggggaaaaaaaaaaaaaagaaataagagattggtacctctcagtcatcatagaagaaaagaacctctggaataataggtaatgagaaggagtacacagtctttgaaagagatggggttgataaattatcttcaggatggggtgtacttgttcctggaactatcagaaaaaaacgtaaaatgtgtattcatattatattttattaatgttaattgtgatttttatatgtgataaaattacattcattttggatgcatttctcaaaatattttattgataagggcaaacaaacaaaaagtttggtggctactattataaaagcatggcttaatatgaacgtgatagaatttctgtttgtcataaacaaaggtgtgatgagaccacttggctaaagtaagctgaaataaaagtgtcccataggccaggtgtggtggttcacacctgtaatcccagcactttgggaggccgaggcgggtggatcatgaggtctgcagatcaagcgagaccatcctggctaacacggtgaaaccctgtctctattaaaaatacaaaaaattagctgggcttggtggcgggtgcctgtagtcccagctacttgggaggctgaggcaggagaatggcgtgaaccctggaggcagagcttgcagtgagccgagatcgcgccactgcactccagcctaggcaacacagccagactctgtctcaaagtgaggctctgaaaatttgctccaggaatagcaactaagtagttacttcaattatacataaaattgaacagcagcccttgagaacaaaagtggaggaaagatttacgactgttttctggaatagagttttatccctcgagtattattataatctcctataggcagtgtggtacatttgattgattttacatagataaaataaatttttactttttagcactcctgtgtatctactgcagacttttctgaatgccatttgttttgcttaaaatcatttgtacaaataagagtcacttgcataagtaaaaatcacgtctgttagtaattatcgtgctcattattaacttccattttggttttgttgttgattttaactattgtccatgtggcttaactcgaatccctatttagaaattcacaagcccagtgataaagaaaatttactttagttttctaataataaatcacttatcaatagtgattcttttaagagagtaattagaaaagagtcaactttaacttcttaataaaattgatatttcaaaatgaaattacgaaaaaatcagaagacacttgcagtttgagttgttgattctctatagtaagagcaattggtataagaaatcactgtaagtaaagcatcatgtattgatgataagaagatatatttagaaacctgataaaatacatttagaaaaattcatactattagcagctttaggataagaactaggtgacttttgaatgttggaggcaataactgaagaagatagtttttaaaaaaagagcaaattttcatgaaaaagtttaaaaaattattaagagccgaataatcaggaaccagagcaaaagtcctgcgtatgactaaatgagcaaggagctggagaaacgtttatctgatgcatcagatttaacttttttttttttttttttttttttttttttttttttttttttttttttttagacagggtctcactctgttgcccaggctggagtgcagtggcacgatcaaggcttactgcaccctccacctcttagcctcaggtgatcctcaagcctcagccttacgagtagctgggactacagttgcatgccaccatgcccagccaattttttttgtattctttatagagatggagttttgccatgttgcccaggctggtctttaactccaggggtcaaacagtctgcccaactcggcctcccaaagcactgagatttcaggcatgagccacctcacccagcaacgtttcagattttaaattaaatttaaaatgtatttacaagtgtcccttaacattcaaatctatttgttttctgagttcatattgccatcttgaagagtaagggtgctatattatgataatctgcttggttcttgagtttctccttgttacagtgacagtttagatataaaatcttatccaaacatttttttctgaattaattcaattcccaaattcagaacggataattaagagaagagatttagattgtgaatgatatcttgatatattcatacatacgcatatatgcatatgtagaatctgaaaagaccatacagtttattctatcatcattatatgattttaatatgctttattctctcatctatctatcattattatatatagagtctctttctctctctctctctctttctctctctcctcctcccaccaccaccacttgtcttattctcacggatgggtttggagttatcacctcctaatatcttttctttatataatctctttcattgatcgctcatctattctccccagacatccaggaattcaaccatgacttctgtagaaaagaaactaaaatctatagctcaaagtttatatactcttctgagctctacagaaaatttcaaacatccctttggcattgccacagggctttgttaattattgtatagattattctctcctacaaatttccagcagggaggtcagtgggagctgaaatatagctcagggtttgctaatccagacatgcaccagaggacatagccacctacaaggagtacattttctaatttacacaaaagtgccttatgctctggtgggtcagaaatgccacctagttttcctgatgtcctcttagattctatatggcacattaatgtaataaagtgagttgcctcattaaaaagaatacaaaactactatatgttcttttctggaaaaagccccaaaacattctgctatgtaaaaagaatgaagttgcatagaataatctcaatatttttcaaatataaataataataataattcattatgacaggaatagaaaaagttttagatataagtgccaaactgttattatttgttttctccattgtttgcaagtatatataccatatgtttctgtagtgtttgaaattttaataacttttcattattcttataaacaaataaaataataaagttgttttagagtcagattttattgtccataatgacatcaatactagatcattttatggagcacttaatagtaatcatagttaatatttattgctaaatacatatatgtcagtacactaatgctggaaggtacatactattattttacagatgagaccagagaagttatttctcctaatgtactgctattccctcctacttgaaaatgtatttatctttgaatttgtcttaactctctgctttcaggttgtttcaatttatgtatataattgtgtctataatgttccccatatctgtttactctcatctttttccatatgtattaaaattacaatatttcaggtcttcatgcattctcacctgacatattacagtaggcttttatctgttcttattgcttatctcttttgctgtgtaattctgcaaggttaaacttgctaagtgaagccccaattataatgattatttttgtaatatgttctcatctataatatgtacttatatatgatatatgccatattaatacactgataacataatgatctattatgctatattaatatatgttaacaatatagtgatatatgttacatagacttgtaacataccatcgaaaatttcttcagtgttcctaacctacagattctactttaactccaccacccctactgctctgcctgagtcattctaaggccttaagtcatagagtgtatttttttttaaagaaggcaacatttttcctaactctaaatcttatttatgctaaagtctttcctggaatacctccataaccccaaatcactcattgaaaacatatttcctcatttaagctcaagctcagatgtcacctctttaatgaactattttataattctttgccaacaggctaattaattaatggctaaagctcattacttcagcctgtattacgactgttcaacaagtattagggttaattttatacttgtgtaagcctatgtagttagtttactgagaaatagacttcatctctctcctttatatttatttcactcagtaacagtgatatgaacctcttgatcaatatatgtttgtcaaattgcattatctacacttcattctgactagtgttttcatgttgttctttgactattctcttaatgaaccatttgaacaacattcagtatgctcaataaacagcaatatgttgatcatatgtatcaaatgaacaagttgtttcgtctttcaatttaattaattaatctctaccatgtgcagaaaattttgagagtctctgaaaggaagaaatggaaagaaagaaaataaatgaggtattaagtaaattttcatataacttgccctctagtgaaagagacagacgtatacacgtataactaacatgtaatttagtgcaaaactaactaaatacaaaatacaggcacaagcaaaatacagaagggaacagagaataagcgtattctgtgccaaaggatcggagaagacttcaacctaaaaagacagcatttgagtatatccttgaaggaaggctatgatttaacttcaaaactgtgggaagtatttcaggctgaggagacagaatgattaagaaaatctgaaactgctgtttcaagaataaggaatgttgcattgataaaagtcagggtgtgaaaagatacagaagaggagggtaaagaggttgatgggatccagattctgaagagctaaaaatttgtagattttatgctttctgaaatgagaaagcactaaaggtaatattatgggtttttttctgttttttttttaatttttgttaaagtgaaaaccattaaaggtatgtttttgtgtggttttttttgttaatgtttgttttttgtaaagtgtaaggctgacgtggcaaagagctagaaagttggcataatttgatgcgtttggttaacataataatataatatgtgattctaatcatggtactttaacaaatacttattgggcatcttccagttgccaggcatttcattaagtactgggtataaatatgttaacaaactcatatttgtaaatagttagttctagccgggcgtagtggctcacgcctgtaatcccagcactttgggaggccgaggtgggtggatcatgaggtcaggagttcaagaccagcctgacctacatggtgaaacccagtctctatacaaaaatcatctgggcatggtggtgcgtgcctgtaatcccagctactcaggaggctgaggcaggagaatcgcttgaacccgggaggcagaggttgcattgggccaagatcacgccactgcactccaacctgggtgacagagcaagactctgtattgaaaaaaaaaaaaaaaaaaagttagttctgctccgaaggccagtatgtgagatagacctgttaatgttaaaaactaattgtaagctgggtgtggtggcatatatgtgaaatcctacctactcgttacactgaggcaggagggtcgcttgaactcaggagtgtgagaccagcctcagcaacaaagcgagaccctatctatttgttaaaaagcaattataatgaagagttagtatttaatgtgtacagaatttcagtttgggaagatgaatgaagttcggaagacagatgatggtaatggctgattaacaatgtgaatgtactttatgccattgagtagtacttaaagggcacacttaaaaatgattaaaaaactaattatttatcttgttttatcacagtaaacataattataatacagtatgactaatgtgaatataaaagtaggtacaaggtttagtaatattaccaaagggaggaattcattgtaggggtatgaataggaaaaacagatggtgctacaaaagtgactataaagagctcaccagatggacttggagaaagaaaatagaagcaggtagaggtaggattggggaggaggtgacagagagaggcagatctgagtgaggggtggctagagttgggctttgtcctgcagacagcagtgagccaacagaatttttaggaagagaagagatgtgattggattttcggttttatagactagtggtatctcaaaaagttaaaggtaagaaatgtattagatggtcaaggtactgtgtttaaggatagatttaaaagaatcttcatgatcttaaaagaatcaaggggacagtgtcagaaaatacagcattgagtagaccacaggtattatttagtgtggcatttcttatgttcttttagtaatggcaaatataaattttaaaaatcaaacaaaatattgtaaataaatatatacataatgaaaatgtgttgtaattttaggcctttttgaatggccccacttaggcagattggattgttaatgttgattacatgttccaggccattgtcctaaaaaagtgagcccagacaatttagacacagaaaatacaataaagtctttatttttttgcagagtattattgttattgcttaaaattggaaagccaaaaaaaagcacaataaagggaagtacaaggggtaataaatagattacatcctaacaatgtgttctcttttatcagaaacctgtacacttttaaaattatgtaattaagccagacgaaatggattattcagaagcacctgtaaaaattcaattgacagactaatttgcagtgaatacacaggcgtgcttattttaaaagcctttccacatgattacattatacataaaaagaactggcaagtgtagttgcaggctgaactatattttttattgcctttactctgtgcatacttattccaaccactgaatttaccaattttcaattagaattttccaaggaaattaacaattattgtacctcatctacaatcagctttatctctgaagtctattttcctaaggaaaaattaaagaacttgcatgggcgtattaagtaatattcacatttagaaaaatattgcatcaggatgttgaaaggagatagaggcagcaacacacattttgggggcattacaggcccatggatcatagccattgcatcatacacattattccatgtaatcatcccccaaatcctttgagttaggttaacaactagtattctgttaaatgcatggaattaaatggaaaactggaaaaggtgaatagatacaggcaaaggtggaagctattctaaaagcaaaaggctggaatgaaggaaggagagatatgagactcaagcaagtcaagagtcactgaaccaaattagagatagaagtagtgagatagcaagatattgagagagagagagagagagagagagagagagagagttttaagcataaagattggaggtgttcaatgtttcttgaaggcatggaggattatgtctgatatgaaatgatttcacttatacttaagaggtcactggaaatgtttacagagatagttgcagtaaactctaatgaaagtagaatagctgcgattaaaagtatgtatgagttcagataaatgaaagaaggtaatactcttttgagaaattcagcaacgaagggaaggagagggtatatgctgaatgattccagacagtattgagtgacagccttgttataatgggacaaaattgaaaatgcttatagccattgaaaacaaagccacaaatgaaggacatgaaattatggatggcagcacagtggaggataactataattttaagatcaatggcaagtaatagaactccttcctctgagaaatggaggaaggaaaatagaacatgtagtgtagtgatgaatgaagatattgatttggagaggatttctttttcatcaggggttcttctcaaggagatgggttatctgctaaggaaagtgagaacagagttactttttaggaactaaggagactgtaaacgagacaacatagaacatagcaaggaaccaataagactaagcgaataaattttagtatgggatggtggacccagatgaggttctcattaagttaccccagcaaattaaataaaagccagtatttcacagctcttatcaactgaaacaacatggattctccaatggtatttccttatttaaatctataaagttattttattcatcataattcaaaaggaagagatacaaatattgagctaaagttgtctttgattgctttggccacttagaataaaatcagtgttataacttttccctaaaatttgacacgggtaaaaattagggaacttctgaaatccatgagtagttcagctatatttgaatagtttaaaagaaacttaaatagctgataattatgcagaaaaacatggagaaagtaggagatttgctgaacaatactctattaaggaatttgcctagagggaagtaatagaaatactcatctgaagttataggatcgtttatttgaaaaattaatcaagtgactaagtcagttttctcttcaaattaaaactgccatatctgtgagtagaaagctccagatgtagaaaaagagaccactgcaaaatctcttaagttaaattatttcagaatcctaaaaataagaatcatttcttttgaggggcctttgcaaattactcacttttgtatttttaaattctatctcttcctcagttctgggagatgaaagcagatttaattttgtatgtctatcactgctttataaaaatgattactctcataatgactttctaattttccacatgtttatgcatgctacatattctaattccactgattagcttattttaaacattaggaatcatattagtaaattccatgaccaattttcagttaacattcgaacagaaagtcagataaaagagattttttgtttgtttgttttattaacaattgaaacaagtcgccatgactaaacttaccagatgacagtatgcgtttaatgacaacagtgtttgcataggacagtgacacccttggagctctgaacttatattccttaaagataatgcaaaactgtctgatgctatgcttttagcttgcctgccaacagttgtgagattccaaaagacccacttattgggaacgtattattcctgttggaaatgtatcatttttggttagaagattgtatagattttaatttcctagaaaagttgaataatggttgaacaatggatttttttttaattttagattggtaaactaaaagtttcagtattgttaaaccagtagttatttacaaagacctatgatttcttattgtacctcttgattatcctttatgatgatattgtattataaagataaatgaataaactgtaaattgtccaagttattatcatgaatagaaaatgtatcttttgctgttgatgattgtactgttataatacaaagaatctttcccagacaaaaaaaatcaaggtgttttataacaatacctgttaaaatccaacaaagaagataggtaacaaaattgctgtttgctacttccactaattttactagttccaagtcttgtgtgaagcaattatctaaaatagaagttaaaagtgtcacctactgtgtataagacatttgaagtttgtttgcaaatctttccagactctctcctattttgattagaatattttctttgatgagagcataaggtttttttttatttgtggtagcagacatagttctattgttgcatgtggagattttgaatgctttttttctctattaatagtaagatcgtgtttgatattaatactttgatcataagcatcataaattgacctattttattttacccatatttattcttattgtttttaagctaacattttgagaaagattacttattgcttagaaatttagatgaaatattgaactttggtgagaggcaagataaaaagttaaagaatattaactttaagtcagaagattcaagattgaattatagagctatcatttactaattccatagcacctggcaattaattcaacttctcagtgcctcattctttttcatccatgaaatagaatgtattagtaaattttggacgtatctttcaaagaagtcgtaatatttggatgagacaatatacagggaagcactttgtaaacttggcatactgaagttgtattgctattattggactcaaaagtaaacattagttattagttgagcaaatgaaaatacttttctgttgatactttgaatgtgataaaaaatgaaatgatagtagtactctgtactttatgttatacccacgactacatctccttttttttgtattttgaaatcttcttcttgtgaataaacaaataccttatttgttcatagaataattctgtagcactatatgcattttataaatgatattgcatttcacttattcacatgtttgataaaaataatagcatctgcaattttagaggaggttactgtgtgcttggtactacagtaaggactgtaacaataccccgaacccacacacattttttagttatcataattaatgtatgagaaaaggataattattactagcattttgaaagttaagaaattgagtcatatagaacctaagtgaattgttctgagtgttatcactagtcgacaggaatccaaatccaagatgtctgactttcaatttcggtgtagttactatgtcacctggcctttctcccaacaatatttcctcctgtataaaactggtatagtttcctcatctttcagtaatttgaatccatcatgatatcttcatatctagtatatatacatgaattatctcaaaatttataactccattacactgaaagagacataaaatgtgtaaatcaataaagcatgtattcaatcaattaatcaaattaaactacctttaaaaatgccaaatactttgataaaatttaacatttaactatacataaaagattaattaaagcatccagatatttacagtttttaagatacatttgattattatatcacagtatagacttcagtataatagtaataaatagcatgagaacattgcagtggccactatgttttaaatatagaaaatgtgacacctcaggtcatattaaacaagatgaaaggatttctgcagtacctatttgttcccatgtcatttttaacaagaaagtgcaatagctctcaagtcttgaaaactgtggaagttccaaataactgaactcttggaacactaaataaataaataaataaataaataagatggatgaaaaagatatacattaattgacttaattttttaattgataattgactgctaatgattttacttttaaaaaacttcctagcaaaaaacaaatataacttgatcagttggtatttaccatatactattacctgagtttagccaaactgcaacatctgagggcacagtcctccataggacctccctcacttctgataccaactgcaagttcaggaaattctcacatccacccttaggttcaataaatcactagaaagcctcacagcactcactgaaatctattatattatagttatggtttattataggtaaaggttacagatcaaaatcagccaaagcaggagaaacaaagtgcagagtccaggatgattccaaacacagagcttctgttatcctcaggacgtattacccttctagaattgacacatgacagagtattaccaaccaaggaacgtcaatcaatctttgaagtttcaatcaaggcttcattacataagcatgatcgattaattacctgtttgattcatcacagctttgaagttgggagagaaagctccctaaatcatctagttggtcaaactggcataactgtccctcaagctggattatcaggtgtagtcagcctcactttaaaataacacttttattgggtatgacaagattatctccttaaggctgagggcaaaagcctgacctcctttgggtaaggtcaaattctttaccacacaactataaatcatcttaatttttttaattgaatatttttacaaatagtgctgatagatctctcatattatgaattaataacatgttgataaagccaaaatggtatttttcatgtagaaaacagtgtcattgggagataaggaagaaaataacttacagtacaatcagaaaatgtgtcgtggaagttttgtaaagccagtgcagagagagagagagtcttttaaaagaaaattacaaaacaattaaataatactgtaggggctgggtgcagtggctcacgcccgtaatcccagcactttgggagcccaagttgggtgaccatgaggtcaggatttcgagacctttgagaccatcctggctaacatggtgaaaccccctctctactaaaaataagtaaataaatacataaaaatacaaaaatttagccgggcatggtggcacaggcctgtagtccccgatactcgggaggctgaggcaggagaatcgcttgaacctgggaggtggaggttgcagtgagccaagattgcgccactgcattccatcctgggtgacagagtgaggcttcatctcaaaaaagaataaataaaaaaataaaatactgtcactagcaagtttgggaaaggcaactggtgtttttgaggcataaggctgagtcaagtatatttatgtaagtgctgttttatcgttctcagaaagctccaaccacttacttacctttccctaccttcaagttgatggatccccacattacgaggttattgctgttattaacagtgaaaatgtattgagatcttgcgattatctaatcacctttaaaacagggagtactatcaccactttaaagatgcagaaaatatggttctaatgcttaaagtaattcacctgaattacatagttagtaaatgcctgagccatttcccttttcttggatgtattcatttcttctaatctctccttttaaaatcttttctccaggttttggttaatcaacacttattccaagaagcatacatttgtatctatccatggaattagatggatttgcacctgcactgatatgtctgttgtatccagaacaagtgggctgagggacataaaaatacgctgtatgggttaaagtgcctgtcacagatggcactacttccagccagcaggtattatagggagctaataaacatataaagaaaacttttaagggcgagatcaggaagtagcacacatgactcttacttacatgccattgaagaaaacttggtctcacatcactctaagctgtaaaagagaccaggacatgcaatctctattttcatggccatatacaaaagttctattgctaaagaatgtgagaatgaatattaatgtacaaaaagcagactctagaacacacaaaacataaagaatgtttggaatttattaatgaacttaataaagtaatataaaaatgtatatgtaaatatcagtagtattcccacaccagcaataaatagaaagcattagtgaaaagcatatttcgttcaaataactataaagatagatatatagatgtattttatatgtaaacactgaattatgtttagaaatttttagctaaagtagcaaatcccattgttttaggaaatacaaaatgtcctaaatacatggaaacaacagtttcatttttgtgtctggagctagatattgtaaagatatctatttttcccaagttattttataggtgtaattcaatcaaaattctaatataatggttttgagatttaaataaaataattctgaaatttccttattaaatattaatgtaaaacatttaataatgttatgaaaattaaaagattgttgagtatggggtttccctagaatgcacagatattaaaatacattttaaagttttttaccactttgattaagtttattgctaagtatttgattcttttcattgctattattaagggggttgttttcttaatttcctttttatattgttgtttgtgtgtggaaatgcaactaatttttgaatgttgattttgtattctgcaactttactgttttgtttattagttaaaatagatattagttataacagtgagcctttacagttttttatgtctgtggtcatgtcatttgcatacagattatttacttcttcctttccaattgtttgctttttattttctttccctgtctaattgctatggctaggacttcagtactatgtcaaaaagaagtagtaaaagtgggcatccttttcttgtgctggatcttagaaggaaagctttcagtttttctccacggattaagatgttagctatgtacttttcccgcatgatctttattgtgctgaggtaattttcttctataccaattttgttgagaatatttttcataaatagatgttgaactttttcatttgccttttctgtatctgttgagataattctgtttctaaaaaattttgctgatgtgttgtatcatattgattgatttgtgtatgttaaactatccttgcattccagagataaatctctcttggtcatgatatgtgatctatttaatgttctgttgcattgggtttgctagtattatattgaggatttttgcatgtttgttcatcagaaatattggcctgtaattttattctcttgtagtatctctgattttggaattaggggatcctgaccttttaagtgttactgcttcttctattttttggaagagcttaagatgagttggtatcaattcctctttcagtgtttggtagaattcatctgtgaaggcattggttcatggacatatttgggttggtttattactgattcaatccccttatttgttatttttctgttcggattatctatttctttttgattcagtattggcagattgtatgtttattggaatttacccattccttcttggctctgcagtttgctgggttataattgttcatagtagtctcttatgatcctttatattttttaggcattcgttgtaatgtctcctctttcatgtctgattttattaaatttattaattttgggaaccaggggcagaaagctatggcttgaatacatctcccaaaagttcataggtttgaaacttaatcccagtgcaacagttttgggaggtagagcctaatgagtggtgatatgatttggctgtgtccccacccaaatctcatcttgaattcccacgtgttgtgggagggacccaatgggaggtaattttatcatgggggtaggtctttcctgtgctgttcttgtgatagtgaataagtctcatgagatctgagggttattataagagctcctgtatgagctctctctttgcctgctgccgtccatgtaagaagtgacttgtttatcttaaagagtagcccttgactcccttccatctgtagtaatttctttagcaaatggttgcttggccacattttttcacattttaccttcccatgctgtgaattttccaaggtttttcactctgctttccttttaattataaattctgcccttaagacaatccttttctgtcacacttcactgtaaacagttaaaagtagtcatgcagcagggtgaatgctttgctgcttagatatttctttcaccagatatcatagttcctcactcttaagttcttcattccataaagtccaataatatagacacaattctactagtctttgcagaggtgtaacaggatggcatttactttagtttccaataccttgtttctcgttttcatctgagatctcatgaaaatgacatatatatatatatatatacacacatatatatacacatatatatacacacatatatatacacatatatatacacacatatatatacacatatatatacacacacacacgtatatatatatgtatatatatatacctgtttatataatcaccttcttgcctctagagacagttctagacttaaagtctattttgtctgatataagcatagccattcccagctttcttttgattaccgtttgcatggcataacttttcatgatataagcataactacccctagctttcttttggttaccatttgcataacataactttcttcagctcctcattttcaaactgtgtgtgtctttatatgtaaaatgagtgtcttatgaaaaataaaccactggatcttgttatattatttttttcctttaaatccattcagccatgctatgccttttgattggtgattttaattcatgtatatttaaagtaattattgacaggtgaggaattactaatttctttttgttaattgctttctatacattttgccattgatttttctctctctgctctcttactgtcttctttttaattagatggttttttgtagttatttgctttgattttttttcttcttgtatattttatgtatattgtgggaattttatttgtggttagctcaaagctttcataaaatatcttgtagttacaacagtcttttttaagttaatagcaacttaacttcaattgaatacaaaacctccacacttttactcccctttttactctgcccgatttgtgttcttgtagttagagtttctttttatattgtgtatccattaacaattttgtatctctaacctttatagtaggattaaaagtaatttatacaatacaattataatgttactttaacctccatttctctgtatgtttaccttaaccagtgagatttatactcttacatgctttcatgttgctactcagcatgtttttgttaaaatttgaagaacttccttgtgcatttcttttaaggcaggtctatagttgaaaaactccttcaattttcatttgtattggaaagactttatcccttcttcacttttaaagaataattttgttggatatattgttcttggtagacagttattttctttcagtactttgaatatatcatcccactgtctcttggcctgcaatgtttctgctgagaaatctactaatagtcttacagggattctctttcacataatgagttgcttttttcttttggctttctaatctctttgtccttgacttttgataatttgattataatttgtctcggtgcagtgttttggggttgatcttatttgggaacttttgagcttcatgaatttgcatgccatttctctcctgagatttggggatttttcagctgttatttctctaaatatgctttctatcaatttctttctttctttttctctttttgggactcccataatgcataaactggcccacttgatggtgttccatagatatgataggctttcttccctttttttcatttttctctcctatgactggttaagatcaaaagacctgtccttgaatttttagattctttcttctgtttgatcaagtctgctattgaagcactctattgtagttttcattttattcttcagctccagaacttctgttagactcttttttatgatttttacctctttattgaacttttatttttttcatgtattgttctgctgattattttcaagttgtgtatctgtgtttgcttgtagcttgctgagcttctttaaaataattattttgaattccctgtcaggcaacttattattctccatttctttgtggtcagttactagaaaattattgtgttccttttgtggcattttcttgatttttcatattctcatagacatgcattgatgtctgcacatttgaaggagttgtcacctctttaaactttatgtactggcttcagtaaggaaagacctcacctatgggaaggtatgaagccaccaactgggtgggtatggtagcttcttctctgaaggacacagtggctgttccagctccaggagtgggcagcagttagactccaggtagttccatcagctgaggtcagcactggtgaagactacagcgtttttagtagacaaggctgagagtgtctgcaaaggcagcaatgacttgcagggtccccagtcatgaaagcttttgaagtcctcctgctttccttttcacccacaggagaagttgtggtagaggggattcttcttggtgcctgtgtctgaactgtgaacatacatcgaacaatggtggtactaggtctggaatgcaggttcatatggcatggctatggatttggatatggatgcaaatgcacatggccaaaccacttcatttttaaagctaatttatatccagaagtcatgtatatactctttattccttctcaaacttgaatatccaacataaataaggtgaaaaatgagttaaatataaaaagtgaaattataactagggaatgaaatattatttgtattgaaataatacactgacatctttcaaacaatacaaggtatagcaaaagaaaaactgggattccatcttagaaaagttaaaatttttattacaataaaaaaacagaaaaaaatgaataccatgtaacatgattaaatcaaaacgtgtatacaagggcaatatcatgagactttatgtttattgtaagaacattcattcaataaatatttataaaaacaacaataataacacttatggattccctacaacatgtgaggttctcttgtaagtactttatatattttaactgattttctttttttcatgaataacatttcagactgatgttgcaaacatcattactttatagataggaaaattgaggcagagcgtagttgagcaactggtttaatttcagtgttagtaagtggtagaaccagaattctaccgcacaaatcataatcttaatcagtactttatactgtctacttggtggataccaagcaatgttttggatgtcaagggcatatcagtaaccaaagaataaactgctttccttaagggtcttatattagaaatatataagttaaaactatttttatatactgataaattcggtgaaataaatttcacctctatagaaggagaatattgaaaatgcaattgacattcaattttaaactgttttttttctgtgttctctcaactgtttccattttaatattaaccaacatcattatattatctgaatctctgctatttagacatgagtagacaaaatagcatgtgaaaaaacacattatcactatcaaataatttcattttcaggggtaattttttctttgtacttatgtgaaggaaattagaaacaacgtataaacctaaaactcaggaattttagttatagttctgactttaactgtatccatttgaacagtttttttttccttaaagagatagacaagaaccactagaccaggtatcagcaaacttcggtaaaagtccaactagtaaatatttttggctttatgagccagatggtctctgtcacaacttctctaccattgtggagtgaaaacaatcatagacaatgtgtaaacaaatgagtttggccattttccaattaaaatttattcatggacactgaaagtgaatttcttataatttacacaatattattctcttttaatgtttttcaactattcaaaaatgtcaaaacaatttttagcttgcaggtctgacaaaaacagaaataaggagcaataaaagtatgaaatattttatggaaagtggatagctttgagtagttagaaattagcgttggcaagtaaggaaaagtggtaaataaaaaaacctttattctaaatagagtatttacttggttccagtaaatatattctactctggaaatagaaggctaaggaaagagacaaacctactccaaagaggagctataacgcccaccaagtgaaacttactttctccctaagtcattctgctattcactagctttgtaaccataggcaatttcctttttctttttaccttaattggctgaaccataataataacttataatgatgttgtgagttttaaattaattaatacattcaaacaacgtaaaactgtggttggcataaagagtctttcagtaaatattatgcttattattgattttggtaatgtcattgtggtctttttagatatgatactatccatctcctttaaaggtaattgaactgagatttagggaggcagagtgtcctgtctacagtgagactgactagatggcaatttgttggagacaaatagaattatcactattctctgtaaatctcattttctttattcataatagtaagggtgtaaagaccacttaagttctgcttccttctcatactgacattattttgatatgtgcacatttaaaaatcacataaaaataaaatggaaatgggtacagataaatgtaacatgataattaccattagaactgaagtaaatggattactttaaaaggaattggccagaacaatgggtttagtatgcttttgttatttctaagaaaggaactaaatgaataaatcctttttattgccctagcttgctttgttatatgcaagattgattaatgaatattgtttctgctttctatatttttttcaagcacttttcaaacactttgaaacgcttttccctaaaactctcttctttgccataatagaactaaaataatagatctaggacacagcctataatttcgacacatttgccatgattggagaaaaaacaaaaaaacacatgtatacttacagtgttaaccatgcacggctgaagaggtcaaatttcatgatgctagaggaagaatatagaaatcaataagtccatcttcagagagattcatttcagtgtaacattttaagagactcaaattgatggaattatagtgtgtttggattattaaagcagaatgttagttctaaaacatccaaatattcccgaaagcaaatggaatacacttgaataaacagaagacaaagacatgattagaatagggcagatttatctttttaaatttaatactattaacagtgtttgctcaaagtatttttatacttcttagcatacataaagtaaatgaaatataaacttttagtcatatattaacatttcattttatttaaaaataaatatttattgagacttttgaaaacaaatgctctcattcacagagcatgtttcctgctttataaaatgatcacgtacacacacattggattatttagtttgcattcactctcttctcagcctaactcagtatctttaattttgcttttcctttttattgtagttggggagataattaattactgcagtcagttgtcatttatgcccttagctgaaactaaaccaagttagcagattttgatacctctgactttagagggcaaagagccctgtgggagtgattgtgaggaaccagtatgaatcaagatagcctccattctgtacaaagaagtactttataataatcaataccttcagtaagttctgtttgctgttttcactgtgagacacctatttccctttttgaataggatttttctgtcttgttcaaggaggtgagaagttattagcaatagcatcttccttggtgatggagattttaccatattttctttatgaaattcaaaacttttaacgcaattactgccaatactgtcagcactcaacactgaattattgcagtttctttatctttggtagggcacttctcagtactgtttaccttaatgaatactctctacccttccttatttatctgcttatatatattctaaattgagtcttgctttcatgcagtgatacatacaagtggttaagaatgtgttttcctaccactaacacttttgaaaaactgtttagaaattggtgtttgctttcattctctggattaattctttcactttcctgtattaacagcttccttggctatttttcttactattcttccatattatgccactcttagttgctaacctagtaaaataacagtcttgccttaacaatgtccactaattcttctgaccaatataaattgttttgtatattctgtagccttttacatgcctctaatgaagatgctagtattttattttattgtcattttaattattagggaactacatagatggttaaaataaatgatgcattatcaagcatcagaaaatgtattgactgaaatactgattagacaaaaagaagagagatgttagtacaaagttgtaattttcattagaattacatgttaataacaatgacaaagtatagctattgtcaaaattactattgttgaatattataattctaagttaaatggatagtgtaaacatctcctgcaaaaaagcaaaactttctacctgagaatatatttgatttttttttttttgctattggaatcattctgttttaaacttaaaactaaaaataacagttttgcattccagttactgttttaggaagatttcttttttaaaaaaccctttaaatattaatttaaagaggattttttaatcattataaactaactgagtttgaattccatgtgtatttagatacaagaaagactagtttagatgtaaaatttggaaatagccaaatttatgtactttttatatgatgtattttcaattaaaaggtcaccagaaacttactggtaatgtgcatttaaattttagcacttaggtaatttatctgtataggaattgggagtactagtcagccaaatttggggtgggaagtttaaaataaataaatgtagaatattcttattcatccaataaatattagttgactgagtggaagtattttatgtagtaaaaattcttacaaacatatatatatatatatatatatatatatatatatatatatatatatattttttttttttttttttttttttttttttttttacctgaaccaagataaattctcacaatgcaaacctctcattcttacctcaaagcaatttgattattcactggaacagtttggtgtcacaagctttcaaaatctgcccatggttaatgaaagccatttaaattgaatgttacatgtaagctgatcaaactgcacagactacatgaagttgctctccattggttttaacgtgcttcagtgatgcttataaatcttatttccaaatgcagagctagaaaaggaaatagttactggcttgggtttcttaattctatttaaataagtgtttcaacctttatggtttcccaattaataaatagcgatacaaatgcaaactattgtgactgaaagttgcttaagtttaaattgtaaatccctactgttttactagttttttcttgttgtttgtgtgtgtgtttcaacttcattataatctaagcatggaattcagctagaagtagaataagtatctgtgtagaagcaaattatgtgttggtgtagtgagacttcaataagtgtcaccctgggaattgttaattgaatttgggataaaaatagatgaaaagaatctttgttaattagatgtgggcactatctggaagttgttaaataagtagagacaaatattaatttaaaaacatgagaatgaaaatccctgtagaaatagcatgaaagattttatgtagatgtagtttattttaaaaagtagttaattttttttcagggtaagtttaagtgcttatgctgtatacgagttataaatgaaaataatcagtaaggtaaaaaccatgactttttttattttggggaatatatgaagacaccttttaaatgtttttgaagacatcttctaaattgtttgccaacgcaggtcaggaaaagccccctgcaatcagaccacaaacttgtagtcctgaccttgataaatatttaaattgtgtatgcaatgaatcatttcactgattaccaaaaggcattacagcataatatttttaaaatgttttgaaggaatcagacctgaatcagaaatatctctgttgtgtctttttctgtatgacttcaagtatattacatatttcctctgtgttagttgcctcatttgtaaaatgaaaataaaaataccaaatttacaaggttactggaaagattaaatgaggtaatgtatgtaaattgttttatttcatatggggcatgtaataaatgttcaagacatagctattattacagctagaagttcttaattagaaatttaatttctcaactcccatttcttcatgtatattaatatttcagaaagacaaaggaaaatgaagtgaatactaaatcaatttacattgcttttccttttttattggaaaattctattggcagaaattagtttcttagacactcttagaattccatttttctgtccacaaacaacgattcattctaaatctaaagcaaatacacaatgtgcttcaatgcatgtgaatcatattacctaagctgcagtatacttgagaatacattttaatgttatattttaagatgcaatgaaattgcctattactttgagtttacaaaacaactcttgatgactttcattaaactgtccttccatgatcctgctgctagcctcctttacagttgcttatgccttctactttatctgcctcctcacgctagagcagtgactttcctacaaagccattgcagtatttcccattcttttatttctttatttccccagtgagctctacccagaatcctttttaaccttgaagcctataatatgaacatttgaaagaccttcaagttcttatattcctctatatggataactaattttcttctccatgtatacatcctgtgaacatttctgtccaatttttccaactcctcatatgcttttttttcattcatgtagcctgtcatcattttttttgacattctacaaatatttctagagtgcctcctgtttgtcagtcagtgtcctaagaactgagaataagtaatgaatcagaaacagtttctagtctcaaggcactgtgtcaaaatggttggtgagaaaactaacatccagttgtgataatcacttgcatgacatgagttactggagattactaaggcattctgtaactccttgggaagatattgtccccgaattcatctgaaagacttaaaagctaagtgactaagaggcagttaaagaggaacaaaggttacccaggtgaatataaaaactcacagccaagacggcactttttatatgtgtgatcgaagcctttcagtaagctagagcacgcaatatgaatagaaagataaaattgaagaggcaagtggaagtcaattcattattgtcattgtcattacatagcaagtgtttaatgtacatcaaatttgactaagtattttacaaacaaatacaatataaagtagatattatttgccctccatttgatataacaagaacctgaacttgaggttaaatagcttgtacaagatcgtacaaccagcaacaactacatgggccaggattcatcctcagcctttcaagcatatttaaggaatgtttcacttccaggaatcacctttcaaactacttgtacctgattattattaggttggtgcaaaagcaattgtggttgttgccattaaatataatagtctcagggtcttttaccaagaaatctcaaacctggaaagaaaagataatgtagatgcaaagtttatgaaaagaagcaaatttatataatgtacttagcacagtttctggcacattataagagctaaataaataattgctattttgttattgtagtcctactgcttcctttttttttttttttttttgcctccttaactagaatgtaatctacacaagagaaggaaactgtctgcatttttcccagtattttgtgatacttagaacagtgatcaaatgaatatttgttgaataaatgtattaatatttattaaaccctcaagaaatcctaaaattttagcataaaaagatatttaatggtctttgttatttttgcccaaatcatttttttcatgataatatgtttccttaagtctccaaggcatcaacttgcactgatgttttacctctcttttagggaggacattttacatcattgaaagaactccctgaaatattgttataaatctcaatatttgttttcaatagttatttacattttctagaaagttattctcccagatatccacattgctgttccctcttgtcctcaagcccatactcagaaatcacctaatttgtaatcaaattatacctcacagcattcctcacttggtttgattttctcttttctgttaacaccatttaaaaatatgctctacttatgtttgtttataacttattttccccaatgagagtacaatttccattaggaaggatttctgccttttcctcccattgtgtttccctaacgcctggtatgtcatcagtgctgaatgaatatttttgagataaatgaatctctccaggatatcaaagaaaaacagttgttcacaggcaaggagctagaagagagtctgttgcaagacatagtagtgttcaagctggtagaaaagaaaaatgaaggctaaagaattttgcagactggaggcccagccgccaagactaccagttgtctattgtgtagggtcagagcttgtcagagccaaaatcaacctgacagaggcaaggatatgaatgaaacctagaagattggcttgaaaatataacgtgtttgagagtgcctagaaggaatggatcaggctgttataagcttatgagcaaccagaaaacacaaataaggatcaagacaaagcaataagccagagagaaaaagcacacagatgcctgagatttagttgaagcactttagctttgctagtcccatcattcctccaactttttccaggtactttttgccacaggaatattaaacaacttacagtgcgaggaacacaaagttgtagaaacacaaaatgcctgtgatcttctacacacctaaaaaagtcttctaccatgtctgtctggtaaattcttagccattctccaaaatcctcacttaggtattgcatactctgtattgtcttccatgtttcctgctgcatttgcaagtcacttttagttgcaagtgacagaaaaccatttcaaatgagttggggcacaaaaggggaaatttggggcttggatcatattactaaaatgccaagggtaggaatgatttaaggatgcctagaatcaggaccagaagcaatttgttagggcctcatctcttccatgtgttttctgcatgaataggaattaatggcaaagagtacccctttcatattctaccagcttaccttccttagtagatagagagaatcgtttcccatagctcagccagaaacatgtaaagtaataatattctgatttccctggcttgggtcatgtgcccacccatttgccatgggctcttggttccttcattgacagtctctgtgggattagaataagaaaggaaaagtctccagtgaaaatataagatgttattatcaaagaaatgtgaagggatacctgaaagcaaatgtcaacagacacttgataaatgatgattgaacattaaaaacagttgtgaaatatttatcttgaacagagttccatgagccttcagtgggttgctaactcactgaaaatatatgcaaaactttgcctccatatgaatctgtccagggagacgtccaatcttaatgacatacaaaggattccagcaagggtatcagcccttggaaataaaatgattatgcttcctatcccagcccgctattaacttctgatttagtagaccccaaatttaaaaggggagccatttgagccaatgttacaaattaggaagtataaggatacggagttaagttttatttgactcttacttcttagtccatttgtgctgctgtgacaaaatgtctgagactgcataatttataaacaatagaagtatatgtatcacagttgtggagacaggaaagtccaacatcaaggcatcagcagatttggaaggactgccttctacttccattatggcaccctgaacaatgcgtcctcacatggcagaaggtggctggcaaaaggcttaattagctagtacccttgaggccttttatattggtactaattccatttatcgtctcctaaagaccttacctctcaaaactatcacattgagccctaggtttcaacatacaaatgttgggggttggaggagggcatatattcaaaccatagcagttgtccccattaatctttctttatcttaatctgatcatttgttaaatatgaatcatacccccttagcagataaaaatagtttagcacagtacttgtacatagtgagtttttcagtacagttatataagaactgggtaaacaacaggacttgtacataagtggttcctcctactcaacatgtaatcatatttggagtagtgtcttagtctgttttgtgttgctataacagaatatcacagactggatgatttttaaagaaaataaatttatttctgaaagttctggaggctgggaagtccaaggcatgacactggcatctggcatgagtttttatgatgccttatcccatagtagagggatggaagggcataaaagcatgtgagatgatacagagagaggatgaggggcaaactccatccttttatccagaacccactccaatgataaataacccactccagagataacagccttaatccatttatgagagcaaagccctcatgccgtaaaaacctgttaaaggtcccacctcttaataccattacaaaggcaattacatttcaacataagttttggagggaacatttaaaccatagcaagtaggccatgttgtttagtggtgaggcatccagacctacgttagttttcttgtaggcaatttgcttgggccctccttctgacaacattccctctcagtgagagcctagggaatattttgaggccattagcttcttttcattctatttattgtcccaagctggttccctagccatctcttgtgttcacttctcaaaccagctaagagaatttcctaaagaagtctgtgctaccttaggctccagttatttattggtgacctcttcactctttaaaacagattgaagaaaatgcttaacacccaaaggggaatttttaaaagagaactacaaactttccccctttccccagtgtcaaaaataatccacttattaacacccacaattaaatcaggtgctgaaactttggtttcataactacccaggataatttgttattggagaaaatagcatattacagtggtagagaatatagaatatgtcacatttgttcttctgtatcaagagccaacatttttagccttgattcatttttacaaaacaaagtttgcatgttagtggttgaaaattatgtcatttttggaactaattgtcatgtatacactgtagcaaacttgaagtttagaattttaaaaatcatagtggctcaattatatttgtacttttttctgaatgaatttgattttttgattattttttaatagggacattaattcatcttttcactgattcattcaataaacttttatagatggcctgctttatttcaggcaccaggacatatttgaaagtcatctgtttattaaacaaatgtaagctaatctgtaagctgagagttaaatttgttctttaaatattttttaaatgtctcccttcacttctgagtagattaataatagaacaaagcatataatttttaaatggcctggtactttgtattagcatttctgttagtcatagatgttttcttagtggaatgtcaacaaatgatacttgaatattttaaaatttataattcataaaatctcatgtatcaattgtaatatttatgcaaaaagcaataagttaagagtgtaatataaaaatgatatatctaggagctattttattcttcttgtcattcctttgatgtaatctatttccatgttgactaatgtgaaaagaatgtttctgaagttttttttacactccaaatctttatcttttgttattttttgaattaatcaggtttagattctttgttttcccatatccatgtattatttaattcaacacatttttagtgaataccctgcacataataatttgatgtgctacttcatatgaaaatgctgttttcaatgaagcattcttttgaaaattattttctcaggagatattattaggacttgtgctagctaaataaataagcaaatgaggaagtggagaaatggaataataaactttattgagtgctacatgcacaaaaataaatagggatatattgtacaaagtgtttgatgacaacacacattcactctgaggagttgtatctcaactgtttttaaagctgggattgtgtcccctgtgatagctgaggaagaatgttttagacaggaagatcatcaaattcctcagttctgtgtaagaaagagacagatatgtttgagggatggaaaggaggccagtgtcgctgaagcaaagggctcaagtaggacagtatagaccttgttaagaagtttaaattttggctaaataagctgggaaaactttaggtttttttaacaaaattttaaagtattttattttattttattttattttattttattttattttattttaagacagagtctccctctgtcgcccaggctggagtgcagtcgcgcaatctcagctcactgcaatctccgcctcccaggttcaagggattctcctggctcagcctcctgagtagctgggattacaggcgcccaccatcacgcccggctaatttttatatttttagtagagacaggtttcaccagttggccagggtggtcatgaactcctgacctcaagtgatctggccaccttggcctcccaaagtgccgagattacaggcgtgagctgccgcgctgggccaaacattagttttgttagaaagctgaagggttacacaatctaatttaagtttgaaagatgtacctggctgctttgtggataatagattgtagatgaacaagagtaagcgtgagggagccaattatttggtgtttacagttatacgagagaaaagaacatatacctagagaaggatataccaaatgctcaaataccagagatcatatagctagatcaactgatgtcatggacacatggtggtaatatggcattgaaatagtgtcaagtagcagggcaaacacccaaccccttgatatcatgtttttttcagttaatgattattcgtcttgtgacatgttggtcttgtaatttccacatgtaagtttaatattattcagatcttattgtgcactaaatactatgtacctttatttctcccagaactaatattgactactatctgagttgataatacaataaaatatgccatggaataaataagttacagcattaatataatgtaaaatattttcaaagtgatatatatatatatatttagcaaatgtattttaaaacatcattttaaaaagactgaaatactatttttcactctattactaggatcacttatgctataagtacccgagaatttgttttttaattgaaataattatgtcattaaaattgagctgaaagtttgcaagaataactgctttcttaatttgtgtttgcaaattaactaaatttggtaaaataatggacattaaaattataataataaaacaaatttaatacatgctcatgacagcattacaaatttttttttaagttcagctgtgtgtctgcttatattaaattgcagatgggctatcagtgtaggcgaaattgctgtgctcataattagtctttaaccttcaatcttttatgtttcttgtatactttaaaaatacagaccaaaaaaacatttttattacatcctacaaattaatttaaaaaataatttctgaattaacatcacgtgaatacaaatatatcattgattttagatacatttccaacaagaaaatattttcttaggtaaattttacagtgctttaacctcttcttagtagagatattatgaatttttgtaaatattgttcaaaatggtgacctacattgaaacacatattttgaataataattcagtaaaatgtaatgttcactttctggttatttgttagtgttcattagttcttaaccacattgaagtaaattcattttctttttatattttattccctatttagactttaaaggcatagtgcttttattttgcagattgttgccttgcgtgaacaaaatgttcatatacaaagaaaaatggcatcaagcgagggatccacagagtcagaacatcttgaagggatggaacctggacagaaagtccatgagaaggtatgacacaccccacatgctcttacatggaaatgtttacttcttatatcatttgacaggaaatataaaaaccacataatgaacatttttttagtatttgttgattctttggtcaaaggttcaaggtttatggttatttcctttctaatatttgttcttattttgattctcttaaatataatacatatgtgtatatgttgtgtgtatgcatatacacatattcaaattttttacctgctcttaattgattttcttaaaagtatttaaattatatagaattgaatttataatatgtataaagaatataatttaaagtacatatatacacattgtgtgtatatatggcatatgtatatatatgtacatatataggcaggactattttaagtgcaaaacaacacttttgaattgtaagtgatataatatacaattggtaacttatttgttgtttatgactgcgaaaattgttggtaatcttttatttgattagtatttttcttgcattgtttgaggcctcagcagtactcttgttaatgagagataacataaaatgaaatgtgaagtcatgggacttttacattttttataatggaatgattctccttttgggtgaagtttagtcccacacaaaggaaactagcgctctgttgctccactagcaaaagacaaaaggtgtctgtgctggaccacctctttccaacagaagaggaagaaggtaagttattggtaggtctagaatcagatgaaaattacatggaggcattcacacatcctgtgttggaaactcaggagaatcatttgcctgtaacaagttatatctttggattcttaagctcctaaatgaagaccacatgaatcagctagctaaattgctgtaattgaaaatgtcaagagtttctaaaacctagcgattaagaagcaagtgactggacaatacaataaatagcactagaattcttactataaattaagtttagcatttcctcacttatgtggttagaaaaaatagagggacttcttatgtttcttccttcaagtagaaaagcaaaataaagtaagtaaatcagatgaatttccggaaagaagcttcaattctggtggctgacaaatgaacagatcttcacataagaccacgaatttagcctttatccatgtattttatagaaatcttaagctaaatataaaacataaactacaatttgacgtatttcattagctttatctgagattagaataacattatttatctttccttcaactaaataaactgatactgcttcagtagatacaccaccaagctctttaataaggcattttcactcagcactcagtttaggaaaccaacatgtaatttgatattgctctttcattttaattatgtcattagtagtatacctctcctcagagaattatagaatcacaattggctggttataaaaaatggattttatggtcatctagtctttttcataaaaggctacaaattattgttttctataataatgctgtatttatgctaatctactccagaaatgaagaaatatacctttctcagacatgaacaacttcagattttttttatcccctaacaggttatttcatacttgaagtgttcttcttatggaggaggagggcagggaatgctcatacatatatatttttttcaaatattttttcatcaaggtactgttagcagcagcaaatccatacaggtctgcagcaacctcaattcttgttttctcagaagaaagaaattgactgtggggcatgaggcaaagggagagaccaaggcaagtttcagggcaggaaagttttagagcaggaacaagaggagataaagtacagctggaaaagggccaaatgggcaacttgagagattcaagtgtgcaatttgacctctgaattggggttttatacactggcatgcttctggagttgtggtacttctgccctgattcttcctttggggtgggctgtctgcatgcacggtggcctgtcagcacttgggaggggccgcatgcacagcatgtttactgaagtcctatacatgcttactggaggcatttttcccttaccagttgagtgttcctagaggaatgttctattcctataccagttaaatgctgccattttgcttctcagtgcacatgcttgagtccacttgcccaactcctgagatcttatctggaaactgctgatcaccagattcaatgttttctatttattacagtctgtcttccctggcactggcagcaaccaataattgttttacagagagagtttaacaaccacctgaccatcacctattggttgcctaactacctactctaacaatataaccactaaatatttgaatatgcagacattagagaatgtaagacagtttatgacagattatttttcgggaactggttacagaattaggatgaggatttatgcataattgatatttgtctctattggtcttcacagatataagtgcacatatggaggattttgagacattggtgacccaaagcaattgtctttaactttttttgacttccagttcttagtgaaggcatttcagccagtggagaaaagaaattgtgtgccaatgctaagtcattcacttcttgtgttggtgtaactaaaggtttttaaacattatgattactggtattcatttgcttttttcagcttccttgaatttctaaaacagtgatttctaaatgctttagaataattatatattattatcatgcataatatcatgcccatatcctttggtgtaaacctaaaatgtgtataatgtatcatatatatttagtctaaatttaaaaatatgtaaacatgtttcaatttatattaatcctgtgattgatttctcaggatgttccaataaagtgttgtaataagaagttttatttatgccacatttttaaatttatttttatttacatatttttgagacagtccaggctgtagtgcagtggcatgaacttggctcactgcaacctccttctcctgggctcaagcaatcctcccatctcaatgttccaagtagctaacattactggcgtgagccaccctgcctggctaattttggtaatttttgtagagacagagtttcatcatgttgaccaggctggtcttgaactcctgagctcaagcaatctgcccacctcggcctcccaaagtgctggaattacaggtgtgagccaccgtgctcagctataccacatttttttacctgacatttcttgataaaacataaaacagtatcctgattattattttcattgtccttatataaatactcccaagttacacacatataatattatagagcatttttcttatcaaaatcatcctccatgacatgattattcaaggtatattaatgccataaaacaagttgtcaaaggattgtaatttaaagcctaatacttattttttttttattgagaacttttaaaaaggtatattcaaacaaaagaaaagaaattattattttggcagattatcaacgatgactgtagtgttagtgtgtaaattgaaaagtggttgatcaggacaaaaatgtaaaactattattagatactgatagaactaagaaagtgacttctaaatcctagttggaaggattaccctttgtttagggcagttaatttgcttaagttacacagtcagggtgggtgattagcccaaagaagatgttttgtgtcggtggattgagaactctgttgacaaaatagttgacaaaaatagcctcacaaaagcacaatctgaaataggccttattattcatggaaaactctggtaattattatcagcctttttaaaagaaaaaataaaaagaaaaaatacacttaactgaaacgaatttaaatatttctgtgtggtcttaaatttaactgattgagaagaatataaatattcaaggataatacaaattttcataacactaaattccaccttttcagaaccaggctctaataactttttcctatttctttctagatggaagttaattggtgaattttaaaaagtaaacatgctactcttgtaaagtttataataatgctcattacttgtataatctgtacttctaattattttttcagctgcaagtatttgctaactgatgtgaatcagtagaatattagatatgttagagattcagaagatatagtctgtaataaatttgataagaatctacagtgagaaataaacatgcccaaattaatatcataaaacatgataaatattgtggtatcaaaaataatattagagtttaaaaacaaggttaattaatcctcattgaggggtgtcagagaggcaatgtggaatagcgatttgtttgaagttcctgtctctgccagctaccagctgtatgaaccttacccttaacaccgctgactctgagtttcagataaaatagtcttgccaacttacagagttataagaatagaaacactatattcaatgaattacatcatcttaggcatattgtatagaagcaataaatgcttattctatttattaatcctgtgttttcaatcaaataaatatttagtggcaaccttattaaaggtgctaagaaatgggccctattctaggtggtaggaatataatgatgataagacagttgagggtacaggcaataaacaaatatacacagtgtaaaagggcatagatatgatcaagggacccgtacaaggtgagtggtgaagacattaaagaagggatctttttaagatggtgggatttgaactgatgcctgaaaaagtaccaggagtcaacaatatgaaaaactttcacaaaacagtagtcacacttaactatatgcagtgaatttttatacgtgtcatgtattagtgactgagacactagttcttcatagatcgaagagtggagttgactgatccttcaatgaccatacaacaaatgaggcacatcctcggcatgtcacatgaggttcttcccaagctggctggcctcttctcgcctcccaggcctgtttgcttatcattcccactttgagcttaattactaagtgaactaagttaaagcttccttttttaagttgttgctcttattcttctctcctctttgaatctgacatttattcgtgactgttctctaaaaatgcaacataacaatttaagcaacagtaatatggaaatgtgaaagctgaataaatgtaaaatcagaaatagatttttgtttgcatgttttcagttctttagttcttgtcagatagaagaattatggacaaaaaagtacataaagcaaaatgaagaatcagtggcaagaataatcctcagatcggtaaatttaataaataattgtctagtatttttattatagaactactgttcatgaagaatattgagccaaagtgataaaaatggaatacgggatgtgcctttatcaaaattaagggttttgtggacttttagcaatacaatgctgttttagaatgaacaaccaatgacaaaaataggtacttagaacaagccaacatagctctacaagcaatgtgatcctcagtggagacaaagtatttcattccatcatgctattgtgaaatattgagatatcatagtgtgaagatttgcacactctcatgcaaacctgtcagctgtccagttaaaagtttggcttatcaatatctcatcctattttaaaatactaataaacatcatttatcacaaatgccattcttttaatcattctcactaagttctgactaaaagtcatcatccacaggcatgtcttcaatatattgactatattttgttcatttttttgtgttcatcaatacatgttaactacggccaacaaccattctttcaaagattcagtcttgtcaactgtagctcattttatgcattattgattccctctctcaaaaatataattgggcttatttacaaatggattgcactcacagaatattttcttctgtgtattgattccatatattgtattctaattccttacaaaacataacgacttgaatgtttctcctttattcttcaattgaattgtcaagcagtgaaacaccaaactgaatggagtttatgaatttgccaacttggaaagagcaggtctaaagatatacatgggctggactggcccagaggttcaatgattggctagaaaagggaccaaaagagtaaggttaggatcttccatggcttatccatatatacatgaagttgtatcaattttctagaagctgagttggcgaggaagcacataacgaaaggtctggaatcttctatatgcaatggcaaaaataaaagtcttctaatgctgtgtggaaactcattaggttcaaaacaaatcgctctgggtgcagtgactgggttattgtgtgttaactaagaccttgttagatggaaagatgaagtgaaatccactctgctgtcttcagtaagaagtatcatttgtattagccaggatttgaggtactcagaattttttttttttttttttttttttttttgtgaagaaggatatttccaaagactttaaaagactgactgactggaaatttgttcagttacctttatcttattaacataattggagggttcattttgtgccaaggaatctgttgtcttttggtgatgtacacaagaataagttctttttcctctgttttgttttgtgcgatctgttaagcaaggctaggagaatttttaagtttttcattcagaagttcctcagttgatctaattgtattttttcactttggtagaatttatctatttcatcatttctcatgaaacacaagctccccagaaatttagtgggtgtttgataggacccactcacccaacaaatgaaattcccaggagaagcagattaggaaatattgttgtgtacaatttttaactggtgtaagtactacagtatttatattttaactcttagtattgtcgagcgtcaagaaagaaacacagtatgtagtgtttccagagacgctctttacccacagggaaataagagtatcccagaatgagaattcaacaggacatgccttaatatggaattaaggaatgctggtgcttaacctttaaagttagccaaattgtttttcaaacttgtctggaaacctcattaacaaagcggctacgggtctttaagaatgagataagtaaccagcataaagtcctttatgtgagttgttttatttgatctctgtaacaacaaccctgtgaggtttgcagagcaaggatcaatggctcaaagtaatgtagctcatgaacagggggattggagataaacaggtaacaagtaagtaaagaataaatgtgaactatggagggaaaaggcagcataaaaactacctgattttatagatttcaaaatataagattatttactttaagcaaagtcttaaacctgtccatgtttctaagaggatggaagagtttattagactgagcatgaggcttacaaaaatttcaaaaaagcctagtcaaagaaaactttgttacaccatgtgtaatgtcttcagcaaacatttaatcaagtatatttccccagcaaattttactgctctttcctttgccatcattttcttttctttgtctactccaatggtccccaaagtttttggcaacaggaaccagttttgtggaagacaatttttccaccaactgggggtgtggttggggatggtttcaggatgattcaagcacattacatttattttgcactttatttaaattattacattgaaatatataatgaaataattatacaactcaccataatgtagaatcagtgggagctctgagcttgttttcctgcaactagatggtcctgtctgacagtgacagatagtcaggcattagattctcataaggagtgcacaacctagatccctcgaatggacagttcacaatagggttcacactactttgtgaatctaatgctgccgctgatcttacagaaagtagagctcagacggtaatgcaagtgatagggagtggttgtaaatacagatcaagctttgctcacacctttacctcctactgagaagtctggtcccaaacaggccacagaccagtacatgtccatggcttggaacgtgggcacccctggtcgactgtattcttataatatacaaagtttccctaacttaaaaaaaattatcttttggccccacattttaaaatcccttataaacctatttcaataaggttttgccccaccatagcacagaagccactcctgctacagtcatcactaaatttatagtgctaaatataaggccaattctcaggccttgctatagttgatgtctcagcagtatatgacatagttaatagttttcttccttcatatacttcttcacttgcattacaggaaactacattgttttcctcttacttaccagtggctacatctccatctattttcctccctctgacttctgaatgttggagcatctgctctctgaagaacagatgataagtctgtcttggcatgacaactcccagtttcttctcttcttctctttctttcttcaccccagggctcagccctccacatgttctctacctacactctctccatgattccaatcaatctcatcctattcatatactaataatttatgaatctttacctctagttcagaccctacaaccaaatgcatatatccagccacaatcgaacatctccacttgtatatctaaaagactttgcacatttaaaatatcaaaagcttacgtatttgatatccccccttaaaaaatttgatccatcatctccagtttacatgatgaaaactttgcctttccagttgctcaagctaaagaatttggaattactctcacatcctccctatgtctcacacctcccatccaactataaagaaatttgatttactctaccttcaaaatatatccagaatcctaccacttccattgatcactctgttttgaaccactgtcatctctcagctgaattattgtaatcaatcactttttatgaggtctctctgcttctcccatgggccatctccagtctatttttaaaacagcatgaatcagagtaatctgttcattttcatttttaaaaaaatgtctatggatatattctaattatgcatatttatatggtgcatgtgatattttgatacaagagtgatgttttaaaccatatatctgaacacatcaatcgtctgctcaaaactctgcaacttctttccacttacacaaggctctacataaatctcactgtctttatcttctgacttcacatccaaatccaccccagccacactggcctcctgttgacttttgatttcctctttcctttgtctgaattgcctttcctccagatacatggctaacttccccacttccatccagtctttgttcaaatgtcataacatattctaacatagtaatgtattatagcacagcatgtgtttatatgctttacttatttataatgtctgtaatgtattgtctgccagcccagttagataataacctccataaaagttaggatccttgttttattcctgatgaagctcaggtacctagaatagttcctagaacatgatgaacacttaataaatacgtgttcaagaataagaaataaatatcacactgttttaatgattaactttataaatcttgattcttagagcttaattataatatcaacttttcaaattccatttttcaactctgttgagattgtaggggccaaggagaaaattttcttccaccctctaaaggtttgctgaaaatgaattgagggaaggcagattaatgtgaaaaaaggcacacaaaacttattttaacacgcatatggatataactgccatttacaatgtattagactggaagaggggccagagggctgatgcttaaatattctcgacataggagatatgtatggattcaggaggcagacattttgcaaatgattctttttggaagctgggtgggactgacaaattaaaggaaagtaaggggaaagactgtgcaggaataaatattgctttattattgcagattaagtcccctgggtaatctctgggagctgtcctctgaagaacagattataaatctgtcttggcatgacgactcccaatttctgctcttctctagtggttaatctgacaggattcctgaagaggggaatcttgagacaattacattccttgtggaaagaagtgttttcagtcagataaggaaattccagagagagagagagagaaagggaggagaggaaggtcagagacagatcttggttctaaggattatttctgaggcctttcaattttcaaagcgctcaacaagccaaagtcatatttgggggaatcgttttctgtgccccaacaagatttttactgcaattgcttaaattaataaattaacttcgggaagttattgcctctattgtatactgttttaccatgtgtacatatggcttatgtctccattcatttgtgtattattttatgttcttcaataaaattgtttaatttttcccatagagatcttatatatgattagatttatttctaggcatttatagttactgtgattgttatctcctttatatgtttttcctaataaattaatactggcatataaagatgctattgattttccaatattgatatggattacagcaaacttgcaaaactattagttctaagagtttgctatactcttggtattttctaagtaattacacagattgggaggatttacttttctcttctcttccttttcagttttcatttattgttattgtccaagacatataaagcttgtaaaagtatagactttaataataatgctattcattaatgtgatgcttatcatagtaactggtagatagcttttatcaggtttggaatttcatttacaagtttgctaagaagtattttcagaatacaatatactcatctttcaaaagtagtggatttcatggacagtttttttttttttttaacttctgggacacatgcagaatatgcaggtttgttacatagatatacatgtgccatggtggtttgctgcacctatcaacctgtctctaggttttaagccccacatgcattaggtatttgtcctaatgctctccctccccttgcccccaacaccctgacaggccccagtgtgtgatgttcccctccctgtgtccatgtgttctcgttgttcaacttccacttataactgagaacatgcggtgtttggttttttgttcctgtgttagtttgctgagaatgatggcacatattcttttggaactgtttttcttttcctagggataaacaacttgattttttttttgtatgcatgattctctgacagaagtgaaatttttaaaaatagaaaataaattaaactctgttgtacttgattagtgttcattatttctatgcctaccattaatcctttacatacataatttttgtgacctggatacaggcaagttgagctcttttttgactatctaaaatatataagagcccaagtaatccaagtaacagtaagtctggtaccagcctcttggggccaatgttgttctgcctaagttatctaaaaactttcaaaacttgatcagaccaaaaaggaatttttttgtttgattgtttgtttttgttttttgtttgtttacaattcatgaaaagataactggaaaatgtgataaagtaacaagtgagtaaatttttaaaaaactgctattgcatatttttagccctcaaagtatcacttttgaaacaagtgttccctcaaaatccaacaccatccatgcaccactgcaataacccactgtcatacaggccaaattaaaccatcttatgccaataaatggcctagtttttccaaactagttccaccagcagtagtgacaacctctaccaaagtgattcttcaggaagaattttccattctccaagttttaccagttgaagtttaggttcatactcatgttcccaaattcatcaagatgactgagccaggaaggtctttcagattccatgccagaaccaccactgggtgttggaccatagttcaaattcatactcttacttccctcatggtaagttctctttgtggactcttggtactccttgtgatctagtcaattgtcagtctaccagagaattaagaaaaacattgaacttcacaattgaaaggggagcaatctgttttttcctctccttcctgaagtttcctggtttatgtcaaatatcttcctcctccactctcttaatatcaagacacagtagaggagacactttttgtcagggttctattaaatattcttccttgggatgtgggagcctacttgacttatatttacacatctaaaaggactacttggtaattcatccaggaagaaagatccactctagtgttgattctttattttatagatgaacaacaatagcaacaaaacatttgaaagctttcaatttgatgactttctctaaagaaaaaaataaactcaatatacacaaaataaactcaatatacacacttctcatctcttcaaactatacagagtaagaatttcacagatgaatgtttttctctatcaatcattaacatgtttatttcatgctgtaatgtgggacctagctattttttatatttctgataattattaacatttatcatgggaatattcacttaactgcaatgtaacaggatcaccatgaatcagtctgactgctataagaatgaaaataagaaacaaggttagaaaaaaagaaccagttacaagattgttacagtaattcaaaggagagtagatgacccagacaagggtgacaatggtggaggtcatgacagtgggtcacattcacatattttgtgaaaagaaagccaacaagtttttctcatagattgtataaaagatgggagaaaaagagagaactcaaggatgactccaccgtttttggagaaagtgaaaaagtgaagttctcactaattgagttggggatgaattaaagcaaaacatatttgggggagaagcacgttctgaacacagattttaaacatattgagtttggaaagtctgtttgacagccaagtgtgaaaattgtattgcagttgaatgtacaataatatataagttaagatttaaacttttaatagagataaaaattttaggaatatatattttggtaggtgagaaagacaacaaacatattttgtaaatatataatatggcaggggtgaaaggcctttctgataaagtaacaattgaagagagttctacaaagacgttattagtcatctttgacgaccccctacttcactccacaggtgatctcatccaatgttatagctgcttgcagaaaacatccatatattcactattctttactgtgggcttatacaatagcttgcctgacacctttattttgacatctaattagtcatttcaaacattgttttcaaaacccagtccaggattttgccccatcctaaccacaaatctgcttctcctacagattttctcttctcaaaaaatagcaactccatctttctaatcgaagactacaaatcttgcagtcatccttgagtctatgctttttgtcccatatcatattcaatccattcaaagaatatgaccccttttataacctttagtcctattaccctggtctaagccaacgtaatttttcacctcttaattcattttcttaaattcctttttttgtcctgtcttttataagaggactgaggaatccatcgaaaatgtaagtgaaatcatgtcactcctctgctcaacaccttcctatagttttcatatcaccttgagcaaaagccagtcttaaaatgatctcaagaacacacatcatatttccatctatatccactcccaccctcttgctttatttagtccagtccattctagctacaatggtctccttgaaaatcctaaacccacttgtgtcactttgtctttgatctttctgtttcctctgccagaaaactgcatgatttatgcttgtattgcagggtttagctcaatgctttcttttcattatcaattcccctagtataagcttgacccaaatactgcatgtgacatcattacactcaagtttttcattgtttattgaaaattcaaatctaactgtacatcctatatttcatctggcaaccctagctgtgaggatattgaacaaacaagcaaaaattatccattacagataggaatggctttatctgaattaccgggtttgtgatgacagagtaacagtttacttgcacagttttacatgttacttccctgttcaaacaactttgatggctccttgtcattctatctggtacccaaagtttattctattcagtatggaaaaacaaaggccatcgtaatctatgctggccttccctgtcaagtctcatattttaccatttccttatagcacatgttttctgctctgcatacaggacgacttacaattattcttcagggatatccccctccctttgctcatgttattttctgctcctagaataagtactcccctcctttcctttacttgaaatataataactcatctttgaagacccaactcaaaggatatcacaaagatattctctgctttctgctcccacacataaatatgaagcaaaataaaactttatgataatactttattgcaatgcatatccttgcctatttgtgtattacttctttgcttgatagaattgccttgatgtcagaaaagtattatcaccttttaaaacattctaaaacttattatcttccacttgacaccaaagtaggtgattaataaatattgatgaatgagtaaatataaatatatattttaaaatttaacatatgagacaccattgtatttgatcattaataatttcaaatatatacttgtactgctttaaaaaattgaaaatctttatgaccttctgttggggattgattttttagaaatgacaccgtgagcccaagccacaaagaaaaaaaaatgataaactggaacttcttaaaattaaaaacatttgaaattcaaagaatactatcatgaaagaaagtgaaaagatggtctacagaatagagaaaagctattttcaagccatatgtttcataaaatacttgaatcaaaatatatgtaaaaaattcatgtaaatcaacaataaaaatacatgtaaatcaattaatatgaaggcaaataatttaaatagacatttctccaaataagatatacaaatgaacaataagtacatgaaaagatgtccaacttcatcagttattaggaaatgcaaatccaaaccataaggaaatatcactttgcacccactagaatagctgaaataaaaagatagacaataataagttttggtgaagatgtggaaaattagaactctcatacattgctggtaggaatgtacaatggtgcaaccactttggaaaacatttcctcaacatgttaaagatagaattgtcatatggtccatcaattctactctaggaatcgatccaagagaactgaaaacatttgtccgtataaagacttatacacaaaagttcacggcagttatttatagtagccaaaaggtggacacaacgttaatgtccctcaactgatgaatatataaataacatgtaatatatccccatgatggaatactattcatcaatgtagaaatgaggtgtggataacatgctacggtacttgaacgaaattcaaaaacatcatgctcagtgcataaaactagtcacgaaagaacacatgttcagcaactccacttctgtgaaaagtccagaactgcgaatctgtatgacagaaagtagttagtggttgtctggggctgggggtgtgtcagtgattgctaataattataagatttccactaagggtgaaaaaatgtgagattaactaatgttgatagttgcgcaactctgtaagtatactaaactccactgaactttttatgtttaaagggtgcgttttatggcgtgtaaattatatcccagtagagctgcttaaaataagtactgacttttaatacagccatttgtcatttaaattaaagtgccacaatttattttaaaggtaagtcaagttaacaatggtttggaacaaaaacaagatctttttctaagatataaatcacagttttaatatgactttttattctgatattattaagacacacagtaagctcacgatacaatctatttaaggtaatgagaacaaataaaagattatatattttctgcaaatgcaagtttcataaacactatggaataaaaattgagagttttaaaatctcctcatgggtaatcccaacacagtagcataaagactatgcagtgaacatttactgcttaatggaatttaaaaagttaacattttaaaagcgttttattttaattgcctgattactatctatagttagttaaatttctcttaccttgagcccatttaaaagtatgcaattttcttgttaagtgcattaacaagattttaatggagcgcaggtgcacagaattggaacaaacatttttcaaattagaaaataaatatcgttcatttgcaccaaataaatatttatcaatattatatatatataatatatgtgtatatatataaactccactgaatacatatatgtgtgtgtgtatatatatatatatatataaaatattgaataaaattcaaaaacatcatgctcagtgcataaaactagtcacgaaagaacacatgttcagcggctccacttctgtgaaaagtccagaacagcgaatctgtgtgacagaaagtagttagtggttgtctggggcttggggtgtgtgagtgatatatatatatataatggtgtgtggatgcttggtacctgcttggtacatgcctataccatgcgtcatatataattttatcctgttgatttatatgttctgattagaggcaatgtggtaaagcgtaaattaactgaactgggaataaaagttctgcattttaattcagatcacctctatgtgattacctgagtctcagtttctccaaaattcttcagagctctagaatcttaaatatgatttttcaattctatgaaacatttttcaaaataaaaatttgtttttcaaggtttttataggcttttaagcaaatgtattaatgtacaagtaacatacaatttaagtgcacaattctgtcaattttgataaatatatgtgcctccgtaaacacccaaatcaagataaagaacatccccataaaccttagaagtgctctcatgcccccttgaagtcaaccccacctcccccattccaactcccagcccaggcaacaaccaatctgttttcctgccatgatagattaggatgatcttttctagaatttcaaataaattgaatcacacattatgtactcttttgtatctactttctatttctcagcttaatgtttttgtgattcattcattgtattggagagatcagtaatatgtttgttttcattgtacaagcatatcaagttatatttgtttaccccaagagtacaatagtttcttctatttttaagaagtgtgtttgaatttaattatttagcatgattgcattgtacttttatttatagtatgtaaacgttatttccaaggaatccctgttggttactaaattgtctcttaagatacaagttgaatctacagacctaattctttgaagatatcattccatatctgaacatagaactcctgtattttgggtgccaaattctatttaataaaaggggtaagtgctgctacgaatatgtgggaatgttggagtgcatactgcagttcattaatcacatttccctttagagtctgtattcccctttctgctggaaatgttgctggttgaaggatcagagctgaacatttctctgggaattgctcttagagggagggaattgtgaacttctacagtacacaactatctgtacactgaactcagaaaggccagtttataatcattaggcagcacccaagatctggattagggaagatgggtggaaccaattgccagtcagttatttccaaatttgagataactgaggtatgataactgattttagaggggttttgccataattttaaatatcttcaaatcctgtataaagtctacaagtaactagaccaccataagatttattagaacttctaccttctcacattgagaaattcctctagtcaactttaaaaaggcaattgtctctatctttctctgctcttttaattttgattctctcagctatttctccacactctcacattgtttaggttattggacttacagtacttcttgccatttgcctgcatttcctttctctgtgttttatctttctcactgctttcatgatgctttctgttcttctcattcttctatagtccattctactctatgtgtcatttgcattcctaaatatcatgaactatgcaatattgtgcaataaaaatcacagggcttaagggggtaatgaagtttatggcacaacactaaaaactttatcagtgtcacattaaaataaaagtaaaaaagctaataaaaatggtagcacaattttacacctgttaaatagttggagatagcacaaatacagtgataagtatttttttttccccgagaaagagctgaagtttgcttgtagaagtgttagaagacttaaaggctttcatttcttgtgaagtggtagaaggaaaggtatctgaaatcagaaagttgtaacacaggtgtcgatgggcaaatttatgacatacaaggggcattgaggtcagttttagatatttgaggaatgggcatgtgtgcattttatgtgttcctatgtggcttgtttcagccaggtgtggttttctgtatttagccagtgcttctcaggaacaaaattgcatattaaaaaaatttgcattacattgaaattgttttataatatatctatcatgttgaaacaaattcatgtttttaaacaagtgctgaaaacatgagcggaaatgactgtactttctgtattttctctccatactttttgtttctacttatgttctttttctcttagttatttctcccaaattgctgcaccgtcctcactacaaaacttctccaaagtagctaggctgaggagcatacttttatttatcattattattattattatcattattactattggtcagagcctcactctttcacccaggctggagtgcgctaatgcaatcatggctcactacaacctggaccttctgggcttaagcaacccgcccacctctgcctctctagttgctgggactatgggtgcgtgccacaacacctggctaattttcctattttttagagttggagtctccccatgttgcccaggcaggtctcaaactcctggcctcaagtgatcctcccaccccagcttcccaaaatactgggattacaagagccagccaccacatacagcccatactttcttttcttttcttatttatttatttatttatttatttatttatttatttatttatttaaaggttgtaaggctctgttgcccatgctggattgctgtggcatgatcatggctcactacagcctcaaactcctaggctcaagccatccttttgcctcagcctcttgagcagctagcactacaggtgcatgccaccacaccctattttttttttttaatttttttctagaaatgaggccttgctatgtcacccaggctggtctcaaattcatcgcctcaagcagtctcctgcctcagcctcccaaagcactgggattaaaagagtgagccacaacaccaggccttttactttttaattgacaaataataaatgtacatattcgtgagttacaatgtaatgttttgctatatgtatacaatgtggaatgattcaatcaagttaatatatccatcactcactcacttatcatttttgtggtgagagcacttaaaatctactcttctagcaatgtattatttattattaactgtagctatcatgctgtgtaatagaccattattcttactgtataattgaattattttactctttgactaacatctcccattaactcatcacagctatcctttttttccagcctctggcaaccaccattcttctatcaacttctatgagtttgactttttagattctacagataagcgaggtgaagaagtatttgtctttctgtgcctggcttatttcacttagaataatgtcctccaggctcatccatgttgtcacaaatgacagaatttccttcttcttagaaactgaataggatttcattgtgtatgtatgccacactcgcttttatccattcatccgttgatagacacttagttaggttgattccgtttcttggctattgtaaataattttgcattgaacataggagtgcagatatctcttccacacagtgatttcaattcctttggttatatacccagaagtgagatttctggatcatatgataattttgattttttgaggaactctcatacctttttctgtagtggctatactaatttacatttttactagtagcatacaagggttccattttaccacattcttattcttttaccaacacttattggctttttgctaatagccattctaacaggtatgaagtgatatctcatcgtggttttaatttgcattttcctgatgcgttgttggtattgagcattttttcatgtatctgctggtcatctgtatgtcttcttttgagaaatgtttattcaggtctcttccctgtttcttatctggggatttattttctttctattgagttgtttgagttgtttatatatttcggactttagctgtagggcatacttctgaagacatatttttagaaaaccctggtttctaagcagtcctttcggaaagaagaaaaatcagctctcaaaatatttaacccctttcaacctccttcctgtgagttgtgtgcacacatgattttatgttaatagcaatatagaaataaaaacttttctatactatatgtttgttccagctaggtcagattcacagcaggaataatctttgataaaaaatatttggtaagttattcttctgggcatcattgaaaataaaacttaaaaatttacaagggatcttgaagaaaaattttaaaattgtacaccttataggtccttacccattaattaaaaataatgtatggtgttatatcatagcattgtaaattaataataaattatatatctaatttataaaatagtagctaacacttaaatgtttaggatacatcaatgttttatgctatgttttatatatagagagagcatagcatagcatatttcaaatacatctattaaactgtttgaaaattactgatctaccttcatattttaatgtcaattaacagtttccttagaaacttagtttttcggcaaaactagttcttttcagaatttcttatttctcactgtgaaagcagtgtcagtttaatttctttaagtttattttaaattttaaattaaagatgaaaattcttaagtgccatttctttttctatttctgcagcgtttgtccaatggttctatagactcaaccgatgaaactagtcaaatagttgaactacaagaattgcttgaaaagcaaaactatgaaatggcccagatgaaagaacgtttagcagccctttcttcccgagtgggagaggtggaacaggaagcagagacagcaagaaaggatctcattaaaacagaagaaatgaacaccaagtatcaaagggacattagggaggtaagtgattcatgccactttcagtctttgatttctgaatgctgcttctgagatactgtttccataatttcccgtaatgaccatacactttttacttctcaaaagaccatactttggcatgcattatattagttatgaaacttgttcaatagcgcaaacatagtttacttcatgagcattttaaatgcccatgatatatggaaagaaatttgtgctatcaagggtcagatataacaaagacattctgaagctgttaataaaattttttaaatgtaagcttttaattttaaataactctagatatgtgtatgaatcatgaattgctatactcttagcatataggaatactacaaaaatgccttaaattgttccattgcttattttggttttgtgtcatgaaggggaatgtatctctgttaatatacatatacacgcatatgtataacatgacctttctttgtctatatattaaattcctgttagacataacatccctttttctacttaaaaaaatgagtactttagtcatttctcagtctcttggctaatatcaagtgaagagagtactttaagttactaaaaaaaaatactaggagatgtttaatttgtaacactgtcaaatcattttacctgctaaggtgaaagtttagaatcttttcactttttcaccttttcagtcacaactgaaaagaaaattatatttgtggaaattgcgttttctgactttttgccttttccatttttacatattcttttaaatgtatttttatcttttaaaagtatcttttgtatataactagctagttgttcatcaagttggccctattctatgtgtccaattcttttcttcccattctctcgtaagccaattgtatcttactttttccctgactgttccaccaaaactcttctcataaaagtcattactgacctccatgttactgaatccaaggttcaattctcagtcttctgaagcacttgatccattttccagaggacttcttcactgggctcatagcacattatcctcttctggttttcatccgtatttacttgcttacctcttcgaaggctcctttactgcttctatttctcctccccgaccttggagtgtcttcccttctctacctacctttatttccctggtgaatttctgcagtctcatggctccaaaagccaccatcatcttaggattcccaattaatatctccaacttgtccttctttcctgatttccagatgtttctctctcagtcactaagggatatctcaaaattagcacttcagactcttttcttgatattttctcagcaaaccagaccctcctgcagtcttccttatccattattattgttgctcaggccaacaatcttgaagctgtccttaagatctctcccctcacacacttgctttgattcagcagtaaatcctgttatttacaatttcaaagtattcataatgggacctcttctcagaatcttcatggcttttgctttttctacacaatcactttctctcactggattatttcaatggtcatctgtttcctggtcttcctgctcatgcgttcagctcacctcagtctgtgctcaacacagcagcttgagcagcctgcctataagtcagttcatgtcacttttctgcttaaaacttttcagtgactacctattctacttacactattatcaaaaccctcacagtggtctacaagccatgtacaatctctctactaccaccttcctgacctcttggagatcatctactgtctcatcctaacatgctctgctcaactggagtgacctcttaagcaagccagacctgttttgttacattttcttttctctctgccttttgttcaatgttgttttctcagtgaaatgtcccctgaccttgttatttacacatatacactctccctcttcttttgtttgcttatcccacaggactttctatcacctgacacaatgtatattttactgatatacttggttatcatatgcctcccaccccaactattcgtaaacatctataagagctagggtttttttcttgttttgttcactgctgtcttcagagaacctgcgcagctattgattgtataataggcactcaaaaaatctttgctgaaagaatagatatttataagtaaatatcagaaggtgtgaatgatatcagaatatgtactacgacaatgcctgaaagcaaaacaaaacaaaacaaaacaaaaaaaagagatagatgaaccatgaagtggtagactgctccactgcagcacagataatgatacaactttttatgaattaatataatagttcatggatgcatctcttctcttcactactccccacaattcaaactcagagaattcataaagtaaaggcagtttaacccctcttctgtatcactgttaaggaattactaggatttctggctatcaaatcaccgggctcacttcttggtctgttgttcattctctccatcttcattctcttggccctggagatttagatgatttcctttcatcttagtactcattgctctattaatgcttatctaatccagcatcacttacaggtaaggcccaacattcaatccccattttctaactgcctatttaaaaataactccttgatactaatagcctctgaatgtaggtaacaaaacacccagtcagatggaaaatgtcactcctatgatgccaggtgttcttttattaagaatccattctaatgggcaaaacgttctcctttcatgtggaattattttaaaatacaactactcttatcagccccatcgtttctatgtatatattttagaagagtttcctgagaaaggaatatctctcatcatccacctttgaagggaggttgcaaacacaaatgttttcagagccaggctggcaatggaaaagtgtaaagtgccaggtgcaagactgtaggaactgatggcgttgatgaaacctgtgaaatggcctacactcagcctgcgttactgcatgcatcacttttttttttttgtatacacacacacacacacacacacacacacacacacacacacagcactgtgaaagctaaataaacgaattctgaaatattcaggtctcaagacccaggcccatggtttatgaaagattttttaaggacgagtcacatgtgaaaactattacgggtgtattacatggaaagtctcaaattcctcacaactggcaaaaggggcaatgctaattattatctccatttttctcagatgagacccacaaggttcagtgaggtaaagtaacttgccaaagatctatgcagttccctcctcggcagcacggaagagaaataagatcagcatggcttcaaaacctgtgcttcttccactatgaactgcttccaaaatcaacacagcacaataaataattcagtgatagcaactatcataaaatgaagctacaacataactgtcctctaaataatcaatatttggatctttttttttcaataagcaggaagatgtgaaaatcacgtacttaaaaaacaaattacttagcacttaaagcttttattttcctgaataatatttttccgggttatggtcacatagagtcaactggattgcaagtttcttttccttttcttaattattcttttaaaatattatttatttattttagagaaagagtcttgctctgttgtccaggctgaagtgcagtagtgttttcagctcactgcaacctcgaactcctaggctcaagcaatcctctcacctcagcctttggagtagctaagactacagggcacatgtcacgatgtctggaaaatttttgtgttttttgtagagaaagggtcccactatgttgcttaggctggtctcaaattcctggttcaagggatcctcccacctcatcctcccagtgggctgcaattataggcataagccacggattgcaagtttcttagtagaaaaaaataagctcgtttttcttgatactcctatagcattgctagcatagtatgatttataaattgtacaggtaataaatgtatgttgtaataattgagtaaaaattaggaaataagaaaaaacaaccatataataaaaaacagaaatataatttgctttgcatgtgaggacattctaaggtatctaaaattaactattactttgaatagcaaaaactgcaattacttttgcaccaatctaatttataaatatgttccactgatggcttcagaatatacttttgtaatttttctttgtcaaaaaagaaattatccaaaatttaatttcattttacattttgtcttcaaacaaaactccttaaattgattttgatctaggaagaatacgtgagttggattaaagctagacacagcactcaaattagaaaaatagacaatctcatacaagtggattatctctccagtttttaatcaaaaggattattaattgtgtatggataatgatatatcaaatacatagctgtgccagtagctaaaattttcagtggagtattttaattacattttgttttgtgaataaaaccatcctgtatttccaacttcctattaacagttcttcagaatttcactatgtgattaaatgaattaaatacatctcagtgttgccttttctgttatctgaaacatgtagttatatttttcactttaatagatctaaattaccagagagttatatttattaaatatgaacaaaatccaatttatacatgaacttcaggtcaagagatcattgaatctttattttttctcattttttttgtaggtagcaagttttagggactagaaaaagcttcctctttcagaatttttcaaatgacagagggaaaagctatttctctgacttgtaaatccagtttatttttggcaacacagcctgcagttaaaaattgaatctcccacatgaatcactgaatcaaaaaatgcagtaccaaaattacaaaatgcaaaaattcctgcatgtaatctacgtcatagagtgagatcatctaattgtgtacataatagtaattaataataaataacagctattatttatcgagggtgttttctgcatgagacaccatacaaagcacttcctgattcttaacaacaatgctatgtgctacatattagaatctcaacccacacaatatatgaagaaggtgaagcacggaaaaggtgaccaatactgatcccttataacagagttaataagtgtcccaaactagcatttggagcaagtatgtactacttcagtgctcacgttcttgagaaatgtgtgtatatcttttattgactttattgctgttaaaatttagtaagaagtttatttacacaggttagctttagacttttctcttcagaccacaaaattttcccagagttctgtttgcaaatgaaactgacagaatacaatattaagcactctgaaaagatcctctaagataaaaactctaccatcattgagataaaaaatatgtaaagtagaaaaagtcaaaagtgaaaataaatagctttttaaatagtaggcattatttaggatatctaaaatctaggagtatgtatataatatttcttaaaaattagtctggctattttttgctgaattcatagattaaatttaattttttatgtttgcactttaatgtcaacataattaatcaagtagcttttgactgggtcttggtggtcagtaggattgagctagacaaagaagacagcacacattccaggtagacatgatgtcagagtgcattagttttgtaaacctgccataacaaattgccaccaactgggtggcttaaaacaaccataatttagtcactcactgttttggaggctttaagtctgaaatcaatgtttcagcagggccatattctctctgaaggctctagtgagatttcttcttccccccttctagcttctaatggttactgggagtcattggcattcttggctggtagcagtacaactccgtataacgcaattctctgactgacttcctccttcttcccggtatatctctgtgtccccaaatcccctccttgtaaaaacaccagtcattggatttagggcctatcctaatcctgtgtgacctcatcttaacttgattatgtcaacaaaatcttatttgcacataaggtcacattcacaggttcagagtggacacgaattttggggggatgttattagccccagtacactgaagtaaggaagtatcaggtcacaaaaccacttttattccaggctttgtagctcagattttaccctgaagatggaggggaagaaataaaagtattgaaaccaagaagcaatatgatcatttagaaatatctctcaggcagcagcgtggaggaaaagtaaggagaataaaagacaaaaaatacaagagagagagctaacttgtgggtgggcaggagactagggacaacatgatgagtttcatggtggatctattcctttttctttttttttttttcttgaaatggagtcttgccctgtggcccaggctggagtgcagtggtgcgatctcggctcactgcaacctccacctcccaggttcaagcgattctcaggcctcggcctctctgagtagctgggattacaggcatgagccatgatgcccagctaagttttttgtatttttagtagagacgggatttcaccatgttagccaggcaggctggtctcgaactcctgacctcaagagatctgcccaccttggcctcccaaaatgctgggattacaggtgtgagccatcgcctctggctgatctattactttttaattaattttaattttttatatatacaaaaattctcaaagtcaaataatggcacgtataaatatggtacatgtataaacacacacagcatctcacttcaagttttcatcccatttccctgaaattcttaatttcaacccttttatccactacttctggtattttctctctttatttaaacaaaatttatgtcttgctattatattagattaggacattacctattttatttcttattttactttttattcaacctatcttttcattagagttatcatctgaaaaaaaaaagaaagaaaattggaagaaaggctgtctgtttatctgattattatatgtgacaggactggctctggaccctgtaggagagtgacaaaggcactgattaagaataagtgatgaaatgattctggataataagatatggaaactatagccatttcctcaattccaggatccttatacaaagaagcttcccacattctcaggaaacaattccaggccaatgagcctcacttctgcacttgattttcacccaacatcttgtcaataaagtaggttatctaactaccaataaatttccatgtaagctgtgaggtaaaattatctccatattactatctataaattctattatttaaaaattactgtttaaaatattatcaatgccatgattttctccacttgaacttgattttttcctatatttatgtgttcatggacttctttaaaatcttatgtaattgaaacatatataactaggtaaatggctaagtttctaagtcagctggtaaacttataaataagatccaaatgtactatttttttttttggcctggccttttaaccacagagttcctctttcttaatgtaaaggtaagaatacggatggtatttgttatctatttgaagactgctttacaatttagaactgtagccaccattttaacaattttatgatttgcaactctactcattattgtacttaattttactgcataatgaactaatttatctgccacttgtcttacaagaatgccaattctacagtagagagtttcaaaagctactccattgcattcttagacagcagaaagcttttggttaaccgaagatacaaaaataattctgatagctaagttgggaacatgcacctgcaatctcacattcgttcaatgaaaagaaaggaatgagtatttacttcaagaatgcaatagtttttatgtttcttttttatttaactaacaagacaataattaaacaatctgagaatctgatttgctttttctaaattattttaattgtaggccatggcacaaaaggaagatatggaagaaagaattacaacccttgaaaagcgttacctcagtgctcagagagaatctacctccatacatgacatgaatgataaactagaaaatgagttagcaaataaagaagctatcctgcggcaggttcagtatctctgtcttggttttcttctggtctgtgcgttctcatcattctcacaaaacggagtaaataaaatagggtacttcttgacagatgtttgagtaatcattctctaaaatttgaaattctctagcaaaacaaatacgattttcagtgtgaaatttactttccagaaagataaattatttatcttaatagtaatacaaataatgactctgatttacttttcatataggcatgagccagaatctgtgctaaacagttttcatgtattacctcacttaattctaaccaccacctatgaagtaggtggcgttattgtagtaaagacactacagttcagagacagtcagactttcccaagatcatacatctgctaaacaccagagccaataatggaatactaagtttattgggctctagagcagaaacaggcaaactatagccgtgggccaaagctggttggttgcctgctcttgttaataaagtcttattggaacacagccatgcccaatcatttaatcattgtctatgactgtttttgtgctacaacgcagttgagtatttgggattgaggccatatgatacaggaggcctaacatttttactatctgacctgttacagaaaatgtttgtcaaccttatctctagagcctggatcatcatgctacattacctctccaactccagtctaaataccatgattttcaatattttgctacggtggtatatctgatgtcttagtactgagctatattccctttgttaaaatgtatactcatgagtaatttctttcctttttgctgccagtggtaagagcttcttcattgttttaatgtgctgaaatgtatgaaggaaacagataagcaatatatgataacaagacaacaatcaacactttgcacatttaggtgtggtagtggctgatttaaatctagaatcatggctgaagtgcaaagcccctggcgactggtgtttgctatccaaactctgactctttaagtgtctctgctcccattcccatttcagatggaagagaaaaacagacagttacaagaacgtcttgagctagctgaacaaaagttgcagcagaccatgagaaaggctgaaaccttgcctgaagtagaggctgaactggctcagagaattgcagccctaaccaaggtactgcactagaacaactggtcaacctagatatatttgtagaaaggacttgtaatcaaaatggaatgtgtaaagattttctataggctttatgaaaattaagtttaatctctattatattgagctgttattaagtcaatttttttcttgtcatacatatttatgccagcaggaataattgttatacaaatgtgatgatccccctgcctatttaaacattaacaaaacaagtaaaatttcatgtcattgttatagttaattttccatggtaatatttgtataataatcctggagataaacaaaaaagataatgttatatgagacataacaatttaacaggcttcacatcaattgctattagaagtatagagaatatcataacttcttgattcctctccaactacagtataaaacttgttagaagtgggaagttagacttataaaagtctgaggtctaaaacaattaaaaatcagaaagcagttttatagttgtaatttcatctgaaaattaaaatcaataatacgctgaagagtgttcaaaattttctgtataatatggccagtagattctgcaactatctgaatattttagaattttacaagcattataatgttaaaaagaactattctgacctctgacaatcaaacggaaatggcatcatttcaaagtgtatgtatatgtcacaagttatataaaactacattttgtcactaaaagcatgtttgacatttaatatgaattcaaaaataatcacacaatttatatttttatacaatcattaatatttgctaagttttcaaggccactacaataagtgagtatgataggtatctggacttcaagtttaaaattacgggattaggatttacccaaaataattgatgcagcaatgaagtagacacacacatctgattttctaaaaaagcaaataattaaaaatgaacagtggactgatcttcctgttggttaaaataggacaattaaccaggtaatgaaagacaaacctttgactgcgtagagcaggattagagagcatttaaatagttgcttgtttacagagtgttggagtaactagttggataaaactgattaagatgggattataatttggatcgttctgtagtcacaaaccatgccagtaaaccactctggcaatttcaggaatatgtgatttctaagataaagattaatttatcatttaatttgaaaaaatatttaaacatgttcatattatttcattttttcttgcaaacacagatcttaaatgactataacctagactaagatatgcataattaggcctttcatctaaagaacataaaggactttcaaaaagagttatctttttcaattgcactgttttggggggttagatgagttactgaataagaaaaataacttttgtaaaattgtagcttaaaataattatcaatattatcttgactaaaacacaagaaaatctgcaatttcccccaagtaacacaatttacaattcagaaaatcactgccccacattaacctttgatagactgagaataaaaacaatttaaaatataatatttgacataaaaaacactatattaaatactcccaagaattattgatttagaatatataaaaataactggaattaggtgccttatattttttcctcttatcttgtctagtctgttaagttgatatatatatatcttgggcacaatattaccttgggcacaaaaaatagctcccctcagctttctcctccctttactgtccctgaacctctttgatttcatttttcagaaaattggaattcttccaaaaagtcttcaaatgctctgattcactctcctttttatcactttctcttctgactggtgctttgtcaacaacatattttaaatatatactttttatattatgaccatattttattcattatgaaagctccttaagtactgagattttatcctgaacacattccttttgcctgtcattttttttttttaaacatttgaggatcactctttcattccttttcccaagttttgtggtttcaacagccttgtactttttcttgtactctgttctcaagacctttagggtctatttttatatctgttttttttttttttttctgtttcaatttgtttctgatatttccttattatggatcatcatagtctttttctgttcattaaccttttgactactcactaaagtaaaaatatttcttcttagcttaaacatgggttcctcctcctatattttgaatgatattcttaataacccctcagacattttatttcaccaatatacgtttttctactttactgtcacctttttttcttcttttttctaggtctttctctttaaatttaatttcttctccctttctgaggttattcatgttctcaaaaccatttctgcctgtagttcatcctaaaactttagtatattttaaattttcctatatcatattaaggagtgaaactaagataaacagtttttcaccaaggagtataaaaaatagcagactgtttctgtgtgatctttgtatttacaacaattgctaaaactatagttttcacatagaatgcaaatcagtagtgttggttgaaaattggtcccagtatatattatttagatgggatgtctgaatgcattctttggttgataaactatttttctccttctaatgtgtttgtgtgtgtgtgtgtgtttgtgtgtgtgtgtgtgtttgtgtgtgtgtgtgtataggcaaagcttatttatgtcttttagaaagtcagaatgattgattaatggttatggatacaactaaaagttttgctttggcgagtttatacgcaattaaccaataaagattactttgggctcccagtcttatgatttataatatctactttttaattaaaatgcatattcctttagcaaggacataattcatcttgaatgaggtattttatttatttctagtaccaataaaatgtatcagcaataataggaatttaaacaggaccaaattctttttttttctctgaagggaattttcacaattttggtgttttgtgtgttttttctttttaagtttgatgtgtttttaataagtaaacagaaacaactagaagttttaaagacctctaaaaacttgtatttttgaagacacagttttggcagctgaaatattcatgtctcaagtgtcttgagtcagtcacctaattaatttaaacactactaactgcatgttaaaatgtaattttgaaggatcacagatatctttatgaatttagattatataatttcaacaacattttgatccacttactctaaaatttaaataatattatttaaatttttatttttaataaaatatatttttaaataatattatttaaaaaattatggcatttggggaccatggtaactctgtatagcttctaaattggaaatttgaggacgacttggaggaaaggaattggttatcatgtctttattatcttccacatttataaaataagaatatcagaaggaaagccttacaaaatgtaaatgttgaattgtagtttgcataagcacaccagaattgaaatgttaaatgtttgctttcatagattaaatttgaatttattgcataaaatagtatatatgcatctgaatcaaatgaataggttactatttcttttcagttactgcatgacatatttatatatagttctatattggcataaagtgagtttcactgttttagaatgagcttataaaatgtgacagaatatgctgtggagttaaatttgtagtcctgacatagagtcctttaaatgtaataattacttaacttgcaatgattaaaatgttgatataacttcatatgtaatccttgcataacatactaacaattttgctatcagcaatgtcacatgtgttgaacactctgcacctgtggtaacctgacggtcacctccaagacatgtatctaaccttggcactgggcaaacatgagcttacaaggaaactgtgctgcctattcactttaggcactattttgtttccacagcaacaaatcaatgcaggaacagtttgggattggcccctaatgtcatttaggagagtcacaaacaagatttcttgttctcacagcattgttgtcaattgataatttgaggactttcaatcattttcatttaaaatttctaattaaacctatctgagagtaagccattaaattctagaccaatatctgagagtggaccgttagaccaatatttgagaccaagtatctgagagtaggccattagattctagaccaatgaccatagtgtgcattcagagaccagaagtcatttcataagttttcctgttgctgaggaaactcaatcttgcttgaattggggactactcacaataacccccaggcttagtttttttatctttttttctacagagcaaggtttagaataaattttgttccaaattaattacacctgagtcattgtctagcattttcctcaacattgtgaaactactgtttccattatttttaagtaatatagacaaacaaaccctaatacaaacttttaacaatctatcagagacatattctggtgtttggtttcccataattccaattattatataactctttcagagttgctttattcattctgtagtagtctttcattgccagccatcactaacctttcatatcttaggttgatagctttttattttagtatattattgttttttatttaaaaccatcaactgcatcgtgttcaccaaatatcaatgtagttctttccacataaaattctgtctattaaagtattaaatttgctgtcacacttttcttttaagcattctgtgctatgttctgtttggtgtcagtgtctttagttctgatttttcaattttgtccctctccttttccttgactcgttagtctgatccaacctcttctacctcatctgatgattatcaatatgttatggaagctaaactacaagaaatgatctccatacgtaggaaggtagtcctactggactttactttctattgctaaatagaatccatctaagtttttcttttcatttataaaaattatgttacttttatttattgataatcaaccatctgtgcagttcagtgcttcaggagcttaagattggacaatggcaggtttgtgttcaaaccatgcacagtctgcatgttacatttggctgatttcattgctcataaataactccaatgttttgctgatgcttggatgtaacaggcctttgtagctgacacatttcaagcaatgctgttcagctgcctgtttgaagaaagtttattttttaaaaactatgtttgcagttggtagtagcttgctttacattttatttcaatttatttagaggaaaagtgttaaccaaatcttacatttcaggtgtattcttcatatttcttaacaggctgaagagagacatggaaatattgaagaacgtatgagacatttagagggtcaacttgaagagaagaatcaagaacttcaaagagtatgtatattaagaactattaccccccaatcattggtttatgaattcgtattctgtatataagaagaaagcctttaactgagtatgggttatatttaaaacttacaaatatgacctgttgacttgaataaaatgtttccaccactttaatcaaaacagatgtaaaattaaattcaatttaaaactagcaacactataaaaataatctcaaacagtttttgaatggatttttatgtcattttttaaaatgtaaggctaggcaaagagagaaaatgaatgaggagcataacaagagattatcggatacggttgatagacttctgactgaatccaatgaacgcctacaactacacttaaaggaaagaatggctgctctagaagaaaaggtaaaacgatagaagggtaaaatcacatgaatattttgcaatgctcatgtttgttttatatacagctgcaatcattgtaatggtcagatgatccatttacttagtttttaaaaatgcctggtatattcttagaaaggaatgcatattttttatttaaaaaagtgtaagatcaaatttgggatgaataaaaaatttgcatgatatataaatcttttatattcacatgttcatatgaggcaaatgtattaaaatatgctgtgcttttatgatgaaaatattttatatatcctttgcctggtatgcaaaatagaaaagtgatgagacacaagtcaatacttttttggggggaaggtgatttgaaatattcacgtgtcaagtgactgatacctacacaccagtctaaaagtcaaaatgtaagtgagtttatatcatcaaaagaactagtatcaatcccagtagagggtttaggaacccagtattttcagctgcattatttcagaaatagtgcttctgtacagtctgcaatgtgatttacagttatatatgtctcattgatagttggcagctaccagaccagcaagagttatgagagctggttaccaattccagagcataaattaaggtagggtataaaacccggatgatcacatcattttagaaatctagattgaatgccaatcactattttagctagacattttccattagtacataaaataaaccaaaatagggaaaatgttttgacaaaaagttagtttgattaatttacccattagaaagtaataagacatgacttcctctcatacaacttcaaatacatggcccctatgcaattactacactcttagtttaattttattctataactttgaaaaagaatacattattttaaataatgtcttatagtacttgtgtgttttgtagaaaaataaataatttttaacaacaaaaataattttctggcaaggtttattttaagtatctatgatgccaacttatttccactgactttgtgacatgtaatattaggtttctgaatagctagagtttgttatttctctaataatttaagtatcattataaattgttaattccacattgcagtagatgtccagaaagtgaaattttaaaaaatatgatttcatgatttcttctttcttcagacaatagaagtgagttcttctgaattttttataacacctctaagatttagcttgttgctcactttttcttacttgaagaataaccaatagtttctgatttaaaatgtggtctgagaaaaggcaaacagaagtagcttaaaatgcaatatttatttcatttgttcattcaagtgttacaaaatagcatttcccatttaaattatgtattttttaaatgtgaaggtctcacatttgaaaatttcatcaaagcatggtttccatggaaaccaagaaatacctgaactaaggaaggaatctaagaggattcttgagtgataagatattaatcaatatatttttaagtattttatgtttaatttattaattatttctgctattttcttttctttagaatgttttaattcaagaatcagaaactttcagaaagaatcttgaagaatctttacatgataaggtataatggaaacttatgttttgggcccattttctatttttattttctattccactgatgaatgttttgttgtaaaataaatttgaaaaaataattttagtatgctatctttgtaaaacaattttaactttttagaatatgtgcagaaaagcgtacatagagaggaagagcttcatgaatctttgtaacccaaattcaccaaaaattagcacttcagaaactccccccaaattagtctatactcatactcttccattaaaggataatcactatcttgacttataacattaaaaaatggttttgccttgctttatgccttatataaatagaattaaaatatatgcgctaatttatgtcagttttagatattctttcagcagaaatacattaaatactattataaatagaattatgctaagttatatatgtccaaacataatcctagttccaaaggagctaaaaaaatctaactgaggagagagaacacagcccttacaaaccaatgaggatgcagggtagcagatgccaaatgccaaattagtgaagtaggcagtaagagctacaggtaggaaagaccatgatatattgctgctgtgaagaagacttcaggaaggagggacttgactgaagatttaagggaaagtaggactctgaccccaggctttcaaacatagtgcatgtggcatgatcacaggtgcttggtggggtgaggggatgggtaatgagtgtgacattttaaataataggcacaactatttggctggaatcaattattcctgttgtagggtatgtggtagaagaggaaactaagggcagattgtgaaattttaatggtaattgctaatagtattttccttcttcattagcctttaaagttattgttagcaattttatcttatttttttaaagaagaaaggattgctaacttaagaagtgatctataactgtatgttgagaaaagatagaagaaatggagagagagaaggaagggaaaaagagaatgaaggaaagaagggagagggggaagaaagaagggagggaagggaagggaaggaaagggaagagggagggagggaaggaaggaaggaaggaaggaaggaaggaaggaaggaaggaaggaagggagggagggagggagggagggatagtatgggatatagaaggtattggaaaagatgaagaatagaggaaagagaacaattatacatttaaccctactggatgctgcatattatgaagcaattaaaaataactaattctacagtcaaggtgtccacaatctcctgaaagataggtctttagaacaatgtaatgtggggcctagaatatagtatctgattctttctgaggtagttcacaaaaacaacacagagattacatttttagtagcctcttaaagacatatatgatcttcataaaggtagagcattctaagtagaggatgaatcctctgcaacggcacaaagaaaatcaagatgattgatttgatgaatcatcagaagtttactgtgactggtatgtatttaaagaagtagtttttgagcagattgtgaattttggacgtgatgctgttatgcatgttatgttatccaaagctctgtgtgctcctggcaatatccccagaacccactcccccaccacctaccaaagccttgtaactccaacaatctgcctaagcaaccaagagtactaatcatgccatgctttgcatccttgcttatgtcagtctccagagagagtaaatcccagatcatatctcatgtctgaactatcatcccatttagatgggcacattcactaatctgaccacatcttctataattcctcaaatttccactaaactaactgtactcacagtccattatcagcaaaaccctctgtaggctcaaactcttttctcagtgtttccctttccatctttatctctacaatttgaagtttctaggtagctttcctttcttctctctgattcacccctagtgacttcatctgatctcctggatttaaacaccatctataaattgagcacatccaaatttagattacctactgggtcctcttccctgagagagtttatatattctattgccaactcaatatctccatttggacacctaggtacctcaaatgtaacatgccagtctattctcaccccactcccacacatcaaacaccaccaccatctaacctaacacaccagcagtcttctcagtcaatcataattacaatttctttctttctttcagttactcaggctaaaaaacttggacttagtcttgacccctatgtttgtttcatatcccacatctagtccaatatcaaatcctcttatttctactctcacgatatagccaaaatatagccactcttaccctaacaccattcttgtccaaaccattactctcttgcctcaaaatttcctctcttttctgactcccaattcaacttgacaatctatttcacagccattagaatgatcatgccacttctctgctagaaaatccaggaaacatagcaagaccccatctttacaaaaataaaaattaaaaacaaattagccaggtgcagtggtgcacacctgtagtcctcctaactacttggaaggcagaggcaagaggattacttgagccctggagttcaagactgcaatgaactgtgatcacagaactgcactccagtttcagtggcaaagtgagaccctgtctttaaataaataaatacataaataaaataattttttaaaatccttcaattgttgcctatctcatgcagagtaaaagccagagtttgaagtggtttacaacctcttttaggactaccattcctgagttctgcaatcatacttttaaaaagtatcctctatttgtcaatttaacctctgcaatccagccacactggactccttaccctctactccatttccactaagaggcgtatgcacgtgttgttgcttttatctgccatgccttttcctaagagtctcattttttaatttctcctttatttaggtcattgtccaagtatcactttattgaaaaacccttccatgactcccctgttttctcctttctaacaacatgctatatttctatattactacttgtttattattcatcttttctactaaattctaaattgcatgagggcaagacatttgtcagctcactactgtatctcaggtgcctgacacacaagaggtactcagcgcacttttgtgaaaataatgaacaaagatatttacaaatcaataagaaactattgaacattttaaagcaacacattagtttattgtacatgtgttttgaaattatatgtctagcagagaaatgtgtaggaaagagactgaagctggtaaaaatcattcaggaaaaagataaaaagggcttagagtaggatggtagtgacgtagtgagaataaaaagaacagaaaagagaaacattgcaaaggccacattaacaaaaaaaaatgtggtgagaaaagtttgagtaaagtaaaatatcaagcactggccactgggaaggggaaaaacagtaatagaaaaatctagaatgatacatttagacctgtaaaacaatataacagttataatcattaaaaccaaattgaatgcttacatgagcagttaattaaagctctaagacaacccctatcttcataaatttatagaccagaaaatgccaatttgagaaaattataattaagtacaaataatggtgacaatatcaagctaattggttattaactttactttttaaggtgcactccagcctcagtgacagagtgaggccctgtctttaaataaataaataaattaattaattaattaatattttttaaaaaaatcctccaattgttgcctatctcatgcagagtaaaagccagagggtttactttcctttttctttcaatccaatcatctttttccttcacccatatgtcctttaaccctcatagaataatgaaagttcttcatttactgcataaataagacattttctttattttcaaaactgcatatgatttctactctgcatttttaagtgacatctacatagctagtcataattttaatattcccacgaattttcaaatattcaggattagtgaatgccagagattgtagataaatttttattaatttctgctatccacattttttattacaaggggaaaattttggcgtgctttattattatgtgtaataacctttaataaaaatatatcctcagtttttcctttttaaaaaaaatcattaagactcatttatcataattgcttgctgatattactggcatctgagtaacactgttttgattttttaggaaagattagcagaagaaattgaaaagctgagatctgaacttgaccaattgaaaatgagaactggctctttaattgaacccacaataccaaggtaacattaaactaaaagcttatctataattcactgaaaatcaacatgaattcccttatggtttcatatgtcctcaactaaaataaatcagtacttcctattgctcactagtcattatcatgttttgactcttcactgatttgcagtttttacattcaaaaataactttttaacttagagattatttctgtagataatcaataaaaaattaaaatgttaacttttgtattctgcatttcattatatatataaatatattaaaagattcttaattgaagaaattgaactgtgtacagggagattgcatctcattcaagaagaggcgtcagcccttctctttatatgtgttcaatacagaaattgaattcgacataaaattttctatatgtgttcagtgtagaaacatgcagaaatatgttcaatgcttatgtgactaaacaaatattattgattatggtcacttagcatctacctatttcggtaaagtaattgcaaaaaaaaaaaagaggaaaagagaaatgaatcagataaaagaaaagaaaacaaaaacttcaaataaatttagccatactcatctactttgattcactatctcatcttaagaaaaagaagcaatggatggcagcttacttgatagatcatagatagatagatagatagatagatagatagatagatagatagatacatagatacatagatagatacatagatagatctatatgttaataattcacacataatttccttttgtgtttgagatgttttatttaaagttgttagaaaccctagaaggacacactcatttagtcacttatttactaggcaacacagaataatagcagccgtttgaaactttccactaccataggcttttagtagaagttcatctttcttggtgttatgttcatctttagaaagttaactccaccagaggatgggtttgtatttgttttgataactaccataatctcaacacctaaaaaactatcttgcatatagtatgctctcaagatatattatagaatgaataaatgaatatctggtaaagcatttttcagattctcaaataaaaattcaaattgaaaaaatcctgaagtgtcttaaattcttttcaatataaatgtaaggaaaaacaatatttgatattttaagtacttccatactcaattgaatatgagaaaaagttcggcaggcataaaaacactcaaagaacttttacatatgtaagtcattaattgagaaaatcgttcttatttttcacatttttaagattctgatttttacatgtgaactgaaattattatttcaatgttatgtgttcacatggttatgatgattataatgaggatggtggagaaggagaaggagaagaactggtaaaatatcaggggagtcaatgcatagaataagcattatcaaatcaatagattaaatatatttgattaagaataaatggccatttccttgtttttttgaccttatgtctcaaaatacagagtttcaaagtgttgtctaaaagtctatcactgcactgagtcattatgggcagcctaacaatgtgacatttatctacaatgaaggatgatttggcctatatagaacaattattctttgatcaacagattgtagtggaaggaaccctagaccaagaataagacaatccacattcctaggactcacagataattacaagctgcttcattttggaaacctgttttccttaataacattctaaataaatacatatttgtacctaaatatgcataaatgatatttttctgattatatcacaggcttggtttgcagataaaataagacaagcagtagggattatatgtatagtaaatcatatcacaagtataaagtattatagaaataattaaggtaagctagctaaacagaacttattataataagttacaggataactgaatatttattaaacaacaattatttatagaacattcatgcttctgaggacaagtaatttcgtaaaaacaataatggaaataggaggtgcatgagaactcagtctactaagttttgatctaataggtggagaggtgaggagagataagctaaggtgagtgaatatcagtgaccactcttctctcttaatatctcatctaagaagaaagtaaaatgagttccagagtgactacaaagggcttgatttggctcaactctgaaaaaagatagactctgggtaattggaaaggacaacagagaacactccaggaagcagagcgatgggtaataggttttctctaaaaaaattcttacctggcttatttatgcaagttctttaatgagattacatgcaagagtcacaggagattcaggaggagaagctacagggttcattgcttaaaggaactgatgcctattttgtgacttacttagaccttccaaaagcctttcaaaatactgaacacctagaatgatttaaaaattgaactagtatgataatattgcctctgttttctcctgttagagaactagctcagagaactggaaaaaagaggagagagatgagtttgaggactggtacaataaaaaagaatactaggagctagaagggtagatggcaatagcacttttaaactgagaccttaaaactgttaaccacatgtgttgagactgttttcaggagaacacaaacaaacaaacaaaaacaaaagcatgttcaaagaaatgaaaagaaagtgtgagttactggaattgaaagaaggtcagtacagctgtatgaaaagctaggcagagagtaccttaaaatgaaactggaaagtggcaaaggcccaagttatagagggcctttaaggacattgaataattttaagcaggaaattgatatgattagatctgtgttttgcttttttttaaaataaattatctggagctgtgaaataaatcaacaagaaaacaatgctcctaggatgatgagttataatgttagaaacttcaccctgatgcctaaagggacattaaggtaagcagccacaggaaaaaggaacccagactgatcacaacaagacagtttaagcctgtcttataatcatttcttttatttatcatcttgccagatatttatgaagtgcttattatatgctaggaacgccttcctggacataggaaggtgactaaaatctgatctttgttcttcatgaaacttagagcctctgcccaagagataaagacagagttgtgtcctttatgaatatggcctagttgtttttttttttaaatgtaacttatccatgataaaacctgtttacttgattaagtctcaaatacattgctacaaaaacaatagctgtcacctatttgatggaaaatgttttagttcatttgttctaatgccccatttggcaaaacaagaactttcttaagttagtgtcttctgctgttgcaaacacccaaacctcacctcccctttttaatgttaccagatatttggaagtgcttgtctttgttcacaagaataactgaaaaagagagtatagtcaatcagcaggagcctcaaattcaatagaactaacagctttaagtatatttcctactgatgatagatctgttatttcattttataggacagcattatgtcactgttattatcatcattattgtaacaataaaatgaatttgctataaatctacatataagtaatatgcctggagaagccttttctgcactttgattatagggtactttattaccatgtttattgaaaactagtgtaatgatactttccaactaaaattttccgactctttcatctttaagcagatttaagaatcaaatgtgcttatgaaaagatttttcttcatccttttgaaacaatgtcttattaaaaacttaaaaaatccttttggtagtatatcctattttcttttataaaaataagaccataagccttgggtccatctaaatttaagcattttgttgattctctaaattgaaaaatagaatgtgaaaaatagacaatgtgaataaatttctccaaaaattttaagattggaaaagttctgggaccctcaaatttcagacatttttagctagatgtataagaaatatttaaaacaaatacagtaatcaatagcacatactgtgatatacacaaaagagctcaaactaaattgccagaatttaacctaatggattttgattatcagtcttattatgattcattttactactgcatttgaaaatgataataaacagaaaggttataagcactgtatattctaaaagaagaaagtgcacttgactttcaggaatggacctaagactgcagcttctgacataagtctctaaagaggcctcagagagtcatgacaatttatcggttatctttcttgaggtttatttccttgaggatttctgctttattgccagtaaaacagcagatagtaatttcctggtaagtttaatttttgagattggattattttatatttttccttttttccagaactcatctagacacctcagctgagttgcggtactcagtgggatccctagtggacagccagtctgattacagaacaactaaagtaataagaagaccaaggagaggccgcatgggtgtgcgaagagatgagccaaaggttaatcttttaacttcaactcttctctagttttatttaaatacatagtttcatttttgatagaattttaacactgagataattagaaaatgctagcatttttattaatttgaaacacagagtatgacatttttaaaaaaactataagtaacataaagcccctactatgggcccaaagttgaataagcatttcccatgtatttattcatataacattatgaagtgggtactacttgtatactaagttcagacataaaaacactgaggctcagaaaagctaaatgttcaacattgcacaggtagcaaagtaatggagtcaaaacttgggcctatgtttgtgtagtttccagtactattagtagtgtaatattaactattatgctacattgccaaacatgtagtcttttgattttcttgggcacttgagcaatggcattcatgttgttcattcaaattaacttaattaaaattggtattttaaaaacactttgaagaaaatgtacatagactattccttgtgttcataaagaactattaatgataaggggcagtgctagccttccattcagtcagtaacttaatttaaaatttgcaagctgtttgttgaataatgtagttgtattttacagagaagtaaaatagtcctttggtgcctaagcatagtttattctttcaaccacttttattcaccccaaatactatataatccatttgtccatatttgtacacaggcccttgatgacttttgggtttgaactggcaccagtatgccatgtattaattaatccatcatagtaggcattcaatatctgttgaatacatgaataaataaatgagcaaatgaagactaaattaagttaatctcaattcttttctcattattatgtgacaaattaattagtgctacttgataccaaaacaaattgtaacacaaatactaattctggttctcaattcttaactcaatgctcagggaagtatcatgtggtcttccatagaaatcattttatatgatcacaaaaataaaaaccaattttttaagaagcagaataaaagagatctaggatctgtcttttatgctcagcctcctcatacattcagataacagcttgaaaaacactggtcaattgcttacttcaaatggaagatttcttgtatccatttaaaaaacataaccatgtaaattagcatgccttgggcttaaaaattacaggtataccttgttttactgtgctttgctttattgtatttcacaagcattatgtttgtttgtttgtcagttttttacaaattgaaggttcctgataaccttgcctcaagcaagtctatggatgctagtttttcaatgcatgtgctcatttcctatatctgtctcatattttggcaattttcacaatatttctttttttttatttttttgagacagggtattattctgtcacccaggctggagtgcagtggcacgatcatggctcattgcagccttgaattcctgagctcaagcaatcctcccatctcagcctcccaagtagctgggaccacaagcgggcaccactatgcccagctaatttttgtattttttgtagtgatgggatttcaccatcttgcccaggttgatctcaaactcctgtgctcaagtgatctgcccacctcagcctcccaaagtgctgggattataagcgtgaaccactgcacctaccagttctcgaaatatttcaaacttttattattattattatatctgttatggtgatctgtgaacagtgatctttgatgtcactattgtaatcatttgggtacaccatgaaccatgccaatataagatagtgaagttaatctatatgttgtgtgtgcttctgctccaacagccatttcccactgctttccctttctttgggcctttgtattccccaagacacaacaatattgaaagtagatcaattaataaccctacaatagccttaagtgttcaagtgaaagtaagagttgcacatctctcactaagtcaaaagctagcaacaattaaagttagtgagaaagacatgtcaaaagctgagttaagccaaaagctaggcctctggcatcaaacagccaagttgtgactacaaaggaaaagttcctgaaggaaaataagaaacaacacgcaagtaagaaaacaaaacagccttactgctgctatggagaacgttttagtggtctacgtaaatttgatcatttagtgataaacaatcaaagcatggacaacattcccttaaaccaaagcataacccagagcaagaccataactctcctcatttatatgaagactgagagaggtgaggaagctgcagaagaaaactttgaagctagcagagggttgttcagttcataaagtttaaggaaggaagccatcttcacaacataaaagtgcaaggtgaagcaacaagggctgatggagaagctgttaaaagttattcagaagatctagctacgataattcatgaggatgactacactaaacgatgggttttcaatgtagatgaaaccaccttccattggaagaagatgccagctaggactttcatatatagagaagaaaagtaaatgactggcttcaaagactcagaggacaggggtgaatgaatgcagctagtgactgtaagctgaagccaatgctcattcactatgctgaaaatcctagggtcttcaagaattctgctaaatctactctacctgtgctctatgaatgcaacaacaaagcctagatgacagcacatttgtttacagcatggtttactgaatattttaaacacagatttgagacttactgctcagaaaaaaatactcctttcaaaatattactacttattaacaatgcacctggccacccaagagctctgacagagatgctcaaagagattgtttttttcgtgcctgctaacacaacattcattctgtagcccgtggataaagcagtaattttggctttcaagtattataacttaagaaatacatttcacagggctataactgccataggtagtgactcctctgatggattggggcaaagccaattgaaaacattctggaaacgattcatcattctaggcgccattaagaacatttatgactcatgggagaaggtcaaaacatcaaccttgatcaggttcaatggctcacacctgtaatcccagcactttgagaggctgaggcaggtgatcacctgaagtcaggagctcgagaccagcctggccaacatggtgaaatctcatctctactaaaagtacaaaaattagctgggtgtggttgtgcacctctgcattcctagctactctgaaggctgaggcatgagaatagcttgagctcgggtggcagaggttgcagtgagccgagatcaagccgctgccctccagcctgggcaacagagcaagactccctctcaaaaaaaaaaaatcaaccttaataagagttaagaagacattgattttaaccctcatggatgactttgaagggctcaatacttctgtggaggaaataactgcaaatgtggtgaaaataacaagagaactagaattagaagtagagcctgaaaacgaaaccaaattgctgcaatctcatgataaaacttgaacagatgaggatttactttttatgaatgaacagaaagtggtttcttgagatggaatctactcccagtgaagatggtaactactcttggtgaacattgttaaaatgacaacaaaggatataaaatattagattacacagttgataagacagtttcagggtgtgagaggattgattccgattttgaaagaagttctactctgggttaaatgctatcaaactgcattccatgctacagagaaatctttcatgaaagaaagagtcaatcaatgtggcaaatttcattgttgtcttatgtttaaaaattgtcacagccacccaaccttcagtaaccattacccttatcagtcagcagccatcagcatcaaggcaagaccttccaccagcaaaaagattaaaactcactgaaggctcagatgatcattagcattttttagctataaagtatttttaatgaaggtatgttcattttttagacacagtgcaattatacacttaatagacttcagtagagaatgggcataactttcatattcattgggaaaccaataaatttgtgtgactctaatgtcatattcactttatcagggtgggctggaactaaccctgaaatctctgtggagtatacctgtacatcattttgcaatattttaaataatattttgttagaatcgatgtaaataaatgttgggaagagaattcctgtgtaatttcttatgtgataatatttgtggtctgagcttataataagaaaatataggaagactaattagtttaagtcgtgagtgcttgagtacaaataaatagattgttatatttggaaataaggaaaagtattacaaatacatgctttaaagtaattgttaccttggaatatgattgaactataaaacatatagaagtttatcatctttatttctactaaaatcttgatatttatactgacaatccctcacattacttaagatgtcaaggaactattttatggaagcaaataaattaaaatgttaataattggttcagtttttgcaaggtcagttgtaaaagcatgcctgttgttgttgctgtctttgagattaatgctttgaaaatgagcaatatgataaatattctgcattttttcattcaccattcaggtgaaatctcttggggatcacgagtggaatagaactcaacagattggagtactaagcagccacccttttgaaagtgacactgaaatgtctgatattgatgatgatgacagagaaacaatttttagctcaatggatcttctctctccaagtggtcattccgatgcccagacgctagccatgatgcttcaggaacaattggatgccatcaacaaagaaatcaggtaacttcaattagtactgatgatttcaagaaattagaagaccttgatactgtactaaaaatgtaattactagatcagaagcattagcattaactgggagcttaatagatctgcagaatctcagacctcaccccgtacacactgaatcagaatgtgtattttcagaagattcccaggatattgtatatctcctttataatattaggacagcctttgtaaggaacatacatgaaacatataagattaatgacatcagtgacagtacagaagaataagttaaaggcaaaactttctccagtgaattttaaagcactttttaaattaaaatttactacttaaagggaaagtgtgtgtggtaatcacgtacattcttcagatacattacatactgcaataaaggtaccaaatagtatgcaaattaatgtgcattcagattccttaaaatatttcaacattggagtgaaattaatttaccattctttttgtcaattttatgccatttatatcagggacagcgtgtttcttggaagtttattaacattaacagttttagaggctggaaggtccaagatgaaggtatcagcagggttcagtttttggtaaaggctctcttcctggctccagggaaagggaaagtgaggcaggcagtgggaggcagaaagacagtggggggagagagagagatagaacattaatatattaattctatagaattaagcctctctctctctctctctctctgtctgccccccactgcccacccacctttcccttttcctggagccaggaacagagagcctttaccaaaaacagaatcctgctggaaccttgatcttgaacttgtcagaagagcaaattaatttcactccaatttttaaatacttttaagggatctgagagcctttactaaagaaagatttatggaagacctcatgtaacctcaattacctcctccagatcctattttcaaatacagtcactttggcctttacagcttcggcctatgaattgaaggtgggagataaaattcagttcatagcaaagcaaatgcagaaagcaggatagagtcctcttctctgcctggaacacttgagaaaaaataaaagttaatgcctttaaatgggataaaccaaacatattactactattcttaataataaaaattacatttctgtattaacatattgcatgaaaattcagatttttttttatttaaatagggtctcacactgctacccaggctagtgtgccataactcagatctggctcactgcagcccacaacctcccagtctcaagcaattctcccacctcagccttccaagtagctgggactataggcatgtgccaccatgcctgtcttttttttttttttttttttaattttttgtagagacatagtctcccttgcccagggtggtcttgaactcctgggctctaatgatcctcctgccttggcctcccaaaatactgaaattacaagtgtgagctaccacacccagcctcagattgttaatcttagtgcttgtggctgtttaattgtgttcactggtgcctaaaacttgcgtttgaagttgggctgctaccatatcttaaactgagacacaattcttatagagttttttatgattaatattcttacatcagtgaaaatacatttttcacatattaatgctgaagtttataacaaatcaggctgatcattaaaaatcccctagcattttggggacatatgtgcgaacattttctaagtaaatggggaccaaattcatttgcattctttaaatataaaaggcttactatatctgtgagacataatttaatattatagcctaacaaatatctttattatattttcatttcaaaggcaataaaacatatggtgatatgaactatttcatactagttatgaaaaaaatgtactgttgctatatagtaccctaataatagatggttttcattacaattgaaattggacaaattaacatttcaaatattgagaaatgttggcactctgatacttttattttaatttaatatatggtttcttgaattccaatgacatcagctttttctgtcatttccttgactaaccccagtgatgaacccaattgtgtcaggtagatttgtgttcttctgaatatcaacaaaccattcttaacttgttttttcaatgggtgaacaggttttaagtcttttgaacaatgcctttcttttttctttctgggtctagctaaatcagttggcttccttctactattattcaaattacctatcatcaccctactgcactttagaatagttttttaccttatgacaataaccattactatctggtttctttgtagtatgctagttctccatataccaacctaactacagccagagaagacttttaaacacacaaatgtgtttatgtaatccccctttttctaaccattcaattgttcttaggataccaaccacactttttaatatggtctacaatacctcacctgtctcaccattctctaaccatttaccttgcctactttctagttccttgatgttccatgctctttcttttgttgtgtcatccctttcttctggaacattcctgtcattccacacccttctaccctaacatttcactcatgttacccttactcaccatggacagctcctccatcacttcttcaaggaacgtagtactgtccttcagttctttaccttcactagattgtaacttttatacaggagcaagaaatgtatctggctttgctcacctttatttgcaggtcttagcacttcgcttgatatttagagagtgcttcataaatatttgattactctaaatagaaaaataatgtaaaacaagtattaacggaataacggaataacactttctgaggctgttcagctaatggtcgaatttaccaaattaagtttgaaatcaagtctatattcttgtgatatttatttgcaccaaagagatcaacacaccctccataacaagctatttctcttcagtgactcttagctttgtaacattagggtagtaatttctagtaacaatcttggccagtaggttaatatagttgtttatttgtaagattttaaaaatacatgaaatgagattatatcacatttaaaagaaatagtcatcttgattcaaaccaggtgaactgctaataacaaccagaatttttctgtgattaagatttttcttctttcataaactaatctagccattaaaaaatgcatgttttctgtcttcacagctcgctgattcaaattacttcaaactcatttgccacagcaatgttcattcatctgtgcttttatagttagctactattgtctgttaaattaaacttcaatatactctcttacccaacttgttcctctaggtttggctgtcttgtacaatttatagaatacctaaagttaataaccaaaatttctgtgtacagcataaccatgttacatctcaccagaaaaaaatttctaggagtcatttttctactaagtattttaaaagtacaaaatgtcttcttttttttacatttttattttttgagggtgaagatagttttttctttcaaatgtgtgttaagctatgttactatgtactatgttacttgattaaacctttctttggagttctgaccttggggtgaagttaaaaaatgcattcatgaaaataaactttgagagtaacagaattcatgttctttttctaagtgaaagattataattaagtgtaaatgtgcctcataatgttttaaccaaaatgaacctttgtgaaacatatttgattagattttaagtccatactttgtaagatttttaaacagcctattaaaatcacaaagatcacttattccaatgacatgtaagtagactaccaaagtactttctgcctggccagcaaacacatactacttaaaaactgaaagatttgcagaatagttagtgaagacaccagcagtgagttaataatcaaagagctggtgaacatataaaaacaggtgagtaaatgtagctcaacttcccatagtaaacgtacaccagagaagtatttcctattgaataaatttagcgaataaatttagcaaataaattacattctccattctaaatatgtaaaaagaaaactttgaagtgatcataaacttgaaggtacaggttctatataagaggggatcccaataaaccatttgtaatcaagaacaaaatagctcaggagaattttacgacccccttatcaaactatactggtacacagtttcattataacaacatacaaaatgtgtatagatttaattcaggattcaaataggatttttacacaacctagctaaagctctttcctatttgtgcctttgtaataaataatttatataattttttttctcactctgccacccaggctggagtgcagtggcgctatctcggctcactgcaaactctgcctcccgggttcaagcgattctcctgcttcagcctcccgagtagctgggattacaggcatgcaccaccatgcctggctgatttttgtatttttagtagagacggggtttcaccatattggccaggctggtctcgaactcctgacctcatgatccacccatctcggcctcccaaagtgctgggattacaggcgtgagccaccactcctggcctagttttatttgcaagttactttttcattatttatgtattcatcatctatctatataactatattttcacattattaccttttctggtacttatttaaaggaggcttggctaagtattaatattaagaaaagactcagggttttatttggctaattatgaatgaccatttactgaggatactatcatttaaactttttcattaggtaggaggtaagattcaatgactttgaatcttaagagggatatttacatgtaattataatctttcactttttctaagctattgctagtcctttgccatctcaaggctgagtttctaaagtctcttttagtggttcctgaggtcaaatgtaagattaggattaatggtagaaattaattaggttcaagatttttaaatagttttagcaggtggtagtatacaaagaaggtaaaactggaagttgtcaggaaaaaatgtatcatttgaaaacaattttctaaactgcagccaggaagtccctggaatttactgcaagttacactatttagagaaaaaaaaaagatgaaaaaattagatttgatgtaaaatgttcaagaatagtttctactgatttattatgtgaattccaatgatccttacagcagcatataatggatccatattaaattatatatggatcataattaaactgtatctttcaggctaattcaggaagaaaaagaatctacagagttgcgtgctgaagaaattgaaaatagagtggctagtgtgagcctcgaaggcctgaatttggcaagggtccacccaggtacctccattactgcctctgttacagcttcatcgctggccagttcatctccccccagtggacactcaactccaaagctcacccctcgaagccctgccagggaaatggatcggatgggagtcatgacactggtatggtgatgtgtccagagaacctttgcctcctgttaagattaatgatgctttagctaaaacttaactgggtgtttgttctagtctaagtactttctgtgtattttattgtttatttattttcttattcacaacatccctatgtgatcagtacatttatgaatcccattatgagatgaagaaatggtaacccacacaggtgctgtaactttctaagggtcaaatagtaagtcaatggtagagcagagatctaaatagcacattataaatgtcaatgaatttctgggcatagtggctcacagctataatcctagcgcttttggaggctgaggcaggaggattacctagaggcaaggatttcaagactagcctaagaaacatagcaagaccgcatctcaaaaaaaaagaaaagaaaaagagaaaaagaaaaaaattagctgggtgtggtggtggtctgtacctgtagtcactgctacttaggatactgaggcagcaggattccttgagcctaggaatttgagactgcagtgagctatcatggcaacactgcactccagcctgggcaacagagtgagattccttcttgaaaaaaataaaataaaataatttttttttaaaaattgaatgacttaaaccattaagtacatttttattgatggcatacggaggaaatcactttggactctgtgtgtgtgtgtttttaacataataagtaacaaaacttagtattataattgcttcaatacaccaagatagagttttataacttttcaatatataacataaatttcttgcattatttgtgttaagagccataaaaaacaacagctactaattcctaattttgttttagattttatattcacattttcacatgtatacattaattccttatttcatttatctttatatttgggattagaagatggaagcctaaattaggaagtctcctgaatgcaactgagaaaaagtcaaatttccccattctaaaaaattttattataaaaatatattaatatgtaatatatgtatttcattataaaatatatttcattatatatatttatatataataaaacctctggaaaatatgattgtgatgactgctgaataccatgatgttagtcatttaattctcgtggcaaaactggaggtagtagggcattatctcaacagagagtggaggttttgagagtataaatggagtgcccatattcaacacagctaataaatggagctggatttttccacaaatttgcctaatttaaaagcatgtactaccatgtctttctgtttcagtcattacctagaaatatagtatgttgaaatgacaccaatgatgaagattaaaacattctgaactgtttatggaggtaaaattatgtttttgtagtgaatatgcattggcatacttacaattttgaggcttccaagccataaaacttatgtaaaagaaaaattgtgaattttttttaaaaagaagacagttacctctttaagctgctgagtccactattttctgctcatttccaaaacttcctactaaaaatgttttttaaatagaatagacaatggccaaccagaaaaaatgcccagctaatcagaactgattccacttggatacagtacaaacttttagccaatgtgctgagatatactaaccaaacatacggaactacattgtgatctgcttattttagaaatttaggaaccattcatctgattttgttagttaaaagtgttattgtctcttgcttagtttctgcctatataagatatgctacatagtattaatgagcaacttagtaccaaacctatagtaagaatcctggaccacagaataaaatttagtcagcattcaaggcaggaatactttgattatttttgtattgcttttatttctgacatttttacaacacagttttacacttttaagtctttttataaacataagcatcataactcttgatagtgctattactttcatagcaataaaatatttataatcctttagatgtgattgtgtgtgtgtgtgagagacagagagagagagaaagatgccagtgctttcatgaattctcttgaacaattagtaataaataaatcagtggaatatgaatattattacattataattagagtactgaaaaaaaaggcatttttagaagagtaaagaaatatttaaagtgtttaatatctaagtcagagaagcaagaaatgaaatccaggaagtccttaacacctaatataattctgtcatcaattgtatatttttaataaaatatgggtaattttttttaacctgaagaaaatgcttttggcatttgtgggaaagagaaagattttaggatgccaaaaattttgagatcccacaggaacagcacatctgcccaaaggaggcccaaagctctgcatagatggggcaaaaacaagaatttataaactccttgtatatgcattggatcttcactcccaataatattttcttgaaaagatgcagtctcgtttatttctagctagctcactcttctagctagactcactcactcattccacagtttctctttcccagggtccatgcctcgtatccagtgcctgtacacatggccccattatggaaacaatcatctgacttatgttacctgagaagttccctctctaaatttaactaccaggcggagtgcttttatagtaattaaaatatgtttatttagaaaataacaaaatgaagaaaaaaatgatagtcaagttgtagacactatttaaaattgtaacttggtcaaatgattgttaattcttaattaattgtgttttatgtttttattactgccaatcacagccaagtgatctgaggaaacatcggagaaaggtacagtaaataacttttacatcattacgaattgaatactgttttattctatgaaagctttaaaataatattccctctagtcgaatgttgataaaacattaaaaagttgagagtatttaaagtgtattgaattgtttaaatttgattataatagaaaatacttcaaagataaaattgtttatgatttctggagcaataattagattataagaaccataatatcctgttttccattgaatatttaaaccaaggatggtgtaattttatattttaatataagtatttatatttattaatataatatagtacaaatgttttaatatttaatatataataaataatgctcgttgttttcaaatattttattattattattttgatagggtgaggacaacagattgggagaaagctgtcaaaaaaagatagcttgttactcacagttcccaagaggagagagtactctgtgcctcaggacagcaccagcgtcagtcaggaggcagaaggagcagggcagaaggttttctgaggtatcttagggaaaggcaagacaaggcaggataagcaggttaggatggatagcctgattaattttgtctggcctcaggatgtagggactctctctagttgtctcagcctggcccacaggtgattagggcagaggaatattgcctcttggagagtaagagccagatggagaagatgatttagagtatgggctgtgagttgtttggtttgcatgtgaaaggtgtacttataggtgagtgatgtgctatttccaggaattaactatccctagggttagaggagcatcctctccagatgccagagcatcaagactatgcaaaataaaaaaatatgttcgaaacaccgcttttctgtttggaatgaaatcaagagaataaatatggaatatggaaaacaaaatgaactgaagttctgattcacaaaatgacatcttattagataattgagtagagctttcactcatgggacatcagatgaaaaagatttcaaagattcaaacttctattcagtgcaaaaatctattcctcagcatcttcgagatgtggtagtcagcttacacccaaacattggaacactcctggaaccagataacttttatgtcctttttttaaaaaaaataaaggaatctatattattcttacatggcttgaatagatggaattaccattttattttcctgggctattatctatctacctatagcctcttctccttaacactaccagttcattcttatttaccaaatttaccaagtataatgtccttattttctttgacctccatcaccttaaaaagactatataagtttaatggctgtaagaaatagaaaggtaggatggaaggttctatacgaaaatgtagtctcaaataattcaggaagtaacaacataatttgtgagaaaagtcatggaaagagggaccacaaccaaaaaaatcttgtgtatcggggaacgagttaaataaatgatggtatttacacttcaaaagactacattaagaaaagtgttgtatcacttccattttattgatgaggaaatgtaatattagagcaggtaagtaatcagcctatttattcaacatttaagaaaaatcagaattcaaatccctctctaattccaaaactctaagtgatattcagaggaaagttttgtacatgatttattattattattattattattattattattatactttaagttttagggtacatgtgcacaatgtgccggttagttacatatgtatacatgtgccatgctgtttttagaagctgttattgggaataagtatagtttggctggcagggaggacaaagagggtattttataagatgtttcagaagcaaaattctgacagcaaaaatggccatgcttagcagaaacaatcagagaagagtcatggtgggatcacagaactgtgaaaacactaacatgtattaggaatagttcagaaacacgcttaagagtttagctgggttgtgggtttaaaaaggttttccacagcatcagaatcaatccgaaagcagttattgaaaaaagattctcctgatggcaatatgctagttgaatagagcaaaggaattatataaaaatgcctacctacctaagctgttaaaaggaacctaagattgggtgacaaaagtcctgacaatttcatgaagttcctcaaagttacaaggtctttattatagataaacacatttataaataacagctttacataaaaacaaacaaaatatttccctagaactttaaaaatttttgtttagccatactaagaacttttttcatcagaactctaaagccataagtctttagctgtgttttctacaatcctgatctctccatattgtgatacacaacgatgccatgaaaaatatgcagcattgttgtaaaaactatgtctctacaattaacttgacattggaaaaaattttaagttacagctctatatcttcatctctgacaaaatggatagtatcctgagtcattctggattctgtactaaagtgttctttaaggaaatccctcccatctcatcttcttttggttttctgtatgtctttgccagttttcccatcatggtagtaaaatggaacaatttgaaaacattactatcttaccttttattattctctttaaaaagagatttttttcttacaaaccacaactcatattttaaataccctgtaataaatttcattaggctgactgatttaaaacactttatctgataaagttatattttatcaacttctcatttcaaaaatccctacttaaaagatgtctttattatgatagcctgagtatgtataatgctatatgttagtgaattgttcaaatgtgtgtttaatacctttttgtaaagagtttatattctgatgttataaaatatcatagatcaatgtcaataaacactatagatcaatagtcagcaactagttgatttatggcagcagtgtctaatcttttggcttccctgggctacattagaagaagaattgtcttgggccacacataaactactctaacactaatgatagctaatgaactttaaaaaaaaggtccgtgcataaatcgttttaagacagtttacgaattcgtgttgggctgcattcaaagccgtcttgggctatatgtttccagcaggctgtgggttggaaaagcttgatctatggtgtttattaatcaaacatttttgtgtagtgggtctatgatttttttttaattttaatgtgtccaatttaaatatttgtgaaaatcaaactctttaatgggaatttatgtatgtaagacttaaatgccccaagttttgttgttttattttgtattaaaattactcgacagccttgttctcatgattctccatttgtgtcaatttcaactgaaatttagaaagggtttatttgaatgtattgtttttgcttctagattgcagttgtggaagaagatggtcgagaggacaaagcaacaattaaatgtgaaacttctcctcctcctacccctagagccctcagaatgactcacactctcccttcttcctaccacaatgatgctcgaaggtaagactctgcaggcacactgcacactgaatgccctccttccaaaaatattcctcttccttcgttgttgtcgaatagactgcttaacaatttacattatttgagccagaattctccagcttccctttcccagtatcacttgtgaaataaccaaatttcaattttgatatcaaatttgtatttttaaagttaactgtatctttgtggtcttattattggtcaatatagataagaataactcttctattttttagtggatattttctattacaatgagatcaggctagaggaaggacttactagaaatattaacaaaaaactaaggagactgtaggacaagatcataaatttggattgcagtataagcgtaattaaagtctgaaaagtatatgattgtgccttttagcagacaggtatgtgcatcctgtgggtactgctgctgccagcagtaataactcctcagtcagaaagttattagaaaataaaaaaatccttggctaaaatattaaataaaaagataagtctagatggagaaatatgtcatttgtcatcacaattctttatactgtcttatccatatgcataaagcactgcaaacagatctctataatcactgatgatatgaatatacctaagcatgtagtttatatctgaaatatatcttctcttattgtctcatcaattgcagcatctgtagacacataattaatataaccaaatataatgacttaaggatgaatgcttcaataaaaatatctatcttctagatattatgttttacaataaatgcttttaaaagtagggctttctgtgttggcagtcatttcttttttccaactattttttgttgttaatgtggaaaaatcagttacttcagcttcaaaatattacttctttcactctccaaaaaagagtatatttcaacatataaaaagctattgcttgaaggttagggaatgtgagttcaaattaattcacatgagtaagtaaaagtaagtaatttatcatggtgttataaaattaacaactatagaaactaataacaatgtctattgatcccatcctattaatacggtgtcaaatatattgaccataaattgaaacttaaccaactgcttgaaaagcatttcagtttaacatgtatttaaaataatatttgagtactctaattaggaaaacacatacattgatcacgaggatacatggtttgttgcttccaaattgcacccagatgattttaaattaactgaatttggctccaaaactgagaaagggaacgatggctagaggaaaatcaagtaaaactgtagattagaagagcagcttcaatttcacaatagttatatttcagttccttgctgtaggtcattatgtttaagattagaaaaacagactctgagaaataaatagacaatggatcaagtgctccataatagaaggccatttatcatgcagttaataactcagcctatattcactgattagtttgagattataccaaaaaagtaaagaaaaaaagacattcggagcaaaaatgaatttatcttatggaaatttggagtttcagggcccaaaggctgaaaaaaaaaactgcatttaatatcttaaaaggaaacatgggaaaataggggaaaaaacaacattacaagtctgcttgttcctcctttggtgcattttataaaggaaatgacttttgtgtaccttgtggatgttgcatgtattttcctcttttgtgttttgcagtagtttatctgtctctcttgagccagaaagcctcgggcttggtagtgccaacagcagccaagactctcttcacaaagcccccaagaagaaaggaatcaagtcttcaataggacgtttgtttggtaaaaaagaaaaagctcgacttgggcagctccgtaagtatgcatgtgttaagactttccactgccactcattttagtcatgtcacagtatccatctatctttcatttcatttcattgctcttcttttcatttcttctcttttctacctgacaaaatttatattttgattagctttaaatgttcaatttagctgaataatgcttaatacaacttagtgaaagggtattgtgaacttttcagtcattttatttctctctttataacaatagctagaatttatttaatgctaactcttgtgacaggcacagttgcctacaaagtaaatgctagtggtataaaccttattttattaatgagtaaataatgtcttcataaatcgcataactgtgatattcatcgtggtgccaatgtttcaaaatcagcttaaaaccattgagtatactgccacttaaagcatgaatgtgtataaaagcttagctatgtagatttaaaggtttttttgttgaaagaattgataagcctacaaaaaattaaaaagaatttttaaaaagttagaataaagctttataatatgttacataaaatgtaaagaacatgatttttttttgcttaaaactatcatagcttccccctaataaactctatggtgtatagttgaggaatggatgtggggaaaagaatagggcaatagatattgtgttataattagttattgtcagtgactaatagaataaaaatgtagatcagtacatttgaaatggtactacttaaatatgtatttagaaataagcagatatatacatacatgatacatacttacataattgtcagaagaatctgtgatatttctgaaatgattatatatatccttcacttatggggggttgtctttctatatattaatttttagagttatattattgggaaagaattaaactcctacctacagtggtaagtgctgaatggaatgatccaaatttcttagtacatcctttggtttctcaaatagagtaataattatttgcaaggaatacccaactccaggacttagttttctgccctaccatcaaaagaatttctgattgcgatattcatgtttgcagatttatgactacagtatccaaaaatgcctttcctggcttccatagtgtgaaacccacagaaagcatcggaagctacaggaaactgatgtgtggccagtgtgtgattatatgttctccagcaaaggaattaaatctttttgtattcctctttctcagtagaggaactctttaggctatacataatattattgcatgaggaaaaaagagagacacagattattttgtgtttaaaatatacatgccagacattattttaaaatttgttttatcttatttgacaactagtggttgaccaaatgatctgtcatatccaatatattacagtgtcagtcactatagtgtgagtggttatttttgagtattaattttgctaacatcatagtcatatttatttatatttcaacatatatattcatcttagttgccataattgacactttacttttaaaatatatttaattgcccttatcacttaaaattttatatttttatttcatatttaactttgatgagaaattcctaaatcattagaaattttgccaacaatattctgtcaaaatcaaggtatgcaagatataagttaaagtctagaaaagtatagaacctttgagaaacttagcctttattactcattttcactgactgtgtgttttaggtcagagcagataagaattaactcaattactattatattctcatcaaccccaccaaagtcagaaactagcaaaagttaattcaggtcacagtttatacctgggaaagtttctgagctctgagtaatattgctttatttcatagaacagcagaggtagagtgtaaacaaagccagaatcagcagcttgttaaggactgcaatatggatgaggaagacaggagcaaaatgctatacctatgaaactaggtagaagctacataaatggtgaatcaaagcttccaggaaaaagaacaaagtctttactgaaaatgagacttgaagaaataaaaataaaacataggtctaaacaggttccagaaaaccatatttgcaccaaaggaaatgatacatgggccccactgatactttagttaagggctaccagttttaggtctgctttggtcctagaaggggtatccaagttgtcatggaaagaccatgcacatttttccaacccagggactacaacctagtactgcttattcatgcatctgaggaacctagggaaaaatctcgagtgattatgattttaatgtcttgatctggaaaattctaaaacccaggagcattgccagtgttctttcttctaccagtaaaaatagaactagaaaatagaatagtatgccagggaaagaactacgggaaagagatagtgatgtcaaagtaccaaatttgaaattctgaaccatgtgctaagatttataactcttaaaaggtttaactcaaaagagcagagacacatgacttaagttgaaagcagctatactacatgtctataaagaaatatggtgtggaaagggaaagctgtataaatgaaactatgaaaatgtttccttggttctatcagaaatgatgaacagcaaaggagatgtttgtagtaattcacaaagggaaatatttggaaaggatatcttgtttgctttatataatacttcgaaatgctagggtaataacataaacttcagataggaaggatcagtcgatgtgattgtatggataactcctacccatgaagaatcaaactcaatatgtgcaacaatatgtctgttcttactaatgtattactagcatagacaatatcagtatggaaaccccaaaactcaaaggaagcactgtattgaaaagcaattgaataaacctaacagaaaccaaccaaaattattttattttaaaattttcttatgacatccttttcaaatggttagttcactcaaattacaaaagtaggatagaaaaagctgtggtactaataggagatttcaagtttttatatatcttttgaaaaaattattctgttcttactagggtttacagttcttatttagattattattacctataatgtaggagcaagatttcccaactgaaatgtgtatcagtgtatgggcagaaaataaataggagtgatgtagactcaaatgaatcagtgagggtttgttcttccatgtaaagaattcaaattccatttgtaagtactattcaggaaaaataaagcataatttaagccaagtttacctgaaggccacaattgaatttagggaaacccacctaacagaggaagcattccttctagcttactcggggatctggttttagagtcatttctatttctttgtatttttgttcattgtctttttgttgttgttgttgttgttgttgttgttgttgtttttagacagaatttcactctgtcacccaggctggagtgcagtggcacaatctcggctcactgcaacctccgcctcccagttcaaatgattctcctgcctcaacctccctagtagctgggattacaggcacccaccaccatgcctggctaatttttgtatttacagtagagatggggtttcaccatgttggccaggctggtctcttaactcctgacctcaggtgatctgcccgccttggcatcccaaagtgctgggattacaagcatgagccactgtgcctggccatttattgtctttcaatgtcacaaatcccaggatgaaaaattaaataaacaggtttggtttgtatccccatgacaacaggaccgatatgtacttctgctgacttcctggaacatagattcaggatgtaatagcatcctgttaagacttgacagcacaatgaccatgatctctccccacccctcaatttatgcatccatatgcaatgcatctctgatattttcattattgctcaaatatgctcatgtctaattcacacttttaaaagctatcacttgatcttgccattatctccaaatattgacttatctttaccctgcatttaatgtacaagactgagttgttcactacttttttctttcctcatctgtcaatcactttacgacctaccacagcatcaattccaaacacactgctactgaaacgctagaaataggtgcagtcttaactaacatggaaaggtagttaggacaccaaaggctgtgtactgtcaaagcaattccagaggatggtaacacacaattatatttatgatgatgtggattaaggaagaagcaatgtatctgaaatgggagttttctgcctaaaacagacatgaaatgatttgttacaaaaattggaaagtgagaatatgacaaataatagatagaagcaagtggcatcgacatgtaaaagcagtggcaggaatgccatccatcaaaacagacagacaattggaaaaatcaccaagaccaaagtgagaattatagaatctatattgttacttttgtttagtaatgtataaatttagagaaaatgaatgaaatgaagatttatctgatgtgaatagaatatgcaaataagtggaaccattcaaaaactcatttttgtttctatctgtttacttgaagagaaagagttcaaccagaatataggcattaccaagagggcatttatgacccagagttgaggagatttatttttttttttttttggtggagggagagaagacatagataatccaaaataatttatttattcctactttcagtgaatagacatatattgaaccactcttaaatgcagagtaccaattatggactttaggaaaatgactaagacatggctatcggcatcgaggagttttcactttagcaaagatagtacgtaaacaaatacaaactttatacttaaaactaaaacttcactatatttttggcccagaaaagttttatctgctacattgtctgtcctgtcagaactaggaacagtggctatgaaccctaagatctgtgatcatgcataaataattgcagtcctgactagcttgacttttaattttatctgaaggcattaatctattttgaaacaaagtaaattaacctatgttaaaaatagccatgtcagactaatgtcctttgtttgtttggcaactttacttagtaacagataatgaaaggtggtgagcaagccatcactcatgacatccctggggacaagatgtcaaaatggggcctgagtgctggaacagttaggtgggatttataactggttaaataatccttgcccactgatgagtggagtaacgtcacctgggatcaaagtttctcgtggcatgattaggactcactctgttcttgatcagcacatccaaaatcacttggatatgaatgtttccacagctcaggtatctgattgatggattactaataaggggaggaatcctaagtgaaaagattagtattacccctaaatgctatcccccccaccaaaaatagaaagaatggatgtaagtgggatctaaattctcctactctaaaagtatagttcttggaagcaagtttttaaagaaaaaaaataaaaaattcatgtgactctaaagtcaatattgattaataagtttaggccacattaacagacataagagttgatatgaaagttttttctactctactctgctatgataaaagaacagccaagcaatggaatccatcctggttactgtacttttaaaggcacatcatcaacctggaggaaggttggaggagaaaattaggcacctgtagaggattggaatcacgttcggagaacataagtgaatggtgtgtttattccctttgctgaactaccaagtagctgatcacaacatttgaagagttgttctgtataagagctattgtccttttcattgtaagtaaggatacgaaactagaaccaaagtattaaagttgtacaaaattattcttcatctcgatgtaagaaagaacagtggggtgtcagaattctatacaaaatgggctggcttatgaggtagtgagttatttgtcacttggaaattgccgagcaaaagctaggcaaatactaggaagagctgttgtggaggggatccaagcattggaaagctgattggactggatgatctttaagatctacttcaaccctaggaatactgaatctatgaatctctaacatttaagtcttttctctggcaactcttctttatacaactaaaacaccataaaatatttactatgaaaataaatttctgcttttaagattacagacttctagagctgtatgcctaaagattctagaagatatgtgaggatcatgtagttgtccacattctatacatatcgaaactgagatgatttcagaagacagagcagctacttagtaagagagttgatagtgaatcctggctcctacttcctggtctgatgatccggaaaggaaactcttgggattatttcaatcaaaaaatacttcattgagttcctatccctgtggaacaagtgtgggcacataaagaaattaaaaatacgattattcaagaagtatataacatcttgaggatatcccatataaatgaataaataataactcaaggcaacaataaaaaatcacacagaaacattataatttttctaatacaagatacagacataatgtttggagagagttctgggttaatctttctctccctgtatatgtttgattctactaggatcatctaagtgcaatcttcctacgtatttgaaaaggtgtaaaggtagagtttcaaacgggacctatctttgagaaaagggtattgaaactatgttaaacagcaagctccagagagaatgtcatggaaatggcgttttctgtggttaaataggaagtgggtactggctgggtcagaagtgtgatgccagcttatgaagcaaaggaagtgattagcaccaaagatcaagttacccagccacagacagattggaactgcagagattgggaggcagcatcttgaagcagagccaaccacagaaataagatgatctgagttccagggtcaagcatccaagcagaagtgagagttaaggattagagcaaacgagctctgttttccagaggcagtttgtcagcttagaaaaatgatgatagtgtatggagaagagacagaaatatttaaacatttactatttctagggaaattaactgctccataccatcttaacatactgatttgtttgccacctgagaaacaccaactcttttgagtcttcacagagctctactaataattacaatgaagaaacaagaacacatctgaccaacttagctgatgtcaatagtgaatggttaggataaagaagaggctactgacaggcatagcaaaagatgaaacaaatctaagacaaagagatattcaagacaagggagtgatcaaatagagccaaaacaacaaagctatgaaaaaaataatgaaaacagaaaagcacgttaactatgaataagcagaattcccaattgcatgtataaaaatgcatatattattaggttagggccactttagcaagtttcctttaaatgcgtatgaaaagcaatatacacatttaaagagctttttttgcctctaaatggcaattcttttatggttatctgccagtttgtattataattgtctgaactcattgacctactataataggcttaataaaaaaataatttcacagtgacaaaaacacagcttcagcagtacaccagcatcatttcacaagtacagtcgtgcattgtttaatgataaggatacattctaaaaattgcatcccttaggggattttgttgcacaaacctaaataatataacctactacctacccaggctgtatggaatagccacctacacacctagactataggtatagcctgttgctataaaaaatccacaatatgtgactgtactgaacactgtaggcaatcgtaacacaatggttaagtatttgtgtacctaaacataaaaggtatagtgaaaatatgctattatagttttatgggaacactgtcataaatgcagcccatcattaacagaaaggtctttatgtggcgcatgactgtatttttctacctctaaaatttgggtgtctgtgtcggcctttacgccaaaacttagattgttccttggtgctaaggaaccaatagttacaatgtaaattccacaaagtgtccattagaaatgactcatgctctgcatagtgaaagggtctttctttaaataaagtagtatttagctccaattatgactgtatttgttacataccctttatgagccaggcactgtgtatagatacagtctccggatagctaacagactaacagatgttgaacaattaagtaacaatttataaattcaaatgtgttttaatacaaaccatgtgctatttattaatgatgaagacagttctactgaaagaaagatgaagccaccaatcatcagcagattgtagtagttagagatctctttttcacacaatgacagagacctctgctggacaaatggaaggacagaggccttgcaatatgggtttgtcaagcaatttctacagacttgtatctcaagggccaatatgaaataagtgattttgaatgaaatttaaggactgggaaatggggagatatttgtctttgttgacctaaataccaaatagagatgctctctaaaagaaaagatgtttatttaggaatagagcattgtgataagaatatgtatgtcatagtaaactataaactatgtgtatactcagggaaggaaaggaagacaaagatttttaaaggcaaaaaattaagaacattacataattttttgaaataattatctttggctactcaaattaataacaagcgtgccaccagtcagaggttggacaggcaattgccagacagatatacctataaaaatattttttggcatgggattgcaatggccttcgtgcaaggttgtggctttcgtagggtcttttgttgttgttgttgttgctatcgtgcgtaggagcatgagaatcctctgttcatggccttccctggctctacttgccaggattttcttaacaatagtgactccattttgattctaacaacttccacaccttcacaatccaaatgaatagatacctccaactagttccatccacagatctaggcatgtgagtttccttcctgtgccctgagccctgagccttcgcaagccctacattttgtagcaacttccttgaaaaattttaagactccctctgatgtctgggaaagttcagggctggcagtgccatctgggcaaggcacccccagctgagacccggacccggggtctaatcactggaagcatcgaaatgttctcagttaccgttcagacactgggaccagaagggaagtagtgccatctggacatgttgcccgatccagccaaacagcaggagcctgggtccctgtttctccccttcagggttttctttgacactctacgccacgcatgcactcgaccagatgccccagggagcctagtgagtcgcatctatggagtcatcctgagacagtggtctgaccctgttttcaagagggtggtctggcaattggatccctcgctcccactggcaagaatggtattgtatgagattgaatcagtagatcgttgtcccactgattttttggtggttcaaaactgtttacacaggaagaggggctggcaaaaaaaaatccttgactgtgcctgtcacaccttaggagtggtcttgccctcaataattccaagtcctcgaaggcctcacaaaagtaaagatgcctgagtgatagccaagaaaactttgagggcaagaaggctgccttgctcatgcccaaccactaggcggaccctgacaaggtgataaacaatttattatgtaagtagtctgctgaatcatgggactcaaaccttcaagcccaagcacttcaggccatgaaaggggtggagttcattgtgttctttccacatagtttcctaatagacctcctgaagaatgagtaacccctagtttccacaggccagtgtttctcctctgaggcactcatcattttgagaatgacaagctaggccaggcatggtggctcacatctgtaatcccagtgctttgggaggccaaagtcaaaggatcccttgaggccagcagttgaagacctgcctaagcaacatagcaagacctcatctctacaaaaaatagaaaaactagccgggcatagtggcacacatctatagtcccagctacttgggaggaggatgggttgagttcaggagtttgaggctgcagtgagctctgatggcaccactgcactccagtctgagagagactgagaccctgtttaaaaaaaaaaaaaaaagaaagaaagaaaaaaagaaaaaagaaacaagctgcagtttctctatttaatgaaggatgtttagaatccttgtcccctgtccaatatgtgccaatcattataatacccaaaaaaatgcaccctccctcaacatacacaaacatttacattccctctgtggatgtactgtatccaggtagaaactctggtatatagtgctggccaacattgatacaatataagccacaaatgtgaaccacatatgtaattttaaattttctggtagctacattaagaaaagttaaaagagataggtgggattaattttaatcctatattttatttaacctgatatagaaacaataatctcattttaacacatgatcacttaaaatttatgaattacatgtatttttctaccacgttttcaaaacctggtgtgtattttacacttacaatacatcatctgaattaggcacatttcaagagcttaatagtcacatgtagggagtgaataaaatattggtatagataaatagatatttctgaagttcacatagccatatgagcccactgatgcctagacaagaatgagacagactctcactggatttagataatcatccatagagtaaaataattagtaagctggtttggctaaggtcacccttaccagctagtttatcaagtatgtggaaagataaacattagatgagtgaagcagctaggtcaattctgtgaaaaaatgtcctccctcagaagtgttttaattgggctgaaaatatgcacttgctgggacttttctcctggttaagcgcactggcctgaatgtgttgcttaaaaatagctttacttacaatggccttacgtcccatttgtacttggcatttttgagtaggatgtagttccagttatctatcaaatgctttgaaaaaagatactagattttgcaatactccgagtatttctaagttcttcatgctttttattttatagttatgagaaaataaaatgtctagatttaactcacaaaatattcctagatttttctttgcttttatttcaagttttattatttaaaaatgtgatttttttctattaaaattttgggtatatgaataaatttaaatcataatttaaatgttcttatattgctcagaagaataaaagcctgattcatctagccacctggtggttgaaaatctttccttgtttattgaatatgtctgcctcatcaatctctatgtccctatatggaccattcaagaattttataacttttaagtgactcattcattttcatttacatttcaagaaaacatttttattattatttgaagactatgaataataatttattgatatacagtaaggcaaatatacagatgagagaaataaaatgaaaatatgcactcactgtacataatggaaaatttcccatttgaaaatgtttctttcccaagagtactttagtcaccagtagaaggctttcctaatccataccaagaagaaaaatctttcataataaaaaaagatttaagtacccgtattcattaaacatgtgaataataactaaaacaaattttggccctcaaactccacatctctgaattagatctatacagcaataaatgtgtttttaattaaaggagacttttaaaaaattatatagttcagtaaaaaggttatcaggaatgagattaatttatttatatcaatgttcccaagttaatattatccagtattataaattatttggtaaaataaagtattaaaaacagtaacatcaaaatttgcttttggcaccttggtaagatattttactttgctaaagagaaaccatatcttggtcgagtcctgcaaatgttaagtaaggaagtgtccactacaatgagagaagagcaaaagttgtcttcaatagttatttactgatatagtgatgaaatttcttgcatagtctttgtgagagtttatattagcttaaatctttctacctaatcttgaccttaactggagtttaattttcttttattaaaaaaagtatataccttaactcatttaaaaatagtgagcattttcatttagctcgacttcagaacataggagtaagtccttatttttcaattacaacagataatttatgaattaattttgtaagtttagaaatcctgtgatatgtgtttaatgtacatcatacttttctttcttcttccttttattacaaagttatataaggtatacatattatatattgacactaaatgagaacttatgacctacttggtgataactatttttatcaagctcttttgaagaaatttagaattttttcaaaaaatattatgaagtttaaaaaacaacacaagaacctgcccagaacacatcgagttctggaagtaagatttatagtgaaggacataggagtcagccagtagagcagaacaaatttccaggagcagtctatgaagagctcttagaagtcagcaaatgtttctccattctctcaacttgtaatagaaaacatatacttgagttcctacccaattggctatcatttatcccattatatgtgaaatattgcaaatacttaacgtgttgaaaaaataaacaaatctcacacgctgcatagatatttgctcttattttccataagaaaagtataaaaacagactttaagacttggggacagtatatttaagtgtcttgtcagtgaacaggccacatttattatgttgccactgggtgcaacaaattatatccccataggtactgctttgttttgttttcattttctcagtgtatgtttatgtatgtacccatgccattttatgcatcttgggttagtaatataaggaaaatttttaaatgtgatactaaacagttgctcaactaaacctttaacaacctgacttcagaattgacacaacctatgcaacataatctgaatacttagttacttctcttcacaggaggctttatggagactgaagctgcagctcaggagtccctggggttaggcaaactcggaactcaagctgagaaggatcgaagactaaagaaaaagtaggtttggggatttttccctctttttctaacttttatcaattccttattattatttatagggaattaaaaagagagtggttggaaacaaaagaactatattgaagccaatattttccagatactacctaaaacactcagggcttatgtttcctggttataatgagctactgtttaaaagagtataaaaatatttggcctgtagttgaaataagcagtttcttcaacgtaaccatccatagatttgtttcaaaatccttacaagtaatgcaatgctattgatgttcaaaattaaaacctgattggtttgataaaatgagattataccatctagctttgttttctctcatggcaattataagtatctactctttgaaatggagtaaaggagaaacatttctctgactgattgaatataaacttattttagactcagagcagattgttttgcatctgtcaggaaattgatagtgtatcttttcattcatatataatataggacatttaaatgacttgcaaaattggccaattttgagttgcagcagctgttggaaagcaagtagttcccaaaataacattttaaaaatacatagtaacattttcattgacaaaatggcacctttaggacatgttctttaaatgtaaatcaatttctctttattccagaatctattggttgattatttcttttccttcttctcaaatattccttacattgtgtttttggttttcacattttccttctttcctatgaaagaatattcactgctctcatcatcatttggtaacagataggctcttaggattataatatacaggctaatcaattgacttcatattttgctttctcacttgctttgtaaatgtttactaataatagggaagtatatacttacaagttgcagaacaactcactaacctaattgtttattagtttgctagttactaaaaattatgtacatatatcccaattcagtaggaatattgtccagaaaaaaatgactttgagaacataattatttctaccatacaatcaaatgctcagccataatcaataatatatatttattctttagttactgatcactcaaaaatatatttaaatattatcataatctttttcaaatgtcttcgttttgtttagtcctaccaattaatgatatactctatttcgtgactatttattgagaaaaacattcttctaaaaaatactttcctttgttaagatttttaaatgttcgcagttgatttccagtctaaaaatatataaatgatcaaaacccagcctgactaatggactcagtttatttcccttgaaagttaattctcatttctcccagacaaatatttgacaaagaatggcaatctgaacagctttcacaattgcatataagtctgatattgaggcagtgcattgcatacttcattagttgttgatggagccaactgaaatatctttttaaatagctactaaagttaaacatttcaattatacagtgatttaaaataacatatttaaagtttagctatcattaaccttatacactattgggttgatttgataataattttatagactcgtttctcaactactaagtaccctcacagtcagaaaaaaatactaattcttcccttaaatatgttaccatgcttgactttgggttttattttgcaacatgtattggcaaaatgtaactgtaagatgtgttatgtagaatacttgcttttaatattaagaagaatattaagaacattctataaggcaaaaatggctaacatttcttagtacgattatttcccatggattaatggtatttaggttcaaatggatttaacaaggcaagtcagagttaattaatgaaagcacaaaagtatttcccttattattgattatcccatagcaatagccctgtgagcataaacatgcaatcagtgttcaaaggacttatatgaataattgttaacacctattcggaatttgcatgccactgtggcttgatttctggattaccagagagtaagttgtcttcatataatgagttttattagagatagacaatttacttttaaattacatggtttcaaattttatttctattgaattttacattgttaattattaatattattaaatgttgacagcctattcttggatttttccaagtgtttaaaatttcatttaaacaattccaattttctttctttttaaagaaaccgtatcctctttcagtgcactttaatgagttacactcttttctgggttccgatttcatgtttgctagtcttctatcaggatgaaaaataattttaagtaaattttatttaaaaataaataaaaacaataaatgaagcaacatttttcataatgttgagcactacagatcgtacgtacacagttgcaacctgtgctatcctatcagttgtttctaaattctatccattggactggcaaaatggtgtttccaagacttagtacttaacagagctatgctcactatcccataattcatagcagagattcattagtctttgtgaggatagccagaactagacaatatcttattttcaaatttgctaggatagcagctatttagaattgacagtctgtaactttaaatttaattgggagaaatctctagaggagttaattatggtacattttttaaaaagccatatgggggagttactttcagagagcagcatttaagacattccaaatttttgcaaagttcagaaatttgtaacttggcagtcctaaacaaaggtttaatttgaggcacacttaccatccagtaaatttaacacacataggttacaacaacttacaagatttgttttcctactttaatcctactttttctttgttttctgatccaggcattagttttgcttatatttctctctattgtcttattatgagaaataggaaatcaacaatattgaatctgctaaaccacccactagtcatgaaaatcttgtcttgtccatctttaccttcctgataattattaaacagttgctgttgttgtttcatcagagtaacacgtaacctcggcctaaagtcaatctattgttgctctgcctagtttgcctttactatgcctcatctttgctgtacttttctttaaagcatcaattccataaatttctccagcaggtttatgtagagtatagttaacctataataattgtgtcaaactaaaactcagcttgtaattctttgaatgcttcacagtaattttattggttttcccttttaaaatttgagcagtttctctgtaggctcctgacatttaaggggtgagtcacttattctcaatatttagtttcagtattaatattataattcttcatagtttattcaatgcggacttcatctggggatgccatgactctctgagatcttatccatcactctctgttggatttctttgaactccaggcacctcttcttatttaacaaaaatatcttctcttttactattacgtttagaacaaccagacctgaaaatttcactctttttcttttatacctttcgccctcatatttaagaacgtatttcccattcttagctttccagcctatgttttaacctaaaagcttcgaagttcaggatagccgattaaagccaaccacacaggccagtaatggtgactcatgcctgtaatccgagcacttggggaggctgaggtgggagaactgctcaagcctaggcatttgagacccagcctgggcagcagagtgagaccctgtttttacaaaaaataaaaatacattagacagacatgatggcatgtgcatgtagcctagctactcctaaggctgagacaggaggattgcttgagcctatgaattcggggttacagtgagctacaattacactgtatggaatgatagatggtcccttcagatttaaaacctacatgggcctgccccccaaaattcctgtgtttctgaataaggttcaactcaccaaattgtacttagagactatatttgagtattttagggcacaataaatagaaactctcttctttgcctaagttcagaatttatttgttgactaacaaaatagtcaattagaaatcaaactgtcagccatatttccagtaaagctggtagagcatggcttaggtaaatagtggggaaaaaaaaagcataactggaagctccaaatagttaaatctacctgacacagaaagatttggttagtcacagactttcaagttgcacaggtataagccccccataatattaaaaataacatttatggtattataatttgataaatttgttactttagaatcaagaactatgagcttacaagggaattaataaaatttaatgtcatcaacattcttgcttaagcaagttttgaatcatcagtgttaattatatttttattatatatctcattaaatttcttacttttctcccctggaatatatttagttgtcagtttcacatgtcagcatctctagaaatgtgatgatagggcaagtggcaaattccttaagtcattagagacctgaaaatatgtgtcacacctaacatcagttgataattgcctgaaacatataactattggttaaaaataatttgtcctcagacctttgaagttatggctcttcttgcttctagttatggctaatgatcaattgattgccattcttttgtatataacatgtaggatttctttttcctctctctctctctctctgttttatttatttatttttgctttatctttggtgttcagaaatgccgtaagtaggtgtctattcaaatgttttgtttcatttttctaccttattctttcaaactgaagacttgttatgctggactatctgacaactgttactctagaggactcacatttctacactcaattttcattccaagaaccttagtcttatagaaacttctgggattaaagatgaggatgtctgtttcaacagtaattcacctctctaattctcaagaccatcctgaataggcagtgaacatattaaaattgatagaatatccattgaattgttatttatctccagcaatataaatgatgaaatatttagcttaattctttatctgctaatgttttctcttgcctcgtaacattatataatttttttagtaaagcatatatccatgctgaaatcttctctattttgtaacttaagttgaaagatatcatacgaatgttaatatactaatttatcattttcaatctttagttacaataaagataatatattattatatgttagacttttctatgtattctgaatggttaacactgctaaaggaaaatagatttcatatgtgaacaaatttttcaatatcattaaaatgaaattaacaccccgactcagctatcagcagcatcctctctcgagaagcagtttatccttggagcaaagcagtcacacttaattactaccaataaatctttatgttagaatatcacagacataaaagttaagctctatagatttacttaatttattcccatcacaatcctgagggtctccttcagtgtgtaatctttaatgtgttttgagactgcacttttaatctttggcatttggcaggttcagagtgtacatatctgtaagcaaaataaatgatatggaaaatatttatatgtgaaggtatcacagaaactccacaatattctttcatttaatacatattcgttaagtgcctatatgccaaattaaacttttaaatgaactgtattccagaacttaatttataagatgtgttagaagctctgagtacattttcccatctgagtattctatatacacagaaagtaaaagtctgtgcttcccccacaaaaatttgttttgtaggcatgcagtaggaactgtctctgggtagataaagcaaaaagaaggattcacttgcatgatattagattatctcacagattacagaaacaacagagccaggatatctcacagattacagaaacaatagagccaagatattcccaaaactttgacaataagagatcatgagagattttcccagtcttgtcacaaacacatatattctccttcatcccattccaaaaatgaagtccttagatgaaatccttttatggcctagtttggaacagatatttgtgcttggatcagtttgtttattttagtcgagggtttatttagtacagacacaattactgcaggaaaattcctcggcaactaattcaatgaatataataatatacaacattttagaacctaaaaccaatgctttcaaaatttctctggaaaaatatgtcccagtttcctacttggaactccagaagcctgtcttctctgttttcactaaaatagagctgctgttgctttgccatgtgatcatgtatagccctacctaccttcaaccaaagacaattataagaattccctgaacgtaaataataataatatcccaaggataagggtcagaatgcactgaaatttgttagtaaaaagaaagctaaggaaaaccaaagtgttctcttttagatatatttagatatatttgatctatttagaggaaggaaaacagcacaaaaggaatagagttgctgttttgagccagcagttcaatgttaatatattaacaaagtgagtagaacagaagccctgtgctggctccataatttctgccaggagaaacatttttgatctggaaagagtaaaataaaaattagtatatgaaaaattaaaatcaagatagttacatataatagaagataatgtcattttctaaataaattcttatttatcttaattgatgtaaatcctggattaatattaatagaacatgaaaatgataatttttcattcttttgctcagtatgtcccaagaaatgttttaaattactgatatttgaattaggtagttctgttcttcaaagagcttgtagagagatggacatgaaaactaattattgcatttaagtatttcagggttcatgatcactttttaaatctttgtggagaatgagaaaagtgccgaaaactcaaaggcaccctaatgttcttatttacaagacattctcccagctaaagacaaataaccaaaggggcttcacaaatgaattgatgatgactaagtgaaacagaaggtggcataacccagcactttcacacatgatttaaataagaacatcagatttgtcaaagtgtgaagctagaaggcatagctcagtttttagataaagaatatacttaaggatgatttttacagaggcatccaaatctgacaagatgaaattttatagaggaatttttataatactgcagccagctttaggactatacttactgatttcctctatataggggaacatatataatttacctgtagctcctaagaaaaaactttctacaaggtaggcaaatgagcaatgcctgacaaataatttaatgtttttcaatatccgtaatagcagtaacagggtcaaaattcgatgcatttaccagattgtagctgggtattgtgttcatttctgggaaagttacttaaagtggattaaaaccagcatatgttcagaggaacatgaccatactagtgagatgacacaaagccatgtcctcaaagactggtagaaataggaatatgtggtatatacagaacaaagatatagatgctgccaacagaatgaacaaccaaacgtgttctttatggccttgtgataagaccttaggccagaagtcaggggttagtacagataaattgagctgactgtaggagaattattagcaatcacagaggtaggaagaaagaattgaccactttgaaagggaattgttcaccataattatgtctaatattgacctgacaggcatatgtacatagtaggattattgcatcgaggattcaacttttggctgagagtttgaactacctgctttttaaattgtccctgccctgagattctgtgatcctctgtaaaattcagaagagaactgaacagaggagaatctttgaatttttaacatatagatgctggcatattgtaagtatttaaaatacatttctcaaataattgaatgtataaacagaagctggataaggaaagaactctaggataaagaagaaaacctgagaaaatgtaataggagttagggcagtgatttctacccaggtgaccaaacctgaaacctgggtttcttctttgcttctgctcttccttgtcctaattcttcctctacacacgtccatgtactattaccaaatgtagtcaattgcattttttaaaaaaaatctctcaaatctgttgattttcttctttccagctcaagccatcatactacaatagtctttctgcttctagtcttgccttcctataatccgttagtcacgcttaagctaaacagacctatctaaatcttattttttagctgcctaaaacccctcaatcactccctaacaaccctaggattaatttcaaatggctttatgtagtccataaatccctacattatctgctccctgtgtatctcaccagctttatctctctgcttcccatcttgcacttcatggtcttgatatacctaatatctatttgttttgttcctgattactcttacctccttgtgtgcatatattctgcttcatttttttcctcatcctttgcatgctaatgacattatctattttatatgtaatatgtacataataatcacattgattagttgtaatgtgctaggcaatgcactgttctatgcattttacatgtgttatctctaatatttttcacaaagcctttaatgtaaaaactgctattttcttttatgcatcaagaaatatagctttccaggcactgtgttatacaaaaatgtagatctccagagcccagttttccttggaattatttagtatctaagaatagggctgtgatttaaagaatatgtagtccaatctcaactgcacttagaatatcctatataacttttaatgttaatggtctatatagggagtgaatgaagaattccccagtctctttatactctggaaagggtagcatatttttttcctctagagaataattagtttcttatctgcccctaccctatccttaaaaatgagcaacaaatgtattcaaaccagtcatgcttttaaagagtggggatggggaggatttcaaaacacgagatgtagctgttttataaaattgactttttctgatataattagccacacataatgttccaatgtttgatataagatataataatgtgaatgttccctaataaataaaccatgtaaggaatttaaatgtgtgcttgaatcaatctaaattattcattccagtaaaacttacaagagagtgtctaatagcaagaataattatggctttttaaataaaaaaatcaaattaaagtatatttaaatataatgctgacatcttaatctagaattttccacatctgttcctgttaatataaaatctcatataagctttgtatagtattttttataagatctttggagatttagtttcttcccatagttatttcaaatgagccattcatgaagtaaatgtatctgtctccacacttctaagaagggcagtaattacgtatagtctctctcttgccggggttttacagacaaaaaattcaatacaaaaagacttcatacatatatatgtgtgtgtgtgtgtattaagtatattttcgtagacacacacacaaacataaaattaaatatctttggttcagattctccataattgaaattttaatttgaggcttaactgtattaggtttgctaggcagatgattaacaaaattcttagagcaataaagatttcttaaactcctttaagtagtctcaaatattttagttatttgaagtcaatattaacttaaagaaaagttatatttaatgtgatgaggaaccacatttaaacttctgaaccatttctttcatttgtaagaatcactagaaacatgcttaaatatttatctttaaaggccccatcatctgtctttaagtaggaattttaagcagttcttgatgtcaccctcgtatgctctgatatccacatagatcacccattcaaaaactaaccttttgattttacaactttattgcttccattgttgttcattaccccaagtcagacactcttcatggtcctattctgaatcttgtcatcaccacaaatcatgcttctttcaaacttaccaattcaagcatctcatttcttgctaatcacagtcttcccacctttgatcttgctttatgaactttttcttctatcatctttatttaacctctatccttttccagtgcattatcacctttctgttttcccctctctcctggtttagcttagatcacgtccataatttcaacaccctcaaaatttgttaaatttcttcactccactttcatttggtcacatctacatataacaaccacacccaatgatgaattttctttctccatgtgtacattttggcacatctgtgctgttggagaaaattacagcagagaaattagaaatagtttcattgtgaaattcagcattacctagtaatcccaagagttttctttcattagtgttgttctactctctgcaactcttgttagaaacctccactctcctcaaacttgaatcttctgctgatgagtttacattctagcttagagagacagagagacagagagagaaaccatccaagtgccctgaattgcttgatgccaaatatacactaacacttgccccatctgtcttattgtagaaaactaggctattcttttactcagatcatccctttccattttcttagtcattttgtgcggaattctcccttgctttcaacttctgctcctgtctttttttttcccccatcagcatttaaacattctcaactttcacctattaaaaaaaatatttatttattttacttttccatttcagttaccagccattaactactcaatttgatgttaataactaatttaaaaatatgtctgaatcaccaacttgaactttacaaagcaagagtcaattatattccaaatataaaactcatttaatgaattgtttcttatttgaagttttcaatccagaattgactagtttataacagaagaaggttcattcaattgtaggagatctggaagatcaaggtgaggaaactgaaaagttgaaggctctcattttgaaatataagacatatgtttgctggtcatttcttcttctcctgactgaatatatgctgatgttggcaaggaaaacataatgtcaataattggatctgatctcattcattagatggtaacataacctatttttttatgttaattaaaacttacttgccaattactcacaatggtctttcactgaagaatatttattcttgacagaatctttcttactattaacatagccttgacacttctgacatggagagaaaaataatgaggctatatgctactataaataaatatgtgtagaaaagaatgtatcaatatttacaataagaaaaattaatcagaaaaaacttctctgcaaatatatattacctcctatatgaagtttataatatattagcacaaaatatgggtcatttataactatagatttttgtcttttgcagaacacatttgtttgaaagtcatgaggtgaaattcttaacattctaaagtgatatagctgcttgaaatagttcttaactttatttactatggaagagaagaaagctcataaaaactatgagaaatcagataatttatacgaattgataacaaaaatattagaaatttgtgcaatgctttttgagcagtatcttttaaatttgtgttttctgtttattttcatattttatcttatattttatattttaaggtatttatactgtgtaagttttctattttaaaaaatgatcaaggaacatctaataaatattaggtttcactacgtgcaaatttaatcaacttgttttatagggaagtgattcctagatagctagtaggctcagaaagattatgttgtccatggtgataactagtcccaaatgcttttggcaattttcctggaaagctcagaaattgcctattttttcagagctcatcgtagagttcacaggtatgttgacaagaaaatcattttaaaatctaaaaactatctccttttggtcttaatttcatttctgtggggtgtatgatgtgaaaaatatgataaatttcttgggacagtgtagtgccagtgtttatgaacatttctgcttttgtttatgtgaaaatctaaggagtttcccacagatgctgtggagttaaggccaaaaatatgcatttttttcaaagtgccgatttaataaaaagtacacggtttctctgaatgaatgccttgagaggaggcatgtgcagggtgttccattgcacatcaatcttttctttataataattgtgcgataaaaaagaagatgctctaacttgcctaatttctgacataggaatttctgctttctattttgttatattgaacatgttttatgagttgtagtaacaattttattttttaataattaggctattatgcttgtaatatatttttaaaacaatactctcatgaatttttgttgaattatttaacttccatattttctcaatgcctctactacatccagggagcaagtgggttcttcaaaagctatatgtgtatcaatgtcgttttagtgatgatttctggtaatattggtgaaccaatataatttatggatgtttccccaaaaacaacatttataaacacctattcaaataattaaatatttctaccactgaaagagccacaatagacacaaacttgatgtttattttgccagtcaaatagagaaggaagtaatatggccaccgaagaagaggaatagaacatttttacactttcttatgttctgattactagccatatatgtttaccaaaatagtaattattattacagcattggttggaataataacattatggatctggaatggactttacacatttctattgccagggattgtgttgaggaaattgaagatcagaatctgctaataattttgaccaaactgtgtatgagaaatagaatctagattttcagatcctcaaactaggaaggacattcttcacttcaagttgctgcccattctaatgtctgctgttcttttttcttgggccttagcagtaggcttataaagctatataaaaatctaagtgccaattaataagttattgtttctactggtaaaatagcatggaagtggcctgaggtaaagaatgtcctttaccaagatttcttgatttcctcctgggatgtactcgaggctgggaaaatgtggtcatgcatgtttcagagtggctcatactcaagacatagacttattggtcaactattagaactaccctcagcctgactatgcttttcgacgcagtgagtatgtgtgtcatgatgaaatacaaaatggcaccatgtctttctcatacctgagctttctcacatcttaaataatgctcttgttttattccatggttttctttggattgaactgtatccattaacatttgtgtgcttttcttttccatccgtccttctccatctcatgaaaagcacatctgggtaagttgaatcacaatggctgctgaacatgtttattttcagcgccatctttttttttcttttttcagagtattactcttttgagttgtaacacaagctgcactgcctctgacctgaaatgaaaatcatgaagcatatttatttccacacagtaaaaggaatcattggttcagagaaatgttcacattttaattaattatgtaagcttttgggcacttgtatttcttcagttttattatacacatgtcaaaagacattctagactccttccctctagttttcaagtaattccctaaagggtcaatgtggcaagcagccaggctcaagtcatactttgagaccactcaggtactattgattgtgctgcctgtctgaattgcctccacctttctttctttctttctttcttttttttttttttttttttgagacagagtcttgctatgttgcccaggctggagtgcagtggcgcgatctcggctcactgcaagctccgcctcccaggttcatgccattctcctgcctcagcctcccgagtagctgggactacaggcacccaccaccacgcctggctaattttttgtatttttggtagagacggggtttcaccgtgttagtcaggatggtctcgatctcctgacctcatgatccacccgcctcggcctcccaaagtgctgggactacaggcgtgagccaccacgccgggccgcctctacctttcttaatgttccacctgtgttatgttcaagagacaaacttattcatcaatgaatagaacggcacatatctgaaaagggttaaatgctgttcttccctggagagcttttacatatagagagccaagaataatccttggttttggttgaatgtgtgttgttcccattgtttcctgtactactggttgatttctaaagctttaaaaacctgaattactcagataatggcttcaaattttaaatccttttctttgagctaaaattagagtatttatctattcctaacagaaatttgacttcaaagtaaaaaagtaaaataaaatatgcataatatttacattggtgtagactactgcatttgtaacatggtgagctcattaaaacactttggactgagaagaaggtattgcttttaaatttaaagcagtgttattttttatcaataaaatgactgcaatgagatacaattatccaggaaactattaaacatattactagttggctatataaatattttgtatgccagtacaaattcttgtactttgtaatattactttattaactagtaaggtttatattatttttaatataattttaagttacagttgccattgccaaaatgacttggtgatgtattatttgcttcagttaggatgttttacaatattgaggaattaagaaaagctctagtaaggtgttcttaaaaatgcaaggcaggttttgtttagagtactcgtcaaccatgttggccaaatgaatattgtaagctctttttgaaaataacaaatattatagacattgagttttaaaacacagttttcatgtcatcatataaattgtcttctgttttctaatgatttttaatttttcagaggaaaataatttcaagaaataaaacttaattcccctgagtccttattgaattaaatattgaaaaacaatgaatgaatgatgcattcttattaatggactgtaagaaactgatataatggacttcattctacaattcggtttcttattgtcttacacatgctcctcgaacttaaacattttaggaccttaacaccatttccctagtacaattactaaaagaaagctttggataatataatatcagggaagatagtacaacatagtgaagatgacataggaagatgtgaggagcaaacaacactgaattaggaatcagaagatagagtttaaattccatcttccccacttacttgctacatggccctgagtgactgacatattctttgtacttactaatattattatctacttgtctgtaccttcagaagcatacaaactatacacttccaaactgggtaaaagagggcttaaaattagatgaaacactagagcaatctaatctaagtggtattcatataacctgaaaaattacaatattctccagtaggtccccaattactattaggaagtgactggaaagtacagactatggtgtcttgcaaaagtgaaattgtttaatggggaggaatataagcccctctcattttcaataacagcataaataattgtatgattcaatcatatttgtgtgtatgtgtgtgtgtgtcaggggggtatttatacctttttaatggctttgaaaatatttaaattcaaaatacagtaaggaaggagattacataactcgcaactcaattcccaaatacatttctttcctgagactatgccctatatttcagagaagcttgaagataaacggtttaaatatgaatgaattttagttccaatgtaatgaaattatttgaaatctaaacagcctagcatgttttactggaatctgaataaaacactacttaaatatgtcatggattttcatacattttcaccaaatgtgaaaatatgcaataataggatacacaggcacacacgcttgcacttgcacatacacaaaatcacagtatgctttgctttcaaatcaagtcaaatttaatgttgaatttgaaactcttaattttatgaagctaaatatgtatagttaggtaatcaatcttctgaagcaactgattggaatttgtaacatatttctgtttagaataattatgttaactaagatatacatgttcagcttgcagatgttaaaaaaaataattgagttggcaccatactttgcatttgctgaccagaatttcaactagcttctcaaatatgtagttttagtttttacagacttaatcaagtatggattcctgaataataagtccattctttggttgaaatttgaggaggttacatcctatttaccctcttgaaagctgaattttagtgaaacaatatacattttacaattaataatagtgtgaagtctgtgtacatttcctgctactattatgtaaggaagatttattttctgtgatgcaaaattaagtatattgcattgtcacattatttgacttatattttattcttcattcttatcaagccacatatgtatttcttctggttttatcagtaagtacttcttatgtgccatagtaaatcagtagctctgaaggtaaatttttcacccagagaattattttgtatggttattacaaaatcaattgaaatgaaatgaatggcaacaaattcaacttttctatctcattcatttaaactaggctaacttttctctggccaagatgtacaacctgatattactagggaataacaagaaaagaaaagccacagttcgtttgttcttttataatgctgaggattgaaatgtgtgacaataagaaggtaaagaccttatgtattaaccaggaagtcaaataaatgtatgccacttctaaaaacaaatgaaccataggaaaagaaagaaaagtaggggaccattattttattttacacttacaataaggaaggtgctattatcctcatttttcagttatgaaaaatttcagaaatgttaattggctaagagatggcatggaggttaagagagctgactctgtggacaggttattggggttcaaattctgattctgcacctcgacggttccatgactccaactggcctctgttcttcggtgttctcatctgcaaatgtgtgtcaatatgtatcttattggattattatgaaaattaaatgaattaatacacataaaaacacttaggatagtgcttcataggtagtaagtgataaatgcacattagttactgttttgtgtgatccaaagcctaatttgtctgcatccagaacctttgctctttcaaaccactatatttcatcttataagaatatgaactggttcagatgaacaggagagcgcattagatgtatctcaattatagcacttactgtattaaattgtaatgcaatttatttaattatatttagattacattttaaattttaagtgaaagtataataagtacaagtataatagatacaagttatggtatttgcatagaagagagagttaattctgcctgggagaggacttagaatcttaatagaaaaaaataaagcatgagttctgtctgaaggataagttaaagttgttatgatggtgatgtgaagaaggatgctcttggcagaagaaaagggcatatagcaagacatggaggggtaaaatcgaatgaggtatttgggtaatagcaaatatttgtgttagttgagcagaaaaagccagggagacagccagattgtgaagcgtctttgtgtaagatatttggcctttattttgaggacagtcagggaggcttttaaacaggtgagtcttacaaaaagatttgtgtttaggaaggtctcagtggaggttggaagggacaagttaccaaatgagagatagagagattctaggagcccatcaccatcatcatcaattgatgagggcttaaacaaaagctttggcagtattcagttagtctagaaaatgtctttctgaatgttagatataacattgtaatcttttctgcagccaacctgggtaactgtgatgcagaattcttatttctttttgagatgcaatgaacagttggaagttataaaaatatagaatactttaaaaatgccctataatcaaggatcctaggtgattgtcaacattgtgagttttttggattacaatttagcagtcattcaaaagatgttcttgactagaacatccagagaaagatgcatgatacggttgaagaacaaactcttatttccaggattttactgtcttgggttggagatgaggctgcgggcacatggtggtaaccagtgatctctatgagtgagattgacactacaggcttccagattttaaaggagaagaggataattgtagattgggctgatcacaaaatatttcatataaaagggaagccaggagttaagtaaacacaaggttgttgatagttgaaaaagtagcgatcaacttaccagctctgggaagtggtatttgcaaaggtggaattggtaatgcacaaactgtgaaagtacttttcaattctggttagaaggaaaggtaattagataattaaatcaagattaaaccaggaatctctttgtaatgaagattaaaaataatcttttagacatttgaggaaagactgaaggggctttagaggacagtgctatgattatttaaagtaaaacctggccaggcacagtggctcatgtcagtaatgccagcactttgggaagctgacgtgagcagatcacttgaggccaggagttcgagaccaccctggctaacatggtgaaaccccatctctactaaaaatacaaaaatttagccaggcatggtggcacgtgcctataatcacagctactcaggaggctgaagcaggacaatcacttgaacctggaaggcagaggttgcagtgagccgagatcaggcccctgcactgcagcctggaagacagagtaaaactctgccaaaaaaaaaaaaaaaaaaacaacgaaacaaacaaacaaacaaacaaaaaacagtaagaaagaagctcacatttattgaccattgccttttgtgtgagttacttttgtaatcatattacacatattttcttacaaaacctttgtaaaaaccctattagatgggttatcagcttcatgttccacatgaggaaactgaatcacagcaaaatacagtgacttgttatggatgtgcagcccaaaaggacaggcaaaggaatcaagctcaagcaatttgattttgggagccactttctcacccactctgccataaagtttatcttccaggcagattttttttttctttaatgtcagtgtaagaagcctggagagaaggaccaattaaaggctgagaaaaaaactgtggtagcagtgacaatagaaagtaaaggaagatacattagaaagtatgaaggggaaaatgacaggcatcaaatagaaggtgaatgaaatggccatcatgagtgacagaggggacagtgctgtatggtatttggacagtcataccacaaattggcatcccagaatagcatgctaaagtgagaggtctgtgaataaagtctcttttcactgacagagataaaccatccacagtaggaagaatgaggaggagacatactgttccctatggtctgtgacttttttgagtaactaatgaatttcatttttcagaattgcaaatataaacactaacaaattcaagttttaccattccaatatagttgccaataggatagctatttatggaaaggattgtctaataagtaattttaaatagttgagacatggctcatgcctgcaggagattatagtgtagcggaaataaggctgtgtacatacggtgaacggcctaccagagtcttgcacatgatatgagtggcatcactcaagggatagagaaaatttgaatggtatgaattgaggaaaggccattccaaatggagagaaagtcagtagaacagaagaggtaaagtgcaaagaatggtgagtatccattgtagctagagagaatagatacagtaggtaaatctggaaatgcaatttaggggcagatcaagaatgaccttaaaggccattcttccaatagtaaattaaaagccattatagaaattggagttatatagtaagctaataaatatgtttactgagttatatagtaagctaataaatgtttactttaaggaggttaatctgatggtagcacacacaatgaattgctttgggaaaataagaaaaaattggagaacggaaattagttatctattgaatacatattggctgctaggtgcttttgtaagtattatcttatttagttcttataaattgagatcaatttataatcatcttcaaatatgggaaaattaagtctcaaagagattaagtacatagccaaaaaacacatagctggtaagaagttaatttgccatgcattcattcattcagttatgatttattgaatgtatgctgtgtgcctgaatccctattccaataacctctcaccatttctgctgccacagctcaggacaaagcaaccattatcttctgcttgaaaattgaaacaaccttctaacttgtatccttagatcacaactctggcctgactcaagtccgtgctatcctcaacagccagaaatgcctttataatgtacaaattattttatgttcttgtgcttaaaccctctgatggcttcttactatgtttagaataaactcctcttcagctcccaaagcccaacatgttcttgcttttctcttgtctacgtctccaatttcatcttcctccaccaccaactcccgtgtccttcaattcactccagtcacactggcccttcttggcttttatcagttgctcaaacatttaattccactcctttaataggaattttatactatgtttctgcttaaaacattcccaccatacccctactccctgccacttttcaacgtacatgtttctactcaaatgttgcctcgttatagacatctatgttcccagaacactataagcattgcctactttactgccttagtctattttacctcctgtagaacacatatcaatggctcaacttattttgtttatgtatgtgtatatgtgtttatacaaatcttccttcctcactggaatgtatggtctttgaggtcagagattcagttggctttattctttgcttgctgcaaaacttggcatatagtaggtctatacaaatcagatgactgaccccctaatcaactcagacacagagcgtacaaagtctctgctgtcaagcccatggagtcaggggtcacaacttgtgaaccaacaaattcaatgaaacataaaagatactatagagaaaattgcttagtactatggggcctatgtatgaaagtggtagataatgcctccagggcaagagaaggatggatatagaaaggaagcatttttgttgaatcatgaaaatcaagacaaagtatgtggggagataaggcagggaggcatgtgatggcatgcaaatgcaagagatgggagccagagactctactcgtataccaattagaccacaacaacaatcgctaaggagaaacttaaaacctaagaatgaaaatccaggcatttccatctggatttagtcattcaaccagagttgcacccgcctggttaattagtctgcattaaaagttggaaatctgtagcttggccaatgcttctaatttatatacattttctagaacctattggtcttttatctagaaatttttgagtctcgtcatttcttgactgcacaccctttgtttgctcctgtcttcagttcaggcatagcaagtgcagacttccctctgcacatttagatacggacttgcaaattattcacagacctgagtgctcaccacatgttgggcctcctaaaatatcactttctagtcacagtaacttattgatatcaataataggagaacctgaggcctatggaagatactaacagcattctttattgaagagtgtttcttgaaaatgcacaatgattcagaagttgtactgtctcaaaataactgtttcttgcaattagtacttttcttgtttgtgttttgacccaagtgataacacctccatgcctgacacttcctctaaaaggaagtacagctgatgccctctaaaatctattctgaatcttaaacctgaaatgtatgccccgaaatttagtgatgtacgggtgatcctttgggaaaagatggtcaaatatttgattgactgaaattatttttaaaaacacactaaaattattcttcaggccaacagggaaagagagtaattttcatagttaaatttgtactggggtaagtgatcacattctttttctggatgaactgtcacttgacctttaaaaaaagttgaattctggctacaaagaaaatccattccagactaaatccctttacatacattgacaggttgaacggagaacagcagtatatccaaaagacttctttgtgccaaatcagtttgtcatttaggatttcttatacagttcagatcactatttttctgacagtaactccaaaacttgatgagaataagcatgcccttatgtaattagtgctacccttaataatctattagcatatcatcatgtattaaattcagttatttccaagtattatagcattgcccacattgctttatttttctagcattgcttgtctctcaaaccaacatgcctagatatatgccttttataaattttgtatggtgccgattattttataattaaaaataataatgcaaggcaatattgctttgtaaatttcaatgctgttcttttttaaataattgttacttctctcaaaaggaaaagcacatctggagttaccatcatgtagcacacagtcctggtgtaaaacctagccatccctcccatctgatccgtttttccacagtctcaagtatgtcagccctaagacagatgctagagattttgccctaactgttggaaaccaaaggatttgagctcccttatctcattttcttagactgctattactaaagtcatcctgttattagagtttgtgatttaaacaaaacaaaaaccaagaaaataaaactttttcagtggccagattgctcaataatttcccaaacaattgtgttatcaatacttctgttcatagaacagaactatttgagcacattgggttgcctcttaaccaaattctcaccaggaatcccaaatagatcagactcttgggatcagctagaatcagtactattgtgagaaagtgggaaataaaagctcaagaggaggtaagatgcaagaaaaaaatttgttctttaaaatacaaaatgttgtacatggttataaggtaaaatagaaaaagctatttggactacaaaaacaaaacattataggacacaatttactgaaacaagaagcacctaaatataaacactgattggcattttgtttaacatttacacgtatttatttagcacctcttctgtgcctgatcttgttctagacttcaaattcatctctgaacagagcatatgaaaacacagatcctccctgagcttacattttattggcagatgacagaatgaggagtaaataatatactatgttagaagggcaataccttggagaaaaataaagcaaacaatggggataagaaattccttattggagttttcagggagtaagggaggagacattcagagaacaggtgacatttgagtaaagatttaaagtagctgagagagttagccatgtagagatagaggggaagagcattccaggtgagctgccaagatcctgagacagaaaagaggtctgggttgtttccaaagaacagcaaggaggccagtgttgctgactgagatgggagtttagtcagagagatggcgcgggtacgatagattgtagcagctgttttggcttttatttccagtgagacaggaagtgattggagagttatgaacagaaaagttacatgatcagactcaaaaggatcactctggcctttctagtgggatttttattagggaactagtcagaagtttcaaaatgaaagcgttctaatatttaaaaatagcttttgtacaactcatagaatacacttctgaaaatgttacgtgctccttaggttattagtgcatatttacttgcttttttactatgtgaagcaaaaactaattgtaaatgtaaatttatttcttcccttttaatgtcacaaacctatgacataactagaagtgtcgctttccctattggatgtaacattaaaactcttacaacatgcattaactctgtgaaggcctaccctaaattttcttccacgtatttcatgttaagttccatacctccccattagtgcttctcctgcttggaatgccatccccacctctttcctacctgcccttcgaagccagctccattgccacaatgccttcacaacaccttcaatggctattaaccccttttctaaaatgacatacttcacaaggtacatcaccaagttttcacgttagcagctgtttgtgtaatgtattgtattatattgtattgtattgtattttcagacagtttcatgtgtttgttttgtccatctaacaggatatcctgggaaattagacccatatctattttccacaccaaacacaagtctcagtccacaacaggtgttcaataagtacctaataggttatttgtttttgatccttcaatccatttctatatatatatatctgtcacagtgaggctaagctatttgaaactggttttcactaaaggaatgtcactgggagacctgagggaatggaggatgatagagcaagccaggtgaagaagtgcctctacttttttagattcagagcacgagtatcgctgttccctttcccaggtgctgaatagcttacatgcagaacttaacacttctatcccctcaaatgaaacagcagttgatttatgtctcttcagccactataacttaaatttgtattttgcaccttttttaatgaatttttggttgcatctattacaaacacagaaaactctgtgttgaaaggcattttattcattatatatcttaatgtattaatatagtctaccacagtaactaattgattaatagtagaaaataatcaaattatccatttgggagttcataaatgattttcatgaaatattcctaagcataaaacatacgcattcaaaataaagcaattattataccatgtttttatcatctatgtgtaagatcaaggcatactaaagtaaagagaatgtattttccaatatattcctggccaagtatatatcaatttgaatttcagtgaaagcacatagctactatcttaacaatgagtgatctcaaattggctttgtaagtggatgtcaattctaaaaatcagtaagagggtcagtgaaattatagatgcatttttcagagttcttttgcatcttttgttatcaaaacaaccatttgttgttattaagatattttaatttcattaaaacagtagtgattatagataaaagcaagtgtaccattgaatttgataccttacattgctttcgagtgttagaaatcaatttaccttggagttttctccaagtgagatgtagttttatagtctagacaaataactaactcctaagatagatccctggacccacagggcatactaaaatcaaccacatcactagaatgtgactaaaaggaccaaatttatcttctgcctctctatataagcattttctttgccatggagatagtaaggcaaagagggcagggcagatggtggaagccacatttagatcccataatgcatacttgaatatgaacatttgggccattttctcattaaagggataagatatttgctggtaatataattccacttctaattccattagcacttaatgttctaattttcatgaataaatgttggggaaaattacttttctatgtcaatgcttcattcgtaataaaatcaatggatgatgtgtgtgtgttactcaaaggaataaggaattctgttattctatattgtatcataaaaaatcttgtaaaggatgattggttattttaaaatattatcattaaaaataatcacagccatatttttccatatacctgcctaataatctttgctatatacttcaggcatgaacttcttgaagaagctcggagaaagggattaccttttgcccagtgggatgggccaactgtggtcgcatggctagaggtaagagaatgaaactaggaggcccttgaatcaatcactactaagttgataatttttttgagacaggtaacggcaagtttctgaaatcacagcatccccttagtctggaattgctcataagggactatttgcttactagggaataaatttatgattttatgctgacacttttttgtgatcgtagtagaagaaatcatgcagtgggataaaaggaagtgtctctaaatcacacccttttcatttctagagcaagagaagaaacaaaattttattgttgcaagagaacatccattcccatccattaggccagggcccttcctcattagcaggttacagagaagaccctctccatattcaacacttctgtaatccaaggtagtaagatcacctagatgtacagagagacattcctttgcctgtaatttagttcctgaacctagttctctaaagcctatggaccagctaggtttagacacttgggattaaacagaagacttacaccttattcccttctgtgtccaaactgaatgctacaataaaagaagaactattttcagcatttcctgtacaacatagtgttctggaaaaataagggaatatctgaacagtgtaggaggcagcagaaactgaccttgacattgacggaactacatatttgactacgaagggctgtttcatgtcacttaacagtactgttcactgccccttctattcagttctctatgtgagctgctagtagctgctaggatatgcctgtgtcagggcaaagaagaatccaggctttccttgcctgccagaggtaattatacatgttgttttaaatggtcttggattataaaattatccgtcttcattttattatagccagagctaagtaaataaataataaagaaacattaaagcccattttagttttaaaaatagacttagatagatctagaaacacgctttgtattttttcttgcactgaatgaaaaatgcctgtattttgcttttactttattctttcacatcagacagggaaatttagcatattagccatcagatattagcgatcagctgcttctttcaaccgtgtctttaaaattactatatttaaaaaatcaatcacaagacaaaatgcttaagaaatcacacctcagaaatgatagcagttctttgttcagtttttgctccgataaaatgagttgcagtttgacagagagttcgctgctattttggcaagcgacgaacaaatccttcagataaaaagaaaaaagaaacagatttactgacattaaggtgataggagatgacagacagtgaagtttgtgctaattaaacctattctgagtacacagaaattgcctatgattcctaatgcaacttaaattataaaatggaataaacaagatgaatgagctgagtgatccaatgaatgaaactttaacttcatctcctttcgttcctccttgagtgcacagcctgttaagaattttgtgtaggcgagaattccatgcttcacatgccatttatccgcatcaaagactctttaaggtctaattatggatgacattggtaacaatgtattggcaggcatttgggtgatgttaactagtgtggaaatccaaatatcttagaagacaaaggtaaaaaaatcattagggtccaaagaagacatatttagatgtttagttattttgaacagtttgagtttataaactaaatagtcaagtactatcttctgtcatatataatgtacctgtcaaggtcaattatttgtgcctaacctgctggaagaaagcataatctgtacagtcacacattgtacttagatcttccccttcttttctcttatctctatcacaacccagtccacactgactcaaagagtttcgttgttggcattttttttttcaaaagagacaaatagtcttttaatattgtagaatttttcaactaaaaggatgtttatactggttagctattgctgtttacaaattacccccaaatttggcatttatgatctcatgacttctatgggtcaggagtctgggaatagctttgtgatggcctctgctcagagtctctcacagggctgcaatcaaggtatcagccagggcagcagtcatctcaaggctagacttggggagaatccacttccatgctcattcatatggtcagggtcatgattcagtttcctgctggctgttggccagaaacattagttccttgtcatatgggactctccacagggctcctgagatctgacttactccagagtgagagctcagagggaaagagacagcgggaggggactagcaggaatgaaaccacagtcattttattgcctaaactggaaagtgacatcccatcacttttatcatcagctatttattagaaataaatcactgggccaatcctacccccaaaagaaggagattatagaagggaacggatatcaggaggtagagagaaataatcaagcttgattccttcattttacaaatgaggaaaatatggctgaggtttagatgggttacatgactcaccaatgactggaaaggaattagggctcaggtcttctgatttgtggtccagagctcttggcactgtattttgctgatttatagtttttcttctttgtctcactttttctcactctcacaattctctcctttgttcaatctgtttatttcaacaaatagaaaaaaaaatcagtcaatcttttggacattcaaaaacaaatatgtaagctgctaattttttgttgtgttttctacttcttactcataactaatgatggagggaaaatgggagaatattcctgttttaagtgatgttattcaggtgctgaaatataatgcccgtgattggcattcacccagtgcttgagatgtgcacgagacctgtgctgtgtaaatagcactgctggtttaattgtctttcaagagtctcacagcaaagttgaaaaatcaaaatatctaatttcttttcttttttgagacagagtttcactttgttgcctaggctggattgcagtggcacagtctcagctcactgcaacctctgcctcccgggtttaagcaattctcgtgcctcagcctcccccgtagctggaattacaggcatctgccaccacgcctggctgatttttttgtttgtttgttttagttttagtagagacagagtttcaccatgttgcccaggctggtcttgaactcctaagctcaggcaatccagtcatctcagcctcccaaagtgctaggattacaggcgtgagccaccgcgcctggcctcattttttgttgttgttttcttttgtttcgttttgaggcagagtctcattctgtccccagcctggagtctaaaggcctgatctcagctcactgcaacctctgctgctcagtttcaagtgattctcctgcctcagcctcccgagtagctggagttataggcactcgccatcatgctcagctaatttttgtatttttagtattatgatgtttcaccaagttggccaggctggtctcgaactcctgacctcatgtgatccttccacctcggcctcccaaagtgctgagattacaggcatgagccactgtgcccagtcttaaaatctctaatttctgatgcattattaattttgttgctttctttagtttttcaatgatttgagttttaacttctttcttagcacatcatttcactctctaaaaggcattttcatatatagcatctaattaagttcacacatctttcacatggtgtaggaaggtaggtggaaatgtggcttagctacactgcatgctttgatcgaaatcacatggctggatgtggcacagctgtctcgttctgtgacagaatttctcttcactcagaattccaaagaagcattataaattgaagccactcattaagcaaacattaattgagtcccttatcaaatgtggcttgtagccgttctggtccctacatacaaaggggaacttggtgccatgcagccattacttttaccactagtaatatgaattagttaaaatagagtctctggagctagcatgtctcaatttcaaatcttgtttctatccctgcctccctggtgtttttaaatacatcatttaatttctttgtgcatctatgtcctctagggaaaataatgataacattttatctcgtggggtgaggtcatgtatgtaagatacataaaataattcctagcatatgagacactaaaatgataactattattataatttgttagtgtattttttcctatctaacagctttggttgggaatgcctgcgtggtacgtggcagcctgccgagccaacgtgaagagtggtgccatcatgtctgctttatctgacactgagatccagagagaaattggaatcagcaatccactgcatcgcttaaaacttcgattagcaatccaggagatggtttccctaacaagtccttcagctcctccaacatctcgaactgtgagtcagtttctgctcctccccttcctcagtgctaggcaaatagccgtgtgtctaagtctacagagcaaaattgtgacagcacacatttcaatgtcagcttgaattattctcaagagattaagcttgctctttattaaccttgctgctacttttaataggttttcaaatgaggaactatgattcatatcagacgtgaaagctagcatagcagacttttgagctagcatctgaagtttagatttttctcccaagcgacaagaccctgagcttactcttttttcaattccttccttccttcgttcctttgttcctccctcccttcctccctcccttccttccttctttccttccttccttccttccttccttccttccttccttccttccttcctacctaccttccttccttccttcccttcttccttccttcctttctctttccctcaggtaatttctcagaagataagatataagcattagtgattactaaagatgcaaggcttaagtgactacattttttagttttaatattttttatttttatagattcagggggtacatgtgaaagttcgttacatgggtatattatgtaatggagattttggggcttccagtgtgcccatcacccaaatagtgaacgttgtacccaatgggtaatttttcaaacctcatccctaccaacctcttcccttttggagtctccaatgtctgttatttccttctacctgtccacatgtacccattgtttagctctcacttacaagtgaggacatgttgtatttgatttttttttgtttccaagttatttcacttgggataatggtctccagttccatttatgttgctacaaaagacattagtttattcttttttatgactgcatagtattccatggtgtgtatatacattttatttatccaatcatccactgatggacacttagattcattccatgattttgctattatgattaatgttgtgataaagacatgagtgcaggaattattttgatataacaattgcttttcctttgggtaggtactaagtagcgagattacttagttgaatgctcattctatttttagttctttgagaaatctccatactgtcttccatagaggttgtattaatttacattcccaccaacagtgtataagtgttcccttttctctgtgcccttgccgacatcttttttttttcttaactttttagtaatagccattctgactgaggtgggatggtatctcacttggttttaattgcatatatctgatgattagtgatattgagcttttttatatgtttgttggacacttgtatgtgttcttttgtaactcactatttcttaagaagtttctgtaattatgaaattatgtgagtttgacgttttacagataccaaatggaatatctggaatatctttttctttcaaagtctgtttgtttttcagttataaattcctagtcatctcataattttttacctatcctaatcctagaaaagaacaaaatgtgacaaaaaaggcatgcatgacgacaaattcccaaaaactcccaaatagtatttaattatttgtttattccattcctaaattatatattttgtttataaagtatattatttctgataattactagatttcccaaatctcatatcttatatagcataataaaatatgggagaatgagataaattttagcaataggtaaaatattaaaaagtcttattactttattgcagttttcaggcagaaaagtaacaagtataacttttttatacatgatcttaaacagttgtgaatagtttgtttcatttctatttacacattttccttcccagtatactagattctaatgccagaaataaaaggtcaaatttaaaaggcttatataattcttacataactccattttaagttcttcctaaatgacatgtaggaaaaatatataatttttaaaattcttacctatattatttttaaatagacacaaatgtttttcactatacctggattatgactcaagctaaaagacaatttagaatacaatagccccttgaataagataggagttaagggtgctgaccccccacacacagtcaaaaaatcagctagaatttttggctctcccaagacttaactactaagagcctactgttgactggaagccttactgataacacaaatagttgataagcatgtattatgtgttttatatgtacacatatatgctccattcgtacaataaagtaagctagagaaaagaaaatattattaagaaaatcatagggaagagaaattatatttactattcattatgtggaagtagttcatcataaatgcctttatcctcgtcgtctttatgttgaaagtacgctgaggaggaggaaggggagagattggtcatgttgtctcaggagtggcagtggcagaagaaagtctgtgtataagtggaatgatgcagttcaaacctgtgttgttcaagagccacctgtatatttaaaataagaaactgagaagaccattaaaatagttattgtaaatttaatttaagtctgatgaagagtttgctgagtaatttccagctgagagagaagcatcataaatagtttatatccacattttcctcccaagagcaaatgcaaacaaaattattaaacattatgaatcttgcaaaaataaatttgaagtcccaacttccagatgaaaaatatgatacattttattatttttatttaccagtgtaattcatttcttaatgaacaatagggaattttaaaaccatttttctaaaactatttaaccaacctgaaggaatttaaattataccatattaattaacattcaattgtttaaagaatggggagaagtaaagaaagctttatgatctagcctcagttcacctcgaaggctttatttcccaggtcaggaactactttcagtttttcaaacatctttccttttggtcagttatgagcttttgtagttggtcttccctttgcccaaaactttcatcctacttcaaagtcatcatattttctccaattcattattcatttatcgattcctttacatatttcctctgaaaagcttttgctgagcccccaaagcctgggtttggtttccttcctgagttaccactccatgtacttataaacaacattttacagttcttcttttcttcatttatctcacactagacgaaataaagatagcatcaggtttccatcaaccccaagccttagcaatagtgcctggcaaattttagatattatgtaaatattcaccttaaaataatcattgtatagatcactctacccacatatttcatatactctgctgaagtataagaaacgtgtggccttgagatcagaaagggaaactctactaaggaaaataagcatgttgactggtagatttagtacaggattatatagattaactccaaaatgtgcaatagaagtgaagtgtgatggagcttcaagaaaggagaaatcactacaagctggataaggcttcagacaaaaatgaacatttgaaacataaaaaatatattgtttatagcatttaagttttatatgtttattgaactaatacatgatcctgtataacatttgtaaaatacagaaaaatacaaagatgacaacaaaataatttaaaaacattaaaaaatactgattttagagataatcaatgttaattttttcactattgaaaacatttgatgaagatcttgtcattcttttttcattatctttttatataaatggattatttcacataatatattaatttgtacttttttgtaaatttagtaatgtagtgtaagcattttcttcattttattaaatatgcaactgcaacatcacttttagttattgaatatgtcctttgtagaaatgtgataagttatttaatcaaattcctagtattggacattttctttgttttgtgtaacacaatttgttgttgtgtgtaaaatatgtgcttgtaattatgttgttgcataaactgtggttatttccattgctatatttgtgtatacggaatgcatattcttaatacttttaaactttaattgttaaattgtgttgtgttgctattttttctccctttgtcaacattggttatctccttgcttaatttacattttaaaaatcactactaaatgtgcaaatttttatattcttattaatctggtatttatattaattttctattcataaccttcccaacttatctttattattataggaatatatatctttttactaatgtgtaatagctctgtattcacggaatatatgtacctcttgccagatactgatgcaaattctatgagacaagttaagttgtgtctctaggctttaaaagtatctactaaatgtttcctcttccttctactcactctacatggtagcatttactcatttctaatatatttccaatacaatttgcattgcaaatgaaaattccacataaatcactattaatgaatccactacataaagtcataacctaacattatgtattagaattcacacttacaaaacacaaaggcagattttttttttttaacaaagttattctatcatgtcttcaagaacactacagtttgtttagattatacaagttattttgcacactgaggtttgggcttgggttcctcagccaggtatttcgtgtttattaactgaagttctgaggagaaaaagacaaggtacttgggcttcggggcttttttatttttaacttttatttatttatttattctactactttatttgattcagcctcctttcctgcctagatataatgggctggaccatcaaaaaggaaaatttaaatgtcacatatatgattaccttgagccagccctaaatttccagctttctgtttcttttctccaagctactattactacagaaagtctcttacctagtaggatagagatggagataccagttaattgaaatttggttgaagaaggatgtaacaaaaataagtgcattctttgaatactttatctcaggtaaaaattacagaaatgttaaagaattgcaaatttagatggagcacctaaaactatttttgtgtatgtttccaatgtctggagttccacattatccttttagataatcttatctggaaacatgtttaatttctctagttggtgtttctttttaaagtgacgacttcaagataactcaaaaagccatttgaatgaggaatccttctggacatttacaatgccttccccagactttgacaaaattgtattttattgatagtgtgtttcattcaagatttgcctatctctggtttttccaactaattcaacttagtgtttatataggagccaaatttgttttatattttgctttatgtaacatttatttaagttgatgaattaaacattttaaaagcaagtgcagtggaaataaataagttttaaacaaagtgatttttgataaccatataattcaacaagattaaacataaatgtaaggtgtaagataggcattagtcagctcagtgtaatacagagacctacagagtatttcttgaattaaagatttgcttgaatggagactacctaacagaatatctaatataattacagtagtagccaacatcagcagaatgctcactgtcagggactgttctaagcgctttacatgtaatagcccatttgactctcacaactacagctatgagaaaggtacttttattatagctgtttcacaaatgggcaaaactaatgtaaagaagtaaactgactcacctaaggtcatactcctatgtgggttttctcctaacaagcacattctcctgcttctgcttcctgcactctatcagttttccttctttttatagcattcttttagtctgtttgattcctcttttcattattacttacctcataagccccaacctttattgaaaagagggtgtggtataattgcctttataaaccttaacctttattgaaaagagagtgaggtgtaaatatcattcttattataatgagaaggatttatcttataatgagagacaaaaattcagataagggagaaatgtggatccaggccatttgaatgtgaaaagtaatttcaagttactactttgtaattccattacaaagtaaaaaacactttaaatgacctaggtagtaacaaaagttactttaactaggtaagatttaggattattctgaggtctggctgctttacttatactgtatctctgacagcaagactactcattattttcacctgattaattttcacaagttatttcttaagttcattgtaatatttatttttctgtcttaactctttccagaatgatttcattaggtaagttctttaattctgatcattttttagaaatttccttctccttctcccttgatactttctcaaagttctattccatgggtactaaggggagacaagcaagataatctcaagcataaaatttaaagaggctctcattgtcagatatcaaccctgaaagtgaatgtttccttaaattatagcctcccaggacctcatgtgcctcatcctagtcccagccctgtataagaacatgttgtatcataatgtaaactttttagtgtttctttctattctggagcatgcacttttagtcccacttaagaagtgcagaacctgaaatttagacaggcttaggaaatgtcctagagtagtcattagtaagtgctactgtataactcaagccccttgattctaatttgataatataattgaaattttataaatttcatgttagactcagatgatattagccacaaaaaaatgactattggtttgcattttctagctcgcacatttttgggggagattgcagcacagactaccaagggcagtgagtagataattttaaggggatctcagagaaccacaaccaagttatacaatatttgtttcttatgcttttccaacctactttttgtactgtatcctcaatcccaaggtactcatatctttatgccctttgattgctcagtttcccaatctagctatcttgtagggatgctttgctctgaaactctcatgctgtaaattactccgtcacaatgtacttagatgcaagttccatcccctaaagtggtggtggagagagagcaatctgattgaataattgacttactacatatgagcttgcctataaaataaacttgttaaaacttcagttaatgtctacttgactaggttgtgtagaaactatttctgtcggctttttacaagactatagggctggcagtggtcttcacaagtaaaactgcatatcaaacagaaacaactaacatacaacttctgaaagtttgccagtcatacttcagaaaattgtcctgggtatatgcttattttgtgaggaatgaaacagataaaaccatagcttccagcatgttccacatcccagaatatggtgacagactggcagacacagacttaaagataatctgtgaaagatactatgcatgtatctattctagtatgagataattaatacaggtagtttcttaaagaagtaatgagatcttcattatttggattacgattcaaagcagaagctacacaaatcagtgtaaaattgattttacactgttctgcaagcttaagccatttaagattggcttaaatgaatttcttctcaggtaatcattgctgaaactcactttgaaccaacagtatacccactcaagaaagcaccacgataactcagtgtaaagggaatgtgacagatgcatgtaaagtacttttcagcacagcactctcctcctaaagtcaataaaaacaatttattccaagtaatgtaatgatttatatactcatatgcaactttctgtttataatgagcatcattgttagaagcagggaatacaaggaagggacttttaaggacataaatgacttttatattctaaatttatttaataggtgtacacagatttatcttatagaaaaaacatcatctgtactctaaattccaaaacagtagaagaaaataaattctatacatatatttgatgtctagcctgtggaatttttatgtgcctcgaatttgcttataattatgaatctttaccacccatttccatttgttacttaagtatatatacaatcaaatatcacttaatgcagatatatgttctgagaaatgagtcatgaaacaatttcttcgttttgagagtaccatagagcatacttacataaacctaaatggtatagactactgcacacctaggctatgtggtataacttattgctccagggtacaaacctgcacagcatgatactaagctgaatactgtaggcaaatgtaacactgtggtaagtatttgtgtatccaaatatgtctaaacatagaaaaggtacagtaaaaatatagtataaaagataaaaaatggtacacgtgaatagggcacttagtgaatacgaaggcctaggacattactatatactactgtagactttataaacactatactttatactacacacaattcataaaaaaacctttttatttcctcagtaataaattagccttagcttatggtaacatttgtaatttataaatctttttttttgttaacttttgactctttttaaaataatacttagcttaaaacacaaatacattgtacagctgaacaaaattaatatctttctttatatccttgtcctataagctttctgctatttcattattttttcccctctttaagctttttcgttacaaactaagacacaaacacaaaaatcactataggcctacacaggatcgggaccatcagtatcactgtctttcatctccatattctgttccactgaaaagtcattggggcagtaacacacatggagctgtcatctcctaggatatcaatgccttcttttgagatgcctcccaaggaacctacttggggctattttacagttaactctttaaaaaacaaaagtagagggagtacactgtaaaataatgatttaaaaatcatggtgtggtaaatacataaaccaataacccagtcattaatgatgattatcaagggttatgggctgcacatagttgcacgtgctatacttttagacgactggcagtgcaataggtttgtttacactagcattaccacaaacatgtgaataatgcattgcactacgatggtataatggctctgatatcactaggtgacaggaacttttcagctccattataatcatatgagaccatttgttgtgcatgcaccccattcttgactacaatgtcggtatgtagtgcatgactgtatatatgtatgtatatacatatataagatttcacttacatcaaattatactcatcaatttatatgtagttacatttgtttttaatacaggaaaagttatggtactaggtgaatggcagaaaaacccaaagtgaattatggtgatgacttgtaatgtttgggtaacaactttgctacaccaattctttaaagattggaccctccccaaaacaagtagcagataatatataggatgtaaatttcattgatgtgcttggaaaaccttgcaatgttcataaagaaatgatggaatttgatggcaagtggtttccaggggccaataccttcaatgatatgcctgatctgtatgttactaagtggactttggtttcgaaactgtacgttattaagtgtatagaactaataccaaggggtgttttatttagaaagcaaatgggactttataatagaatattgcctgctagagaaaaaaaattattttacactatgttcttctctataatggtatcagatactggtggagaattaggaaatatatggattttataatttgacagttattagtgtggctaaaaaatacattttattaaattaaaaatagcatttcacttctttctcagctgcaagaattcagggacacttactatttactgaatcacacacagtaaaaggaatcttttgggaaaagctgatgctggtttccagataagttacgataatgcttcccgctttatattgacaaccattttttttccttcaaaggatatcgagaatcaaaattatgtgaaggaaattttgataataacacaacaaagtgcatgtgccattgttttctgagtaaaaaattaaaattacattattctacagttcaaatttaatcagttcaccgttattacaaaaattgatctgatagccacataccattgaaatgcaaattttgatgatgctctttttctgattaataattgcagaaatgtcattttaaatctacatccccaagagcttcacagaatgcctctttctagttaatctttttgagtagaagaaacagggagctctgagcaaaccagccatgctgtctctttcatgcacacggtaggggcaagggcactgtggtattgctgtgttgctgttaactcacagaggtgctgcctttcttctttaccactgcttgcctcccatggattcctctgcttccctctgggcctcctcactagccttcaggcaacgtttgggtgactcatgaagaaatggaaaatcttgcagctccagcaaaaacggttagtcttaatggctttgttgaacctgaaggaaagtgactttgctgctctttggatgaggaaactaatctgtttacaatagaccagagtaatagggtgtgtttttatagttacatgcaatgataactaacattttttacagttttcttttactgcactctcttgaaattttttaatgaaatagtgttagattgtggctaatatcataagagcttatagtacacaaacaataaggaagaaagtaataaatagtattcatgttgcaacattggaagtttttgtaacaaatatttagtattggacatattcacaggtaacatgtttctaaaccaaattaaattggtaatagaaaagattagattgaatattcatttttaatatgatcatgtggtttcttgtgctttaccatcttagatacaagcttgaccaaaaaaacccccaaaaaaccaaaaaagtgttatgttaatttggtactgaaaagcacaattttaaagaatttcttggggactctttgtcacttttaaaaataaaatgctataaaaatcattttttcatgtaaagtaacaaagttgggcatatcatatattttatctttatcaacttctttttaatttaatgtcttttcagtgttatccttatttgaaaattgattatctacaagtttgttaaggataaaaacaccaatgtcatgtactaatttcatttttagtttagttttgttgtacttggtttttgtcttgttttgttttgttggctgttgttgaaatcgatttgattatcacaaagctttgttggagggatacagttttttcacttcactaatttactttgtataagatttctctatcatatatacatatatatatttgtcatcagaagtttttattatagcacattacattttaaaaattacactcatttaagaattaaaaaaaggtttgtaatgaccaaatcaaatgttcacaaaattatgaatttaacatttaaattagaattaattgaaaatgatgtagttgctgcctaattgcctttgaactgcaaaattgatcactgtgggtctatgaatctgtgtgtttattctacctgttatacaaaatattttgtataacaattttgcttctgctagaaaaattttactgtattgatttgaaattaatttatatttacctgctttattaatcatttcctgctgctaacacagaaagaatctgaggaaggaagctgggcccaggtaggagattcatatgctttaagacccttaatatcatttagtaggcaatgagaatataaatcaagaaactgtcataagtcataatattgtaaaccttcacttagctcaatattaggctgatgtgtataggtaaatgtagattatgtttaatactttatatgtctttttaagttaccatatttttaaaataagatgattgacgtttcataccttacctcttttaaaagggtacttttctttctttctcaaaagaatgatccaaaacttaaattcctctgaaatcactcctgtatatatttaatcaggaagcattcaagttggatctaaagggggaacaaaaagaaagaaaagacttatttggagttgcacatgccttcagatataatgcaaagtgtatgaagagaggttggaggagcaagtgttggcgttgcagaccacagagtcactagcatttattgagatgtttgtatgagacaggtgtctatacttggaacagacatatacttttgcaaggaagctgtgcattttttctacatttccacattttggatgaccaaaagagaaaatttgtgttatattcaatctgattgaaacctttcaatataagaaaaaatttggtagttacattaggacctgtatttaaacacacagtaggattgtatttgattttgattttgataaaaatttcattgttcttgagaacacacaaaagaagaggaacagttagattttccctagaaatgcatattagaattgagaaattagggcatgataaggaactaaatgggaattctgtaaaaataatagagagtaatagttcttttaaaatattggtttagtggtaatggttgatttgggttttcattttagctgttttgaacagtattggtaagaatagtttgtttgttatattaaagaattaggttatctgtcttagtttttgatcctgtcctgcttcttttagagtctatcttgattaatttctagaaaagactgattctttccaatgattttttggaaagctgacgacctgctttgctaagtaacaacaatgtccataaaaagcttcaaaattctgtctctccaaaacatttattcctttctctgtttactgaggttcccatttcacatcaacatttgccattacaatatagcaatggtagtagtggcattgataagtgggaaatggcaataagtgcattgacaagagggaaatgacagatacaaataaaacaaacctatcaatttaaagacagaatcttaaagctcagagtttgtataataatttctttattaataaaatacatacttggacaaaatgtaattccttttgagaatacaaagtaaatagccaatcattttcaataggcagatgctttaataaatgtatgcagagttccattttataccaaatcgaatcaaatgctatctgaatattatttttgctttgtttccacatatcatagtaattaaatatcagttataataataggtaatattatccaattaccatcttatctgattggttaagaaacttgactgctataaaacaattctagtgtccggtttttctacagaccctggcttatggagatatgaatcatgagtggattggaaatgaatggcttcccagcttggggttacctcagtacagaagttactttatggaatgcttggtagatgcaagaatgttagatcacctaacaaaaaaagatctccgtgtccatttaaaaatggtggatagtttccatcggtaggtgttttttcttttttttccccaaagaataattaaaatgaaacaatatattacctatactttagtaaaacaaaaatggacgtctagaagacagaaaatatatgtcatttgaaacatcgtttgtatacatctacttggaaaaatgttttcatccagcaaattgcagggactttctaatttagagctatgtgcatattatgtgcccaaagtttatggaaatatatgtgtacaaaattctcctcatagagcatacatctatttttttgtgagattctttgaaaattccatgttggtaattttatagttatatgtgtttatattagaaaattaggaagaataaacaaattcatagtttcaactctacacaaatatgtggttataaattttataatttaggaacattctagggaaaattttgagaagaaattgttcttctaagacatatttgtgtttttttatttttctatgtctttttatgagtttgcttatttgtatattaatttcagaacaaaaacaatactgtgttagataactgtgaggatgcagttgaacaaaaggcaatgtctttttttcaagttgtttaccatccagcagataaaaaggggtctgttataataccatatcataaatgctatgtttatgttaggtgaagcaatgtcagctggattttggttgtttttttcacataaagttgattgtggtgataagttaataaatataaccatagatgattttggcttgggagactgtatttgcttctctcctgtccaacatttaatcagtggctggagtgaagatggtataaaaattagatatgttgatgacataaaattaggataaatagaggataattggggcttttgcttccaacttatggtgatattttgaattttaatgcagttgttgacactgttgaattaaatgtggtaaagataaatataacagtgttttttaaaaaacccattaaagtgctggatggagaatccataatttaacagaaagttgtgtgaaaaagataaggaatttatccttagcacgaaactctccattttggttaatggcttgacaaggcatgtttagactgtgtttattggctgagacaacaaaagtgctaccatacagtgacataacaaaaagaaattgcatttatttgtgggtatcaaattgttataaggtggtagaagtccagtggtaaagttgaagtaattaaatacatttaaattggatgaaggaagactttaaataagtaagttttcttaggttttaagatcattattatgtgatagaagaattattttttctctgttgagcacctcattttttagttaacacagatgtagatcctaggtgagtgacttctagttaatagaagaaacaactttgtaccactctcagctgccttgtagtgtatacattgtgaggtagtgagtgagctccctgtcacgggaagtttagggcttcatatttcacgtttgcattagatttttggggtccggtttttccgttcttcactagattgacttttaatactgttttattactttagtaaaatgttttctataatgatcaaattaaaaaaaatactcaaatgacttggtttttgtttgttctgggaaatgcccaagcttcatttttaagttatgctaatctccaacttaaagcaagtagtacctgactgtatattgcatcctatggtcttttcggcacagttttccatctgacagacattttcataatattatatgtcctctgtatagtataattttgtattctatatcaaaacttggcagaaactgaccaagaagcattggtttaatctcaagctgcccaatatctgtgatagtgattatatcagtattatctagtatatcactgaattagtttgctagggatgccacagcaaaagaccacagatgggtgtcataaacaacagaattcattttctcacagttccggaggctagaagttcaagatcaaggaatcagcaggtctggtttcttctgaggcctctctcctgggcttgctgatggtcacctcttggtgtcctcaaataatcctttctctgtgaatatatatacctgttgtcaccaagtgtccaaatctctttttaataaggtcaccagtcagtttggattagggcccaccttaatggcctcatttaactcaattacctctttaagggcactatctccaaatgcaatcacattctgaagtactgagaattagcgcttccacacgtaaattttagggaacacaattcaacccacaacacctgcctaatgcaattttctttccatttttctctgattctgaaatatttgactcaacattgtttttattaaaatgcggggcttagaaatgcatctagcaagtaagtgtaatctggccaatgtgtatgtctaaatttgcttatattcctaaacatgtaaagtatcactgataatcaatgatctttactcttgaagtctacagattattttttcctatcacatcttctgcatctttatacataatgtcactaaaccttctcattttctctctcagaacatgcctggtttatcgattttcctttcaagctcatggctgttgtccctattttggcagaactgaaccctgaattgatttctctatcttctctgattacttatttctccatctcctattttgctatgagattacttttccttaaacagaaaactttttttttttttttggagatggagtctcactctgttgcccagggtggagtgcggtggcacgatctgggctacttcaacctccgcctcccgggctcaagcgattcttctgcctcagcctcccgagtagctgggactacaggcatgtgccaccacagccagctaatttttgtacttttagtagagacggggtttcaccatattgaccaagctggtctcgaactcctgaccacgtgatccacccacctcagcctcccaaagtgctgtgattacaggcgtgagccaccatgcctggccaaacagaaaactttattgtcacctcttcctcctccgaaaattgtccaataattctgtatcaattatatgtatttcatacttaaacacaatttaaggctttccttaatatgcccttttctccatgtataattgtattcctccttacttcctagcatgggttttcagccctggaatgtgtgtctcgctaaccacacctttaaatttccatctgcaatcttttgttcatgatgctccattttcctgagtcaacctgtctctgctacttgatactttaaggatcaatcaattttctgctcattccacatatccttttcattcagtttcaatatctgctgactggttcttcttacatacttctgtatcatttagagttatgagctactcattttagtatttggtcttctattacctcacttacttatgttttgtgttatttttctcatcagcttaagaagagagtatccatttcttataaattccttactgtctccataatggggactttaaattcttttcaagtgaataaaatattaatttgcctgcacctaatgtaggaatagctaaatgaaagacaaagacacatagatgaacaatataatccatgatgattttaaaactgttttttcttattttgaaaactttttttctattacttcgaaacattttgtgcttagaataattataaatgtatttccctccaatactgaaggatttggctgcaaatgtaatttattaacttgttgccctaagaagcagtgcatagtgttgactatggctaatcacaaaactttctccacctgctaaggtagactcactgtgtttttttttttttaataaaaaaaaaagaacaagtttacaatatggaattatgtgcttaaagaggttgaattatgacagaaaagaactagaaagaagacgggaagcaagccaacatgaaataaaaggtaatatatctttctttcatatgaaatgcctttattctggggtttttagctttcacttttactaacctaaaatgttatatgtgttacaatggtcagtaagtagcataagtatttggctagaattgttactgttttttttccattcttttctaattaaaatacagaaacaggtatctccatattatagggtgaatatcccatttggggagtaatcttgagtttttgaattgagacttatttatgtgaacctattaattatacattctgcttatactaaagatgtctccatgtagatatttttgtcagacttttaatggaacattctcagtatgattcagagaaacatggtatatcatttttatggcagttcatctttggtttatatcattttaattttattccagtgccccagcaattttatttttgtaacactgtatagttaaagaaattatatggtgattttatgcaggaatgatataaggattttcccctataaaccaaactagttcattaataattttagctggtaatattatcaggaacagtgtaaattgctgcagctgttatgtgcagaaaaatgttttatttgaataacaagaaaagacactccatattgcaggtttgttagaaaaaatactatatttaaaaataaatcatctaaatgttgagaagtaccttaatatacccgacaaaggataatttcaaaagagaagtaccttaatatgcccaagaaagaataatttcaaaagagaagtaccttaatatacccgagaaagaataatttcaaagaggaatatgttagattctattcttagagaccgttctatttttattattgttgttgttgaaggaaaaaaatacatgattggaaaaagatataggtaaaggtatttttttgttttaaatttaaagggttcaagtgcggttttcttacatggatatatttgtggtggtgaagtctgggttttagtgtacccatcccctgaatgatgtacattgtacccattaagtaatttctcatctttcgccaccctcccagcctcccacccttctgagactccaatgactatcactgcatactctgtgttcacctggacacattatttattgcccacttgtaagtgaaagcatgaggtatttgactttgtttctgaattgtttcacttaagataatacgtgggcttttttttgctaaaaataatcaatccacttttgttgtttaaagaagaaaaaggccaggtgctgtggctcacgcctgtaatcgcagcactttgggaggccgaggcgggcggatcacgaggtcaggagatcaagaccatcctggctaacatggtgaaaccctgtttctactaaaaatacaaaaaattagccgggcgtggtggcaggcgcctgtagtcccagctactcgggaggctgaggcaggagaatggcgtgaaccctggaggcagagcttgcagtgagccgagattgccccactgcactgcactccagcctgggtgacagagcaagactccgtctcaagaaaaaaaaaaaaaaagaagaaaatattaaggaaaatataaccaaagcttttaaggaaaattttggatattaaaatacttattagttgtatttacatttcctattatccaagagttgatatgtgcaagcattacatcaaatgtaatgggtgtttctacattacattaatggttcaagggtaggcatgaatctctgttttcatcttcacttcttttaaggcttaatttagataagaaagtagtatatattacattctccaatattaacgtttagtgctgttttattcttaagattttttttaggtttctataatttacatttttgataaacaatgtcagaaattacttttatctttgtcaggtcttggaaagtacattagttctaatggaacgggcttgaatgcatgtgaaagtgattggttaaaaatagttttctacgtacgtctcatcggagagtagacagactcacaatggatttcttgtaacacttcatttgatgcattacttcgaagcacgaaagtgcttttccattatcaaaattgagttgtttgacttcactttatttgggggccccaggaaactgcaggttgttttcagtgcattgctgttcagttgaattgaaatttgggaattaatggaccaaagatggaccccagaaggaagtttgcatgtgaccacacaatgaatgtcttagcacacaggtagattttacccatgggataccactttgtagtttcctttctgaagtatttttatccaattagattttattatgcctcagctcaccacgtgaaatgtttcacatatagatagatctaaaggagaggaattacccagttggccctataccaaatgttatattagtatctggcaattgctgattagagtgtagctctgaggaaaaaaaaactgccatgattcattatgatcacacacaactctatctgataaatagctgtgaatgagatcataaatagcttgtttcctatgactgatctggtgacatttacaggaataattctcaacagtgactaggggtctcttattatctgaagtgtgaattaaccctgaccttaatgaatagttttctgaagtgaagagaccatgtgaatatcaagaacctactaacatttaatttgttgctaagaagcagtcaacactgatttctagccatttattgtttaggtcaagaagatttctacacagttttaaagtcagtgcatacattgcttggaaacagatttatggaaagagatctaactttaaaaatgaaaaaaaaaagaagtattttgttctgaggaggaaacgtttgaattaatgctttatttgtctttacctcataaacagatcagtttaaatatttgatcactcttaactacaggtgtgacgatggaatttttgatgggcacatatttgcagaaatatcacgaccacataatatgtcttagactatcaaaatataaacctaagtctagaaaaaaaccaaatactccctatttacaaatccaactagtgcaaagaaaactggatttattttttattattgagagcattgtcacgttcatttttaaaaaacggtgtgtttaataaaattaagtggagaactgttgctgccacccacaagcacttgcctagcttttgggattcaagtgtagggtaaccagttgttagaatgaatcagtaactatcagcagcagctgattatatagccaaaatgtgatgctaaccaactcacatcccattttctgaggtctgaaaacctcaatggaataggctaaggaaaactcggaggaaaagctacacttcagaactgactcagagagacaattaacatgtataatataaaatttccttatatagtaaagaatattaaggaaatcctttgctttgctgcagaccggtttgggggggggcggggagaaagaggcaaaactctgaggggaggacaataaatgtccttcttcgggcagaaattcattctgctttgaatggagcagctaataataataagactgtgggatgtgggcattcctctcatattccttattatctaaatccaaagaaagatctaggacctttcttttgaaatgagatcattctatccacaaaaggagttaagtagagagatgtgaggctgatacatgttcagcttccagattcatatacaaatgttttgctagtactgtggattggcacagacagaaaggacaccaactaatttgaagaacttctacttctgatagattggagcatattaagtcagaccaatcttccactaagaagaaatagaaaggatagataaatcaataaatggtaataaagagctatttgaaaacagtagaaaccaattaagagggacaagacttgagaggttatgatcttggaaaaaagaaaaatgtaaggaaatagtaaaactgtcattctcttctgtttttcctctatctaacagagaagcagggaacggagtggggtggtggtggggattggaatttagaggtgccaaaactgccgggccttcaggagcaaagaatgtgtaaaacatagtaataataaaataagtaagactgaccatttatacaatactcctctagagacatttgtggacttccaagaaggatggaattataatctaaaaattgaacagaaagctgaagccaaagggtaataaatctagaaagagaactgttgtaatctcatgataatacagtaaaaaaaatcaaaggtcataaccaccaaatatgctttaatttgaggtctctgataaaacacaccgtaggactagggtaaacttaaacagatcaggctatttattatgtctattaatgttaaaaataaattttattatgtatatttgaggtttagaacatattacagaacacatataggtagtaaaatggttactatagtgaaggagattcctaagctttattttgaaatgttaaaattgaaatctagcattgatttatctcaatctttaattggaattaagttgatctgcccttattataacttcagaaaaacataaaagtccttttaagaagaagttgacattcagagcctctgcaatttttcaatcatattatgtgagagccaataaaagaaaaattcagacatgtcagataatggccaaaatgaggaaaaccacgatgataaaatcagaaaaaagaaacatatccatagttgaccctgacagtgtttattaaaaaatatgtaaggaatataagtgagaaaatggagaatttaatatagttggaatcaatatgtttaacaaataatcaaatggaaatttgaagaagtgaaaagtataaagacttaaattgagaacacaataggtggtttaacagtagaagagagtttagtgaaataaaagatcacttgaaaacatctagcccacatatgacaagaaacaaaaaggacgaatgatataaaacatcactagagacatattggacatggtgaggtaagagacaataagaaagaagcaatatttgaaaagatactggtggagacataaaaagaaaataattgaaatgataaaccacagactcaaggttctcgatggaccccaagtgagattaaaaataaaagcggaaataaaaacacgtctaaacacattacaatagagctactgaaaaccatgatttcccacaccccaaaatcttagaatctgccagagtaaactccacaataatttcaatggcgcaacataatataactgatattgctcaactaaataatgctagaggaaaatggaattattaccttaaaatgctgaatcaaactaacttactttgaagtatgtccatcaatagtaaagagagaattaataaactttcagacaaacaaaatctgagagactatttcaccagaaaaaaaacaaatagaaaagaaatattagaataagtgattcaggcagatggaaatgatcataaagataataaaaaaatgcacacatgatggaggagaactgaaaaatgtatgggtaaatgtcataataatagtaaaaataatatctgcaggacttaaattttacatagaattaaaatacataactataatgcaaaaggaagggaataagtgaaattaaattatttgaaagtctttgcattatctagaaaataataaaaggaataatttatagtagactctaataagaacacatattataagctttaagtgtcactactaaaataataatataaagtgtaaatataaaaagctaatagagggccgggcatggtggctcatgcctataatctcagcactttggcagaccaaggcaggtggatcacctgaggtcaggagatgagaccagcctgactaacatggtaaaaccccatctctagcaaaaatacaaaattagccaggtgtggtggcgcatgcctgtagtcccagctacttgggagggtgaggcaggagaatcgcttgaaccttggaggcagaggttgcagtaagcagagatcatgccattgcactccagcctgggcaacaagagtgagactgagtctcaaaaaataaaagaaaaaagaaagctaatggagtggtagaataaaataagaaaacaataaatggcaagaaagagagaaaaagaacaaagaacagataggacaaatagatggtagaattcagcacaaatatcaaagtaataatattaaatgggcaagaactaactacttcaatttaaggacagattaaaaaacaatgatatgctgtatacaatggacacactttcaatataagaacatagaaaacttattagtaaatgaggtatacatgcaaatattaaccaaagctactgtgattcttctaatatcagaatataaactttaaggcaggaaacatactagaaataagttggctattttcaaataatagaaggaaagatatagcaaattagtatacatctaatatgtagatttaaaatatggaaagtaaaaactgacaaaccttaaaagtagcagacgttttcagttcataatgggtgttactgattaaaactacaatgagacaccccatgtattagtttgtcagggctgctgtatcaaagtaccacagattgtgtgtcttaaacaacagaaatgtgttgtctcacacttttacacactagaagttccagaccaaggtgttagcagagtcagttgctactgaaaagaatctgctattcgcttcgccccctgacttctggtgatttgctggcaatttttgatgttctttggcgggtaggaacatcgccacgatccctgccttcatagtcacataatgctctccatgtgtgcatgtctatttccaaattttgccattcaagaatgataacagtctcattgaatttgggcccactctattgactcattttaattgatcatttctataaagacctgatatccaagtaaggttacattcttaggtactggaagttagggcttctacaagaattttggggaacacaattcaacccataataccacacctaccataatgactaaaaaaagcaagacaaaacaagaacaaaaatgagaaatacaaagcattggtaaagatgaagatgttcagacattaataatgcaaggttaaattgtgagagtggaatttgcttagcaatatctgctaacaagtaaacacataacaattctattccttgttatttattctactgcaacatgtaaatatacaaaacaaaatccatgtataacaatattcaaagcagcactatttattgtttttttatttcaataggtttttggggaacaggtggtgttaggttacatgaacaagttctttagtggtgatttttctgacattttggtccactcatcaaccaagcagtgtaccctgtacccgatgtgttgttttttatcccttgccatcccccaccctttccccctcaaaggaacactattcttaataacccaaagtggaatctactcacatgtccatctacagtagaatggacacattgcagcataatcatgcaatgggatgctagatagcaatgatcatgaacacgccactgctatttgctaaagcgtagataaattccatattgaatgaaaggcagacaaaaaagtacatattgggtgattttatgtatgaaaagctaaaaaaaataaatcgggcaaggcgattctgtaatgaaagaagtcagaatattggttactgttaggtgagaatggtgcctgagaagttgcatgaggggacctctgtgggtctgtgctatcactgtattgcttcaaagttatacacaagaacatctaagttggttataaatggataaaataagataaataaggattttcaaagactcatcaaaataattatttagaacatgcttttcaaaggcttattgaaacaggtatttaaaacagttaaagttgaagaatatttcctgaaagatttttatactttgtctgaaagagctaggcacttcattagaaagaaaaaaaatggacaggaaaacttacttttactttaatagtaattatagtttcctttccctttctatgggtagtaaaaatgttttaatttttttctcatatccccttaagtttcttaaaattctttcttttctatggacaattttagtccttcggactattttactcattttatatagcattctgtcaacttttaatgggaagatattgaagaaaataaatgataaaacataatttgatgtttttatctaaaaaaaaagaaacggcatttttctctgaaagttttatttttagaaaataaaaatcaaagaaattttttcctcaatagaatactactttcaatagagtggaaacaatttttgacatttgactgagtgcttgaattttgcattagcatgtgattgggaaaaatgcattgaaatataatactaaggtaagtatccatctgttgatgccttatattattttaccgttctgttcttatatattacttcaggtgaaaaaaaatcttctagtctatatgccaatgtttaggtagtggttaacaaacacttctgatgaaagacagtattacaatctcgtctgctgtttactgaagaggtgtgtatcaagacacaaataagaaatgtctccctctgatggtaaaaatattgaacttcagacagacacctagttctctagtatgaaaacaagaaacacagacatcgtgttctacgcgactgaagtgctgtcattttagctataacaaacactctgaaaaataacaacttttttaaatagagactcgaaaagattaattattaaaacagtaactacacacaaatgaagggagccagatggattagagtgtggatgaatcagcataaatgtgacctggccagatacccatggctcatttcagccagtggttctactatgaaaaataatgcgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagtctccgtctcaaaaaaaaaaaaaaaaaaaaaaaagaaagaaaaataatgcatcctaaaatgatgcatctcttttcctagacgtgttggtgtggagcaatgaccgagttattcgctggatacaagcaattggacttcgagaatatgcaaataatatacttgagagcggtgtgcatggctcacttatagccctggatgaaaactttgactacagcagcttagctttattattacagattccaacacagaacacccaggcaagtcactttctgctgtagtctcaatgtgttctggtttatataatgataaactaaacttttagaaaaaaattggctgtgtattcatgattgttaatgaaagttaactcaatgtttgaaatatgtcactggggttttaatttcaggctagtggatttctagccaaaaaaaaaaaaaaaaaaatcatacaattaaacaagaaagggatttcgaagttatgtggcccagtctcccacctgaatgccagattccactaaatgaaatccctgacagatggccatcagtctctgcctctctgagaggcagtcatttctatttacatgtatgaattatacagactcttagcattggatatgtcagtgattcccaaaactggataataatttgaatcagtatagttccttatgaataaaaaataaaacctccaacccacatcatagtcctaagacatcagttgtcaagagatagggcataggaatctttattatcaaaactttcctcaaatgataatcattggccaggtttgagaactacctacatagattcaataaaaatttggcagtctcgtttcactttttattttgtttttacatatttcagagattaaacaaaatactcaattgaaatatagtaacgaagtgaggccaaagcctcttgacctcagatgtttatgcaagactgtctctctactgttcacagaaaaaaaaaaaaaagccctgttttttttgtagttaaaatttacaatggctaataacagacatggagggctaaaaacttcaaaacccataaataaagtatggtttataatacattatcagataaatataagctacttgatttttaaaataaaatgtgatttcggtgatggtaactgtaatttgacgtcaacaggcaaggcagattcttgaaagagaatacaataacctcttggccctgggaactgaaaggcgactggatgaagtaagtccacctgttattcaaaagagatctgagagagtaaaagaaaaatgatagaacatctttgtttttaaggaatagtgcttggaaattaatcaaatgactgttctatggttagaatcaataattttctccaggtttgttgttaaatattcaatcttattacttaattttggaaagagctatattaattcataaatattatcatttcagcaggtagagatactaaacagtaatttacaaaacatttttatgagtcgtgactgcaaaacgttgggcaacattattttaaaaaattagaaaaaagttaaaacactaatgttgataaattcagctttttaataaagagtgcgtgtatttcttaaatatcagtatatcttgccaggaaattttagaaaattaaaatgaggataaaacttgcttcaataaatggaaagctttttattattttatatattgatactgagttttccttcaaaacagattaataacattttaacagtcatagaatttgaaagctatattgaatataagaatcgctatataatatgtgcatattaagttatttggaaaataataaacatgtaagtagcctcccgagatgaatgaatacaagggatatcagcaaatgctgtggactgtagacattttaatagtctttctgagtttttctacagggtctttctggaagaagtgggaaggaaacctgagcatgaaatagaaaataaagagatgcataattctgtgttgcaaagtacaggtgttccttactacaaagacaagctgattaaaattattttgtgaagacctcagcaaattcaaatatggaccaatcattctatattcaaataggcaggacagataatcttggtattataaaatccactctgtcctttatggtggggattatagagagataagttctacagtcttgaactcagctaacttctgataaattcatgctcttattcaatcagcataatgattaatatttttaaaagcctcgtcttataagttgcatgacagtcttttaaatccttactagaaattattgattcaaaaaggtagtcttataaactcatacatcttaaaatacaattattcttacttataagttgcaaaaatttctaataaaaaattattgaagagttgtcatattgctacattctcttaggagctgtccaggtgtggggtagcttcttaatagtaatgaactagaagaaaagtctattgagccaattaaacgagatgcgactcgttgtctttaaactatgctgctgctttttcttatttttaaaagcacaaaatagaattttgtcatttaaaccctctagtctcttttgttcaattttattttattttttagtgtgagcaaaaatagccaacttacttagaacagtagtggacttatttctgcggttttgctgatcacattcagattccactgaaataatctgagaggtgtcaacaagcttatacagactttgaccccaattaaaagaattaaccctatctcatgaaaagttttccccatgatgttgttgtttatagttctatcaactttctgcagtaacaatatgttgaaagaacagaagtcaggaatcataattcaaacgcttaactctaaaaactggcaattttttttttttttttttttttttttgacagagtttcgctcttgttgcccaggctggagtgcaatggtgtgatctcggctcaccacaacctccgtctcctgggttccagcgattctcccacctgagcctcccaagtagctgggattacaggcatgtgccaccacacccatctaattttgtattttttagtagagacagggtttctccatgttggtcaggctggtctggaactcctgacctcaggtgatccgcccacctcagcctcccaaaatgctgggattacaggcgtgagccaccacgcccagccaaaactggcttatttttaagcccctagctacgacactgtaaggagttgtgtagctctacagtgtaacatagtgttttataaaactgaagactatttatgcttaatgcaaaaacttctccaagaatcaagaagtcgtagaggctgcaactgtgaaattctgtttcttttctacatttacacacatttggagatctagggcaatgaaaaacacagcagttgggaagagtagcggacatctcttaatgtgcaaaatggctaccacactgaaacaaaatgtagattttaatgatgataaggattgaaacagtggatatatgttattatataaaaatgattttatttttccctgattgactttaaatgtcccttaattaatatagcagtctacaaagcctaccttatagaattattcactataacatagcacaaattactatgttgagtgaatatagacttattattccaaatgccagaatgaaatcaaatgagatattaggatacacaacatatacttggctatacctatctatggcatagatagtccttccctagataagaaacagtgagatgagaagacaagacctatgtggaatgattcatattttccttggaattagacacagaatattcattgactgctgaattatatattgctacttgccaatttggaggaaaataattatgtctgtaaaagtactttatgtacacaaagagaaggaagagattattttattaaggcataacaaaatcagcaaccagaattaaaatgtaattgctatgctacattctaaaatgtggattcaccctaggatctgtccaagtagagacactagcctatgtggggtatgatgttgcttcctgatagtaatgaactagagaaaaagtctactgggccaattaaatgggatgtgactctctgcctctgtgtatattaaaatacacattattaaaatgtaaccagggtaatattatgctttcggtggtacccaaagaccacatgtacttattgaaaggatggtgtccaggctacacagatttttcaacaaattgcaagttaattctgtgtcacctaaaacttcacaaatcacatatttagagtttcttgtacagatattataataggctacagtgtctcatattagccatgccatctcaaatatagatttccccaaaataaatacctacattgtatttgtgtacatagaagtcatttcattcaagtgtgtgagttaaatgtagtctactcaacaactgattcaattaagtatatcatctctttccataaaacccgtcggcataaagtggaacaatgtatatacaatatttattttggaaaacattggttgcttattttaggctttcaaggatatttactgtatagatgtcagaccttaaatttgaaattgtatgaaaagttttatttaaaaatttatatatcaaatctcctatagtcttgttttggaatcatagaactaactatcttgataaagcgtgattccatacgtatacttgacagactaaatgtaaataatctatgttacatgtttctaagcacagagctttaagcacatggactagtttacttgttttcataacatcaccttataactgtactggcagagtgatgacaagaacttcagacgtggatcaacctggagaaggcagtttcctcctcgtgaagtacatggaatcagcatgatgcctgggtcctcagaaacattaccagctggatttaggttaaccacaacctctgggcagtcaagaaaaatgacaacagatggtacagtagttttgcattgctgcttatcaagcaaaaagcttgtttagccaaagctagtataattctctgaccttgctttttggaattattttcttgagttggtttgctctgcttgaaatttactttgctctcatcacaaaccagactcctttttacactgctattgcatgaactcatggcactttattcacattttcaaaataatttataacatcccaaaaagaacaatttggttaatgtccacctctaggaggaacaataaacatcggcaggatttgtgtttctttagtcttctattcccaaaattaacaatttgtttaagttagaggttggacttggactaaagatccatagtaaatggaaattaactccactgtctccctacatgtttaaatactgcgagttttatatgtcatcttagaaattcactcatcaaatatttttccctctagccaaagcagaagcccttaaataaacaagccatgaacatgagaagagaattaaagaaacacaaaacacagtaatttcccaattactatttccttctgtggacattagacttaagctatctaatttacaaaagaaaagtcattccagaggagagacaactttgaaatagtagtcacaaaattatttctgtttgggaggcattaaagaaaaatagtcccatgctatttgttaagataatcacctagcatcattatttcttgtcaaggtcacagttattataactcaaatttagttccaacataaactgtgatcttgatctacatttcttacaacttgttaatacggtggaacatgtcagcgaaattcatgaggaatttaacatcattacaattagtgtagaagttcttcaatacttggaaaggaaaaaaaatccactataatgagttctctaagagcaatctccatatcaaaatcagaagcaccctcgggagctgctcttgttaccgattttatctaaggaagaatacataacaactcaaaagctcaggtcatttacattgggataaattttcattaggaacttgatctagagaagaggaatgtgagtggcttatatctgagagaaagaaggtctactaatatgttcggaatccctgtatgcagggaaaataaatctttctcatctgaaatcttgtactcaatcatccaagtccctctaaagcccttttctccatttgcagttgcttcatcaagactgcagaggttagacaactccactgttcgcacatactcatgttgaccagccactcaaaggaggcagcactgacctgctgtgagtagtttccctttggctgacaaaaaaaaaaagacaaaaaaatggaacctacatagactaataaatatacactatactctttggtatgccctagcagtacagaaatgagataacccttttgaattgcttcaggggaaaaagaaatcttcatattgtaacacttagtctagcatttcctatcaccatctgtctcctgtggtttaaggtctgcctgttggaggcctatcactgtattattacacatcaatgggttgccactacactgttttctactttttagtaccatttcctgttgagtaacttagcattttattgataataattcagcactttaaaaaatcctatctttttaagtgtatattttatataaggaagccaaggtagcggatagggatttaagcaagttcaccgagtcaaatagcaacagacaggaaaatgatttagagatggtttcatattaaaaaatagaaacttgccgaggcaggtggatcacttcaggtcaggagttagagaccagcctggccaacatggtgaaacctcatctctactaaaaacacaaaaagtagccaggcatggtgttgcactcccataatcccatctacttgggaggctgaggcaagagagtcacttgaacctgggaggcagaagttgcagtgagcgatggtgccactgcactcaagcttgggtgacagagcatgactccgtcttaaaataaatcaataaataaatagtagaaactgtgaaaaattcaaacctttattacattgtttcttatcaatctgatttacacttgctaaaaacaaatataaattttaagtatttaagacatataggaacaaaataaaattactttaagaatggagaataggaccagcacaaaaccttcctatgtaaccataaataccaagcatttgattttaaggaaataccaattaatgaaagctactttaaaatccatataaaaatgaggttttattgaaaaacagtcttaatagtaaaactgtggtttcttagatttataaatgtcaaatgttcataattttttttcaacctaaaactatgctttaccaaaatatttaaccactttcgatgaatcaatattttagaaaaatactttttaagagcgatatttagaacaaaatgtgtgcacagggttaagagaaaacagttatagacagaggaacaactcaccttgtgctgttttcattgccttgaactaaaagtgccacacaatttattgttggtcttttgggcttaggatgggagcagatatgctgccttatttggatcactatttgaagctgataaaatgaaaagcatcccgataagagatttaatttcagaatgtacaacccttacattaaaattttaattatggtatataatttggcacctaattagacatgatttaaagtatataataatttggctaaataagaggtctcccaaaatactgtttatattagattctacacatagcattataatttcttcaggaaatgaacacttcactaatttacaaatgactatttaatatgttcaatagtgcttgcttcttagctcttaagtgatgggtagagttactctatttgcaatctgttttttgtgcatgacattctagttcatatttcctagtttttaccattaattgggataacagtattcatttacaataattcaatctaggacaaccattttttgtttgggtgaaacaacaacacttttgatattaaaataatccagagcatactacttgctgtttcttttgtgtcagtaatagcaattgtgagctttttctaagtacattatggctgaaaacaatcagcaatgccatactactgacacaaacgtttacaataggtgacttattatcgttatgtttttgtaacaaataaaggtattttttaagaactctaaaatatatgaactagaatataaatctacattatgaaataggtcaattcaacccaatttattaattagcaagttgtaaatttttcagaaggcatgctaacattttgcataactacctttgtttacattactgccatactttccacaaagttgagcaaattctattatttgttaagctcccctgcaccaaattggagaaaagcaaatgttaattacatacggctgttggctacatcctagatgatttccttctcatgatcttctaggacaggagtaagcaggctgcgtggaggtacaccacagaggagtagaatgagatttcccagtctgggacttttcagtgaactaatgctatccattgtatattttagatggcgtcttttcagtctactctacctaaagtgcactaccatctaagaagacgagcagtgaaaacctttgtgaaaactgaattc

SEQ ID NO: 159 - DNA, 8355 bp, Homo sapiens
aaagagcgcgctcggacctccttcccggcggcagctaccgagagtgcggagcgaccagcgtgcgctcggaggaaccagagaaactcagcaccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagacttcagtccttatgtttttgatcttggttcatccgttgtggggcagaaaattctgttgctttaactcttggataaccacccctaatagatacattatttctctctttggtgtcttctcctcctaccccttcccagaaatccaacatgaaaatcctcgtggccttggcagtcttttttcttgtctccactcagctgtttgcagaagaaataggagccaatgatgatctgaattactggtccgactggtacgacagcgaccagatcaaggtgaggccccttcccaggacggcccgcacccttcttcctgggctcgggagctgtcaccttcccacgcaacagcaccctagttaacgtggcacgcaccgccaccacggaaagaggcagcggttgcgtgcgagaggatggaaaggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagccggcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaagatctggttcgcatgcctcactgtattcgagtgaagcgctcccttgactaaagatccaaactgacaaagggaaggcacgggcctccaggggtagtactgcggatgatccaagtgcatgtggaagaggattttatagcattccctgaggtgagagtacatttgtcttgggatagaaatatcgtttccttgaattcatcgcacggtcagtggaacatgtagttaatgacaattcgtctcttgtcagattcctcaattgaaaaacaagtggccctgttaaaggctctttatggtaaacattcctataaatctttattttactattgtgaaagcacatgtaggaaagtgaaataaaatcttttatgggctgaaatacaagatctgggtcatgcctgtttaataaagagatggatttgcgcactctctctcggtttctctctctctctgtcactctctctgtctctctctctctgtcactctctctcagtctctctctctctctttctctctctctctcagtgggtggccagccttgaaggtgggatgtgttacagtcttatagttaataagaggcctcagaagtctcatagtcctaggtttgaatcccatagaaggcacttaataaaaattccatttgtttgtttaaatatttagtttttatgattaataatttgtttagcatttatggttctgctttattcctcaggataatatatagatagaaaatgttacatattttgagaatcaaattattttataaaagatataatgtagcatctttaaaaacaaatctatatgtgtttgctaattttatctttcttctaggacatggccagatctctcacaaaagtaagttcaaaattattttgacatttatcaaatttaaatgtaaaattatattgaatttcactttatttatcttaccttattttctgtcatgactctagggcttaatatgtttaatgaagacaatataagaatgggggagattcatattacatccagaatatggttgtttagacatattgtacttagcaaagagatgcattatattaaaaaagaaaaaaatgtcttttaagtcccttcaattgttagttttagagaagaatttcaatcctaggattagaaatctaccatacatatttcttcccagccacccaccccctaagcttactttcactgtaaacaaacaaacaaacaaacacgaaacccccacaagcatttataggcatctcctaactcattttagtatgcttggtccaataatgatgtcatttattagggtcatccagcagccaattaaatggaatgagtgagtgaacatgagtagagaatccatactaaaaatgaagacggtagagatgcagttttttaatcccctaattgaatgggaaaactcgatcagtaaaacatttcttagggcagcaaagatggcaaaattgtggtatgtgaaggtcattaaatttgtttctcagttaatggaaccggagttgacaagaagtggaaagggtctatcttcatcgtattgtccactcacctattgtaccctgtcatggatttggttcattgggtggcagagcaggccacattaacgtagcagctctattctcaactattaaaataaaaaccaagagaaattctctcactagcattaaaatagtaacctttccaaagagttcatctttgaaaaataaatagtattcatatttactttctaaggatttgactttgaagagaattatatataaaaattctatgtaataaaaaatgtactctgttcatgtgaaaactaataaacttttctgaaaggagtatcttttaatatccaataaaataaaaacagtgaccttttagaagattataatcatcaaggaaaggaatctggtttaattaaggtctacttgctgagaagtacaacttattaataacacaaggaattatgcttggatatttcactctcacacaaatgtgaaattgacttcctaaaaaatcaaacctagctcaaataacaatattttatataaaatattttagacccttacataacagataaaatatatgaatagagagtgcttgctaatattaaatatagaattaagaaaagtggtttcattgtattgttttagtgtaatttataaaacttttaaggaatctttatttcttcagtctcaccaaaacttgaagtagatagatatttattatacagacatatattcagaagcttgctttgttctggttataatagtttgtttcctcaaagatatacatattaaaatacccctaaatgtatttttccaggacataaaacagattcctttgttggactaatgggcaaaagagctttaaattctggtatgtatgaaattatgactgaaaatagacagtatctcaaatctatttctattttttctaagacatagttttaaaatattaaaaaggagtggtagatataaaaatgagtattatggtggaaaaatttaattgttgtacttgtaaccacaaatggatttatagctggttaagctaatactaccacagtatctgtctatttctctccaatcaccattcttaccagtgtctgccccatttaatcattaccaacctgaatctttgggttagtgctatattctttcctatagatctgttaaataagccgtgtttaaccttactgaactaagggggagtggggagtgcagggaagaatgagggtgattttcacttgttatcaaagtaatttgaaagttttacaagacattacatttggcgatcttccaatacaaaaataaattcacaaaacaaattctttatgcaaattaatcactttttatgaagttgtagaaattcaaaatctaaacatcctgatggatgttggagaggacaaaagtgatacggtttattccagtactttcaaaaaggaacacaattaaatatccttgagtgttataaattggttctggctataaactccttagagagaaaggatgccacaattctcattttaattctgaacaactttttcgtatgatataaaggctgcaggtttccttctcttcaatttccatcttctttgtaaataccacgtacatatatctgaaaaccattattagttaactcattcatcacactgatttcaatgtaaataacccctagatcattttaatagaagctcactttttgttaagaccttatagctcttacctctagggcttcttggaaaagctattcaaattctattttgccttcagtgaaaatagaattaaaatactaaatacgttattaattataaagtaatcagcagctgtcttacccatttagaatatttccagtttctagacaatctataagatgtgctggcttaatccttaattatctggatcctaggaaaaataattatcctagtgttttttaatggagatttttttctttattgtgaaatgtaagacttgggtacattaaataaaaccactttctgtggggcaaaaatcaaaacgcgcaatagaaaaaaaaagttaacacaatctgggctacggcagaagccagagaatatattcatataattgaaaagttctaagtgtttcataattgaccttttgatacaaaatttccaataaatctggaatttgaagttcttggtgaagtccacaggacttcctagtgttcttattgggtccccactttctatttagacactacctttgcatcttctcaccagtcattttgggctgccgaagtgtaaaagtgtaagaaattatcaatgtgccttaatgaaaaacttgtaattgttttattaatatgtattatcttcccacttttggaaatgaaatataaatttaaaccacaatggcttttatttgtaccaatacatactagtcctcacttaattgtagttttcttgataatcatattagtcatcaactttccatttccagaattgatataggtttcagaacatgcttaactttacaaatgtagatattgtacaagttagaacagattaaatacaattaaatgtacttaaaataataacataattttaagtagtgataaaaatcactgtagtgaatcaggatcaatttataactaaatctttgttcctccattttagttaaggaaatataaataggtgaaatgtggaaaaaaatgtgatatgatccacagtcaatcagggatctttttatgtacctcattgaggcaaggttatcatagccttaatctatagccctctgatctttacccactcatggtcagggacccctttgacaatctgataaatctagatagatgccctttcccagagaaaccctcatcagctcatacactcaaaaatttatatcaggcttcagagggttcaaagaccaggtaagaaactctgcttccatgtaagaggacattatgttccagctaaatcactgtctgtctttagttggtttacattagctttcatctaatttctctgaggaatagagtcatgttacctaaagcttgtcagagactgaacttgggccattcatcctgttcctaatataatcaaaccagaatgagaaataaactgtttccttccctcacgcctgtccagtgttggctcagactgttctgcctcacaagtgcatacttaattgatgtaaaatatgcagcttattgttaaccgcacttaaaggatagctgggtgtttaagaccagtattaaaagagggaagtgataatactggtgcctttacctgtcttctctgtcagcaaatcttctcactgaggaaactgtttagagtagcacttattattcctacagatccttcacagatctttctactctttctgtttacattcagtattttatacaggccatactgaatttcaaaaagcatagtagttccactataccatacgtctaagtctataaggtattcgttaaggatgaaaaatatcccaaaatacttttattgcaacagtctgatttttacccctttgtggttacagatccctttgaaattatatataataaatataatataatataatatacaattttggcatttttttgtccagataatcaatgtatttaaattacttgctagctatatgttaaatacctttggaagcaataattaatgcttcacaggccattaaggtgctagtgaaaagttaaacagtatggtatttagatggctcaactgacttacctatggtaaatgggctgtttttagtcttgagggcagtccatcactgggaggtatccacaaggtaggaagagacccctacacaattagatgccccttgaacaaagatcagcaaacttttcctgaaaagaaacagattataaatattttaggctttgtgagccatgtaatctctgttgcaactacccaaatctgttattttaggccaaagcagccatagacaatatgtaaatgaatgagtgtgtctgtattcctataaacctctttacaagaacaaatggtattctagatttggcccatggtctctgctagaataaaagtcccacatttggtttttatcctactagtattcctggttattttaggcattgtcctttctagaattcactatgggtatctgccactgcttgagaaagctgctgagaatcaacactgcaatatattgtggaaatatgctttgggggcaccaagtatatgatgaatgatgaatgaaaccgagttctgtggttagatcatttccaatcagaatagagactgaggcaggattggaagatgtgcagataacattcttagaaatacttctgtagagggaaaatgtcattatgagtttaaaataaattactatatgccctgaactttagttgtgtaactccctcagtgaattcacttaaaaaacactttatctcttctttgttttcagtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatag

SEQ ID NO: 160 - DNA, 144854 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtgagtaatggggtgagcctcctgcccttcccccttagcgggcagccgagacatgggaggtagaggttggggggcttgggatgcccctaagaggatccctgattgtgagtaacggggttaagttatttctcaagatcattcatatgaaccgccttcctgtggatttagtgccaggagaagtggggtgagggtgccccggaaagtgtacattgtgtatgcagtgttgggggggcagatctggcagagtgggtgtctacaggagggtgccgccgggtggggaggggcagagagagatgcctgggcaggtgggtacagttggatcgtgagcatgctgggttggtagcgggtgctgtttggggagactgactgctgtgttgtgtgtgctggatgcatgtcggcatatgtgtgccacctgggccagggcgtgttgtgcttctggtgctgtgagtgtccgccgggtttgggggctagcagggaagcgcgttatccactcggcgcgcgcccgcgtgcacatacgcacgcacgcgctcaccccaatctcgggactccaccgccgcgggtcgggagctgcagccccagagcacccaccgctggggccaagggggcgagggagaaggagggtttctccagtgctgcactctccagcccctggtggtctgcgtgatccgggactcggtggagagaatcgaaatatataactaaccctcccccgatcccccaacacacacgcgcgcgcggacacacacacacacacacacacacacacacacacacacacagtcaaagccctgattcagaggctagcgctgctgctcctacaggccctggctgacctgcccagaggacccgagccactgggaaagatgatgaaagcaatttgctccggggaaaaaagcagttcttcgtcttaattcattgtattttatttttaacggtgtggtagtggtggtggtggcggggtggggttaaatagaagaaatgcctttaatgcagtaccataaatttacccgctcatcgcagcttccttctctctctctctctctctccccccgccccccgcttctcttctcttctctcctcctttcctctctctctctctctctctttctctctctctccccctttcctggcgattaaaaaacatacctccgaacgcattcggcggttaggtctcccgggcagaagaattaaaactggtttcaatttatcagaaacgcagactgcagcaggcgcagccaagctcctgggtggtcaagaaacacccgaagggggtggggggaggagggagttgagcgggggtggaatgtgggtacgtgataggaacacatccggccttccggtggggcaccaaaagggaagcctcctcggcccctggcgacccggtgacttgcagcggcgtgtgattaatcttccacagctgtcgtgccccatccacttgagctgagctcttgtttacctcgattttcaaatatagctgctgcgccatgctcttcctgaaatagggggatcagttcaccctttatgggctcttggcttcgggctggggcttctttttgctggcgtcactggctggatccaagtttgagaggaacctgccccttcatgcattgcaggtctccaaaggaggatggctgatggtcaaagcttagggtaactagatgtggactgatcaacccagcccctcattgcaatctacaatgcccagcagcagtccccacacacaagtccactttgtagcctcctttttctttaaatgaaatgtagatactgggttgagaggaagcagataaggcctatagaactgaacttggttgaagtggttctttctttaacttgatggagaagggaaggccattcatgcagtttcctccgcttggaatgctttattcttcttccaacatactcctaaagtactcctactcaagcttcagctctcagctcactagttacttcctcaaggaagcctttcatattctccctgactaggccacatccctgcttattatacacctgtattagtccgttctcacactggtaataaagacatacccaagactgggtaatttataaaggaaagaggtttaatagagtcacagttccacagggctggggaggccttaggaagtttacaatcatggtggaaggggaagcaaacatgtccttcttcacatggcggcagcaagaagtgacgaaaaaaagggggaaaagccccttacaaagccatcagatcttgtgagaactcactgtcacaagaacagcagcatgggggttactgcccccatgattcaattacttccctggcttcctcccaggacacgtagggattataggaactacaattcaagatgagatttgggtggggacacagccaagccatatttggccgtggagtccattggactccaaaagaaaaatatttgtttattcattcggttagccatttattcaataaatattcaacagccacctactctgtcaggcatgtgctaagtccagatgcaaataaaatagaatggacccttttctcataaacactcataatctgaacttatatttttgaagtaatttaaagacgcccattaaatttatgtatgtgattaagtaatgccaggcacacctctagataacagactccacaaagggaggaaactgtgtccccaaggcctagcactgtgcccggcatgggataggtgcccagtaaatgttggttgaatgagtggaattggaggaacaattacattctttccttctctgttcctgctcttctgagctctcctttacactgccacctacagcttcctggtcggagaagggagaatatgcttactgaactgaccctgttaaaactattcccatgccctgtgctcccccaggggatgggaccctaaagccgataggttgtcctcttgccctggccctgccctttgcctgtgcaggatggttcctcttgcattctctgggcacagttgttgatattacttatgggcactgatagtaggcatgttccccagcctgcatgattcagtcattgcccatgatcaggatttgggaaatgtgtcacacatctggacttcttttcaaactattgagattagataaaaagaaaggaataggatgggcgtggtggctcacgcctgtaatcccagcactttgggaggccgaggcaggcggatcacctgaggtcagaagttcgagaccagccttgccaacatggtgaaatcccgtctctactaaaaatacaaaaattagctgggcatggtggcaggcacctgtaatcccacttactcaggaggctgaggcaggagaatcgcttgaacctgggaggcagaggttgcagtgagccgagaatgagccactgcactccagcttgggcgacagagcaagactccatctcaaaaaaaaaaaaaaaaaagaaaagaaaaaaaagaaaggaataacccccttcacttaagcctggttgctttgcctaagaggttcaaatacgtgctgaggctcagaaaaacattgaactccaaaagaaaaagcattcatttattcattcagctagccattgatgcaataaatattcaacagccacctactctgacaggcatgtgctaagtacagaggcaaataaaatagaatggcctctttcctcataaacacacattccagcaaggataaccagctagtgaatggacaattactgtataaagtgatttatgccagtagagggtaaaccccatgataatggaagcatataggaggagcacctcttcctatgggcttaatgaggacttgtagggacagctaagcccagaaagggaggataggtaggagttagctttggtgaaagaaaagaggagaggaagtaaagaggagaggagagtggagggagaaagtgttatgagtgaagggattcatatgtaaagacctaacatggataagagctctttcaaatgactgaagacagagattaaaatgcagtggggagttgagtgtggagaaggcatagggtcaaaccttaaagggcttgtactccatgctaagaatttccactgagtttccagcacggggttaggaaaatgttgactactgatttgaaaggtcagacttgcattttagatagtatactgaaactggaaagtgggagagagaggaaggtaaagaggaagctgtatagaaacccaggtgtatggtcccggcagtctatgaaggtgagggcgggggtttcttctttctgtttcaatgtacagactctcatgggtagcgactatttggggccaatgtcgcgtgggaggtaaaaagaatttaccaagacagttgtaggtaaaaaagaaaataaaaggcagatttattagagaacatgtgaagatagattgcagtgaagcaacaggcaggtcagcaagagaagaaagagctgactgcaaggagacaaaggcttgctgggggctttataggatggagcttgtgctggagaaagctatgtgcagcactgataatgccaaggttgcagtgagttaacttgcacttttctatcagccgatggtctggtgatagctgggtacaggaagattgtgaattatttgcacaggagggctatgtgtcctggaccatgaaaacaggcagacttatagcttatctgctttctctttttgctttcctctggtcctgccagcctgacctcttttccctaattaggtctccagacaaaccagagatacccttctaggaaaaagtttaactaattttctctaatgagattggtttatgtttggttgtccatttgtgttttgaatgggccctctaaactcaacactgggcagatgccttaggggaaaagagaaagggctccacagagtgtgagacatatttcctggccaactgaactgcagagcaaagcaaactctcaaagatttgagatggagagatccgtgaaggctgagacaggcctgaagaaggagcctggaagggttagaatttaggtccatggagactatagagcaagacatctagacaggagactcacatgtgtatgtacgtgagtatttaaaaataatatggtgagtgaataaaagctaattctagaatccagggtacttggatatggcatacagaatcatatctaataagaagaaaacagctctgtttcatctatatgtaatttggaacagaccaaatagcatttactgccttgatatttggaaggacaaatagggctttcctagttgtgtgcaggaatgctgggtcatgtggggactagatctggaagtaggaccaaaagctgtgctcctgccatggcttccatgtgataatttccaaataactagacaggagaggacctcgaagtccaaaagaatgaaaccaaacagtgtgagcttcgtcagcattcttcctttgcaccctgatttctccactgggttcctcatccttccctgtcactaatcttagagtgaaaaacaaacgaacagaaacaaaacccttcatttcctgcacagtgcccaggagctcacccttgccttactttggtaaactgccccagttccatctcttatctgaagtgtctttcttcttcaacacagaatcctctccctccacaaactccatcttaaaaagaatatcacttctctaattccttttccccattatactctttccccatcatgccttcaacaaactcttgagattttaatcatttgtccctattttctcatcactcatccactcacttcccacttttctccaccttctccccaagtctcatccaacaaggactgctcattccccaaaatataatgacttattccaaagagctgcccgctgtcctccctctttctctctctctctccctgcaccagataatattgaccattagctccttaagtctttcctctttcagcttctttcacacagagctctctaggtctcactacctctacatggcccctcttccacttccactccaagattctctcctctctcccaatttttcctttctccattatcccttggcagtctccctgaatggtttgtgctgttactgcagtgtggatagttcccagagtctgtgactctagctctccaagctgggtgtcttgtttccagccgtgtgcacagtatctccaacaagatgtcctgttaactcctcctgaatttttactaacctgacatcatctttgtccttaggagcttctcctcctgacttcccactttctcttgatggcaccaacaaacttccagtcaccctggctcgaaacctccaagtttatatttgaactcctctcccttgttccccaagtattgcttgatgtattttataagcccatgcccctcttcttcatcccaaacaccactacccaagtgcagattttatcacctcttgtataaaaataataataatgtgtgtgtgtttaccatctgtcagctactctgttgcaaagtgctttacgttgattttcccatttaatccttaccatgactgtacgaagtacttactattattatactgtaaaaaacagctttctgccatcttcccaacttcaaccttttcctctttcaattcattttcatcagttacaagattcacctcctaaaatgcccttgtaaacttatcatttttctgcacaaaaaactttgaagggcattccattttttgcagttccttgtattcaaggccctgtatgagctggtgccccactccatatctagcctcactttttacagtttccttgccctttctgcttttgtgcatttgttcacagtttaccttcccctaagacttgtccttgttcttcagtgttcaattcaaatgcctctgcctgatgggaaggctttatggagaagctgtcccttcctcctgtgaattttaataatgtgacatctgtttttcattagccctttacactttctgaaatgcacttttttttttttttttgcgtgtggcttaccatccctcctggagcaagtgctttttctgtctcccactctatgtcacatgatgcctgaaatacagtaggtgttcaatgaaaaaatggagtgaataaatgaatatactccctcacccatgaagcaggtgaaacaaggtcaagaaaggggatctatactatttcctaaaataagacagtggtggagtcaaaattcaaaccagggacaggaaaatggtgtcatagaggaggcaatgaattggtgataaaaggttatgttctaattcttatcacttctgacaaccacaggtaagactcacctctgttctctgggccttggattccttatccatcaaaagagtttgtgttggatgtgttgacttttatgctcctccctgacctgacaattctgtattctgtgagtcttgtttcatagcatacagattgtctcctgctaagaatacttttagtgctgactgtatctttcatttcaggaccttccagctgtaacttgaagcctctagtgtatctgttatcacattgagtctctagagatcaacttggccagtcaactcagctgtccagccagtaaggtgccctaaactggttagagtgcctcaagggccccaggttggcactcctcaatgtgcagccaccagtcagctcccactgcagtattctagggcattcgcagaatgactagtagtgctctaggctcccaaatgttccagacatcctatctcaactcctgcacttctgcctttcatagagcccccagaaaagatgtgtttagagccatgtagattctgttgagagtctagtaaaaccactctgctcagtggctttctagatgctccacctaccccaaacataccactgtactctctccccagtgagacaggaagaatcctcttgagccaatgccttttagcccctgaaaagaaactaatagaggaatcaacctcaaggggaaatcattatggaagagcacatctgtgaaggtagtagctagatctgctgggagtctgaggaatctgctcctagcacccccttgtaataggaggacccagagcatccctagagttaattatacaaaagaactacccagacttgtctcagagagatgactttgactgctcgccaggttttatttgttcttcaatcaggcaatgatatgatttaattccatatttcaacatttaaaaaattaaaataaattaaatggcattaaaatacatctggcttctggagaatagcctgagaaatatgtacataaaggaggctgatcaccagcatcccttgatggctttgcaacagggcagaaggatgtcagcctcccccatgggtaacctcagaagatagagcccaggtggttctctcttggcaacagggaagggcaggaacgatgtcggcctcaggctgccctgggattcttgctcctttgactccagccctgacttcctttcagttgcaggggatgcttcctcttggtccttcccgacatgacacactccttcagcctgctgaaaggagacctctggcattcacagcacgaaggtttggttctggctccattatttattggcatagcaacactcagcaataaatgagccccaatttcttcttctgtatgatcatcctcataagaaggattaaataagatcctgtgagtgagaagttctttgtaaacccctggcacatagcattgtttaatatttattgaatgaatgatgcagtataaatgctgattatcattatgccatactctgaaggaaaagtgaggtgctaatgagaggactaagactgggagaaggggccgtgtttagaattagactcacgacttctgtccaaacactatgtggtcccattggttcttgagaatgaacaaaactctctgaactctgaggtcattggctttaaccatatacctctctaccctaaggcttgccaggaagtttgaagtctcttcctagatgcatctttccagaatcacttaatgaaaactcctgtagagtcattttgcatccactcagcaaatacttactgagtactccctctgccagcactagccaaggcactgggaatactgtggtgaacaaaagggaccagattcctgctactatggagtatatattctatgataaactagtaaaaaagcaaacaaaaacaatgatgatttcatcaagtgaatatgggctgtaaagaaaacgaaaagtgatgttacaagagagtactggagggggagattgcctttagataagatgggcgggggaaagcctctcagagagggggcatctaaggcctgaatgaaatctaaaagtgacctatgtggatatttagggtaaggttgtttcaagtagagagaacagtagatgcaaaagtcctaagacacatgcttgcctgttctagaaacttcaaagtatttcatctgagttggagtggagtatgggtggagcaaaacaaaatggtaggagatttgaaaggtcagcaagttagaagctagatgagaagtcagtagggggtggggtgccacagaaagagagaggatacaaagaattgcatgatctatctgatttacattttaaagagactttccggctgttttgtggagagtagattataaggggtggagcaaggttggcagctgttgcagtagtccaggtgagagatgtaatattaaatattaaatctccagcagctagaatggaatgtgacacacatttggcactcaataaatttgagaatgcatccaggcagaaatgatcttcaaagaacctacaactgtgatgggcacatagtaagtactcgaccaatactttcgttcatgaatcaatgaacagcatcatgctttcttgtagccactctagattaccttgaagttaatctcaatattttgggttttttacacataattcttatccttctagctagcattttttcttaggagcaatatgttccatgggttcattttatcctgtgtgaaactgcggtcatttgaaacagatctgagatgtctgactccataacctttaggcagtgttcataagtccccaaaccctttgcttacacttagatactgatctcatatacctttctgtgtgtcactcccgagggggaaccagacctgcttcatcagtgcatcttcagagcttatcacagtctggtctattgaatccacaaatggttattcccttgactagactgaggaacactctaaggccttgattgggttccatttgtcccacagttacaggaagtcctaaagctaagaagatatctaagttggatggttttgtgttgattccttcagctttcatttcttggggcctggagatctcaggatcgggatgaactttgcagggccagtggaggaaggggcctgatgtggtatggtccttgctaggcctcttcattcctcttcaccatcatcttctgtttctattggtctccaacttacatggattctcctttcagtgcctctgaaatccatgccttccccagcagcccttttcccactgccttggttcagttctccattgcctctcatcccagtcctgggagagtctggactggtcttcctgccgccagtcttgccccgctttcattcacctatcctgttcccacactgtcatcactctaggttgcctatccaaaagaaaaacattgatcttgtccctcctatgattaaaaaccttcagtgcttccttattgcctccaagagaatgcccacattccttggccaggcacacaaggcctcttaccagcgattcctcacttatctccacagcttctctcaagtctttcagccatactgctcatccttctggaaacagacgctgcttgttcgggcttccatgccctttagcatgggattcctgtggcctttgtttgagatgcactgtcttccacccaattaactcctgttcattctttaaatcctagatctaatgttagctggttcatgcagctggccccagtgatcccaagaggtactataccttcctttcttgtgatctcttggcactttgcacatgcttcaaaatctggtagttgttttggtgtaattatttggttttctgtcactgttctccagtgaagtgtgtgcttctctagagggattatattttgttcatattactcaaattcagaaaaccttgctcacagcatccctgacagatggttctccagcctccaagttgaacactgccaaagatgggagaactcactggatattatcccttctatttttgcacattcattccatgtactccttcattcaataaatatatactgagcatctgtgatatgccaggcactgatttaggcactgggcatacagaaatatcagataaaaatttctaccctcttggaacttataacttttttgagtgtgtggaaaaaaatgagtttggaacaaattaaccttctcagcataattcagtgaaagtcagcctgtgacacataagctgggtttcatacaaatgcataaatgcatgcatgcatgaatgaataaatgagtaagtgagtgaatgaacaaagaggccatgaggaagtgtgaagaagtagacctaagctattatcagtgaaaggaaaaataattagaaatacaacttgctgaaaatggacgaatagcatcattttcctacaaagacaagagaattatggattttttatatttcatgagtacaagtataaaccaagtagacagcaagtttagggaaagataaagggaaaatctgcttatgtgggtagagaattgatgctgactattcttggcaaggtatgaaaggaaatgagacttcaagaaggtgagatgtttgtccagcgcatagaaatgtcttgtggtacccatttgtgcgtcaacgcatgatctgctatgagtccttctctcagtccaaagaaagtctctaatggctggaatacctgggatgcaaatgtcatagtcaggtgaggttccttctcttctctcccaggattttcaaccttgtctgtatcttaaaatcaataaaagaacttttcaaaaacataagtatttaggctcctctcccagagagttcaaaacttaggtctggagtaggatctagatgtctgtattttttagaactccatggttattcagatgtacagccatctctagaatgtgatcctggttccatcactgtctccaacaggaggatgacttaaacgcagatgtagacccagccatgggaaaaacaaaacttaaattaagctgagctaagccctgtctcttcctagctctctggcccactctcagtgtttgtaactccccagatctgtcaaggatttggagagggcaaagtcctctggtttacacaagtctagcacatttcaggcatctttgaatcacagaattttagaggtagagagggttatcagaggtcaagttcaacctcttagtcctatcaatagagtttcacagagtgtgatgatgcatttttacaaacaaaaaagcttcccctttgggagggtgaggtgggcggatcacttgaggtcaggagttcgagaccaacctggctaacatggtgaaatcatgcctctattaaaaatacaaaaattagccagatgtggtggtgcacacctgtaatcccaactacttgggaggctgaggcaggagaatcgcttgatcctgggaggcggaggttgcggtgagccgagattgcgccactacactccagcctgggtgacagagtgaaactgcctctcaaaaaaaaaaaaaaagaaaaaaaaaagcttccctatattgacttgaaatttttcatagagcttccagaagagtgtggaagatggataggtaaacagataagcccagtacagtgtgacaagtgcttcagggatgaccaaagtgttagaggaacccaagagaataaatgactcactttacaattagaggaagatgcattttcggggaaggcttcccagaagacacagaactttctggagcccaaagttcttcacctaagggatcttgatccctagcctactcttccaccatccctttcatctcctggagcttaaaagcagactttagcatttgacacaccaagtttcatagcccctctttgccacttgctcagctggtagaccttgggtaaattatgaatctttgaggcccctatctcctcatttctaaaacagataacaagacatgtctcatggtgggtttgtgaggtattaaataacagatataaaagtgcctagagtagtgctggctatagagtaggtgcctgatgaatatatatgatcattgctgttgtcatcacttttttaaagtccttggtccatataaagaatgaggagacggaggcctgctgatgccctggtctgtctaggaagctttcttttctcttcttctgtagtagtacctgggagagtgtcagcagggtttcatgaaactgtcagacggttcagaagtcattaaaggtctgagagacttcagagaaggcaaaatatgacaattgcatgagatcagagaagcaagaacagtataatattatctcacatacgactgcaacattctctacattaaaagccctgctgcagtgcagccactgcccacacgggttgaggcatccgtagagccaccaacctgagcgcttagagcagcagaagaaaatcatattactttccaagacatagttgtaatcaattattccaataattacttgtttgtctccacccctcatcagaaaataaactctcagaggttggagaagtggttcatggctgtacctgcaattgctagcacagtgtttggccttaataggcaaaaaaaaaaaaaaaaaaaaaaaaaaaacaaaaaaaaaacggatttggtccaaggggctttttggtaaatccagaatgtaggctctccttgacttttccctggtcccctcttcctaccaccccctcctagcttattctcttatcctctgaggtctctgtgggagtctaaattccacacctggctttcacgtggctctgggcccatctaacataaaatgtgtcccttcacttctttcctttcctgtcatcaaagcatgtttgactggaaggaactatagcgatcatctaacccaacctgcattttatggatgaggaagctgctgccctaagagggtcactgacttcccaaggtctcacacctcattgaggcgaggctggaaaggaagttcttgtccattttcaaatccagggctctaccatggatccattctgcctgtatgtagagcttccaagcttgtcgggggcctccacatctagaaagactcagcctgccctccttgagcctttgctcgaaggggcgctcaaacctagggtatgtgtcaagcacagtggtaacagcatgtgtcctggaggtggactgccagaattcaaatgcttacctttctgtttactaactggggtcttaggcaaattccctaacctctatgagttccaatttgccatctctaaaacaagtgtggtgataatagcacctccttcattgtgaagattcaaaacattaataatgcaagaaaaacatttaatatcattatattttcctccttggatacaagttccagttgtggcaatcaagctacctaagcagcagaggtcacatctttcctactcttgagagagtcaggagcttcattcctgtgtctctcgaggagtattgccgaggacaggactgcactgacttccacccaccggaggcagaggaagtgcaggagaatatgcagtgtgcttggactcgggtgacacaacggagccagtgcagcctggctggacctaaaacttttatgtaaattggctatgacacctgtgcaggggcccagatttagaagcagagtgggacaactctacccaggctggtgacatgcccggagcagtgttcccattggagaaagtggagggcatagcaggagggagaatttgctcagtctgtcctggtggcactgttttattaatgatctggaagagcggaggaacggtgactttaattaaatttgccagtgatattaaaagatgtcaggagccactgctaaggacacagacgccttgcagatggcctcagaggcgttaggaagatggtccggaaaagggatgagaggctcggggctgagccagggcatcagtttgactgagagaggggagtgtgacatggggacagacgggcatcatgagcagaatctacccaggcccaccatgcttgtctgtatctgttcagtttgcagtagagttctatctgaccttcctgctcctgtcttgcccacttacagccatcctaaacccttaggtgaaattggtatttctgaaagacgaatcataccatgtcattctttggtttacaaccctatcactggcttttcattgcccttagaataaaaccctgtcttctcagcttggcatctaaagcttgccatgagtgaagtcttccctactgtctagcctcatctactgggcctcctgcctcacactgcatgtcttgtaatcccacgcccacagcagccttttccatcatgtttccatgtctttgcctttgcctgggctgttctctttgacttgaatgcccttcccactttccttttttttgactaaagctcactcatgcttgaagtctcatttcaggaatcacctccttcagaatgcctccctgaatccccaggctggctcagtgccctcttcacattctcatagcattctgccctacctcctctttttacaataaaagtgtttatttgtacatctgtatacttctgctagattgtacctttgagggcaaacgcggtgtctctcttttttttttttttcttttttaatccaccagcgtctaataccaggtctagcaaatcacaggcttttgtcaatgtttgtcaaactgaactgatgggaagaatatttggatgggaggctgcagcaggcagccagaacaaccccagtaagcctgggaactaggcatcgaaacagtaagtttctcctctgagcaggtgtgggacagtcaccttgcttctaagtccacataagactggaaactgattggaggccgtggacattctacaacaaagtgggacagcttagtaaaatagggtggttaaaaccatactttatgtcatctgtctgtgaattctagttctactatttcctttgtactttgagtaaatgacttaggtaagactcagtttcccaaaatataagatagggataaaaatatttctaacctcatagggttgctatgaaaattaagtgagaaagcactcagcattatgcaaataataaacacttgtagatgcgaattactgttattaatgtctttatgatttggggtggtcctgggtgggggaaaagatctcaagttgagtcatatctctgagtatgcctcggggttaatagccttctggaaccacagaagattatctgggtctctaaggggttgagctggacccccaagatgttgggatctatctcaattggtgtctgggccggggcaattgcataaaaaatgacgactggcttggtcattagagatgttcctgctttctctaacatctcagccagaaaccatttcctggcagggctgcaaagaggaactaggcattcacagggcattttccaccttcaatttcaaaaactgggtgcctgcatttactagccatctcaccgccttgccttttctttttctttttttgtttttgagacggagtttcactcttgttgcccgggtgggagtgcaatggcgcgatcttggctcactgcaacctcagcctcctgagttcaagccattcttttgcctcagcctcccaagtagctgggattataggcgtgcaccaccacgcccagctaattttgtatttttagtagagatggggttttgccatgttggtcaggctggccttgaactcctgacctcaagtgatccacctgtctcaaccttccaaagtgctgggattacaggtgtgagacactgagccaggccttgccttttttctttaatcttttccttcagttcatttattttctcatggaatagtctttttaaactggcctctgattctgatcatatgatagcacattgcccagaaaaacctgttgccacaaagcgtctacagggccaaaggaaaacaaagaccgtcatcctccttaattctcctggtccataagataaatacgactccaagtcccctgttaatcaggatgattctaccatcccaatgttccatgtcctttcactctggaagaccggctctcttctctcccccatggatactcaccctcttgggattggttggctctcatagcagccacctcctgtcactgggttggcacttgaagaaagagctactcagctgtgcctaccatctgtcatcgctgcatggggctcattggaatccacaaagtgtcagggttttcagaggtcaaagtaaagagccaaggtccttttctctccacatttctctagggtgggtgagtgtcaaacctctgaatgaatgcctttgtgcacatcattgatgacaagagctttcttaacctttgaagatggatgctgaacatcttcaaccactctattcctccacagtcattcccataacctcttctcctctgagtgaggtcaaaggcacaacaggtcccagcacctgttgtgatgcccccagcacctggactaatggagaatgtgggcttcagaacttggctgccactctagggattaaaccaagtaaatcctcagctctttgggagggaggtcttcatggggacaatatgcaccctgatgttttgtgtcccgaagagaatttctctttgagcacaggctttggaaatttaaagaggtcccacatagcctctaaaatccagtctggttttgtctatgaaatgtatatgtatttccaaagcaaatggctacaattcagataaaaaataaagaaggctgtcatccaaggaagcttcattggtgactacatttattcattccaaaaacatacagttactgagaacctactaaccattcaggataccatgataaacagaagagacacagtctttgctcttatgtcattcactgtttattggatgagatctaaagcattattaagagtggggagtgcaaagaagaaaccctcatttcaaagatgaatgagaataatggcatgtacaaaggtcctggggtggacagtcacttggtataatccaagagtgaacctgaaggctattgttgttgaaatgtaataagggagagagtgacgggatgaagggggatgagtgggaagcagtgaattcctgcaaggctttgaaggtcatgggaaagaatttggtctttatatcaagagcaagagaagactactaaagggcttcaaacaggggagcgatatgcttaagtctgtttgtttgtttttttaaaaaaagattacggtggctatatgaggaaagtggaattgagaactagtgagagttggagtggtgagctccattaggaggctactgaagtagattcatgaggtaaggagtgatggtggcctgggctgggatgatggtggtagaaatggagaaagagttgataggatttagtgattggataagggacagaagagagatgaaggctttcagactaacatctgctttctaacatgagtaactgggtggctgaagatgctattttctgagctgggaaacaggagaaaaaggagcaaatatgggggatgaagactttgagtctttaaggtgctgtacaaacacaaatcagcattcctttattactaagggtatcccacacagttgtagcagagggagaaagatcgcccccccccccacttttttttttttttagctattccatggtattttcattctcatcccacccaaatgaggcagtgagtggtaagatgagtatataatagtttcaattgcatttcatcccattcttctgagctcaagctcaccttttagtggtttgaggccagtagatgaagctgcatatcacccccaaaatcttgtctctagtttaacaaaacttatttgagagacatttgcatgttttattaataatgatttttaccacttgttcctttccatgtttgggtttgaaatttgagtggctggcggatgatcatcttcctgttactgcctgcttaaactgctcataagcaggttttactggagggctcagagctgctgtgaacttggtcttgggcacaacttacatggcctctgtttggctatggggtgggtggcattcaccatttatcaactcttttgatttcccaagctatctcagaattatagcttgcctccagaagtcttgcattcggggaggaagtttctttccaagggagctcagttttcaaggtttattgctctgtttaatggatgagatctaaagcattattaagagtggggagtgcaaagaagaaacactcatttcaaaatcgattgagaataatggcatgtacaaaggtcctggggtggacagtcacttggtataatcctggagtgaacatgaaggccaaggaaatatgtatacattaaacagagcaaggttttcaattttctggggactagtccatgaaaattcaattcaatatactctcttgcaaacctatgttatccaagatactcaagtataatgacaacagggtaaggaagtccgaacaccccagaaacagtataaatgggcatgaagattcaggttatacatggcctattttaagttgcttcttgagaactctcacaggtaataccagtttgggagacaggacttgaaggctattgctgcatttccatccccagtattcccagctatttcaagccatttttcaacggagtctccaccagatggtttggaggacagagcagctatttgtgcctcccattgacatctatttttccaagtgagagactgccccatatgttagtgcaatatgtcactggaggtgaagcatcagttgtattggtgggaacctgccgtttgctgtcccctttttcctcatgccttttcctgcctctctgatcttttctaggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgtaagtaaccttcctgtattctgcccctccctgaccccatcttttgccatctctttctgtctttctgtactgcactttacaacatttccttgtgtttgtgttaatgtcaaactttggttccatcacaggtatgcaggatcagcagacaccactggacaggttctgcttccaaactcttcttcagttttctcactttaaattgtttctgggcaaggaatcctgtgacaagagctaaggacacaaaacattttcttctctgaaacacaaaatgatagctggtggagctgtgggatgacagaagttttgtgatatcagattttggagaattcttgtgactaagaaggactagagaactgcttgggcctcttcttcctcccttcctcatatgaagggtatctatgagctttgaaaccaatcctttccattctgggcagcaatagcccatcagaacattctaaagaaaacaagtggcattggctttgttccctggtactatattgccagtctcactgtgtaaccagattccaggcacgtcttctttaatttggaaattgcaaaattgatagaaatttagcaatctttttaaatgaccatagactatttaatggtgtgaggcttgcccagcctagttgaattgagtcagtatggtttggatactggaaagtatcttggagaagcagagctcccagggcagtggctacttgtctttagtcacaggtctaagctccaaaatctggtgaagcagtgaaggagaaacatcctaggaattgtgggaggaaatatatcttctgtgtggtcctctcttttcacagtctaggactctcctgaagtacctcttcttgggctactgccccattcagcccttcagaaactgtgggtattacacttctgtcacctctattaccctaaggcctctgcccattgaaccctcttgcaaattggttattctgtcctttttccagttggatagctttaaaagggaaagcagaatgactttcctcaggatttgtagcttatgagaaagtagactttcttgggtggcctagaaggttggagaagacaaacgggaacttcctctgaatgactgaacatatccacaaataataagcgtggcaggagatggtgtgaagagtaaaaggagcatataggaagttgtgtgtgtggggtgtctgtttcaagaacctgctaattataccttcagtaagaaatgaagccatacaacctctagaagaggaggaggaaggaactcatggaaaagtggggagccatagaagctagggagaggtgtcctaggagtgcttctgcccaggtccagccatgagacagagctcaaaaagagctgggcactgctggtgacagaactgagtgacccgggggatcctgcatctgttcttactcaatcccttcttaataatgtgacttggggcaggtcatttattggttctggaacttaactttctgatatgcaaactgggaataacaatactttccttgcctggaggcaaggtcagtcctttttgcagttccttccagctctaagattttctgaaccatagacataagcactcagtgtaggtcatattcgcacttgccaaaaatggatcaggggatattgtctcctgaagggaaatggccattgacaaattgatttattagagctctgtttagtcattttgctgggaaggataatcatttgttaacgtaagtagaaacctgtgccttctggagaatactatccatttatatgtactctggggagagtgtttatacatacaaatgaaggacagggcttcactgggaaaacaaactccatggaatttcacatgattatcgcgatgtcagtgtggaagaagatatggtaaggcattaaatgacattaagaccacaaaatttgccataatttgacggacttgtggttcttctgattcagaaccctttctacccatgtcacggataggtagtttttcagagatcagaggcttagttcattctattaatttcctcattctattaataatcaattatgcacctagggtctctgaatacgactaaaccttcctcaaacttatttgcgttttcagtttgtataatatcttggtgcaaatgagcctcgcaaatgatcacttctgggtaatactcattctaaaggtatgtcaaccttgagaattctggtctagatattctagggtttggtgaacaaatctatgttcccatccatcccttttcatttattttttagacttcattcattgcagaataatgagtccaaaacctgctcatctgttctcacgtggcacccctattcttgatattttaaattgcaattttacaactagaggcagtattacggagcagaaaaatcgtgggttctaagtactctgggttaggattctggctccactactgatttaataatgtagtttggggaaattttattaacctatgaaattatttcctcattggcaaaatggggataataatatctctcttgcagggccattatgacgattcaaggtattgtatgcggtgtacctggtacacggtatatgctcaggaaacaagactcttcatagtaatattgacgaattaacaatattcttcagaagacactgtggagttgtttaggttacttggctctttgtgtgaccctaagtaatgagcatgccagtttggggttactatgaagagtacttacctaaactcataaaatattagagctagaaaggaccttagaatatcttctgcagtcatggttcttaaattttaatgtgttgctcaatcatccagggatctcactgaagggcagattaggatccaggaggtctaggggagggattgagattccgcatttctaacaagttctggatgctgcgggccccaacttagaggtgaaaggttctgaagctcttgaccaaaccaggagacccagcaaagaagtggtttttcagacaacttgcttaattgaataatgattgtttgctctttaattccaactttcaacgccaatttagcaagaaccagaggctgtgctaattgccacaccagtctggaaaccgaaatggatagcttcagggtacttggacaaagttggaacatctgctttctaatctctccctctttgtatagctttatttgcctaccaagcctggtagtattgaaaatctgccctcactatactcccctaaatataatcaagttgaggccaggcctgtgctctatcaataatataggatccacgaattcacatgtttggttttatgctttacttcttcaaaggtgcttttagcagcatggaagaatggaaaagcacgagctttggaatatgaaagcagatgtgaatccatcacttaccagtaacttttaacaagtcacatcacttttctgagtaccaggtttttgttggacaacagaaataatattctctatccttcaagggaatactaaatataagtatgagaaaaatgcacagtgccttctcgtagatggtgttcagtcattcaacaaacatttgttagatatttgctatgtactagctacattactaggcactggggttaaataagtgaataagacaagctgacatttcagcgctcaaggatcttactgtcaagtggagaggatcaaagggtacagacaaatcaaggaacgtgagagaagtggtatggctgagatggattgaataaaggagcaatgagagctccctgcaatgtgtgtggtaccactgaggattctaaattaaccttcattaaggacttagtagtgacagaggtgaagtggggataggtacatgattaatttacatccatattacaatgaaaccttaacatttaagagggatattattgatgtcttcatgatccagaagaatcctcacctttgcaaccatcactatagtcacttcttgagaattatggcctttaagactgtagcatgcaatgacaaaacctcacagaggtatgggttctgcccgcacactaatttcactcattaaacaagtgactggctcctatatcccaggctctcagcacgcctttgcaaaataacagattattgcagctcttggacctttgatgcctctgggaatagtcaaagccacagatgtcaaatatgtaaatgccaagatctattataattaaatagtgcaggcctccttcaaagaaaaaaagcatgttggctgtgctgcacgttctccaaccaaatcagaatgttaaagctcgaaggtatctgacctcccattttttaaattatgaagatgaaattcagaaagggaaggtaacttatccaagattacatggctagctatgatagaaagttagagttggaaaggacgttagaaagtgagggtttgaaaggactttagaagctgcttattcaatgttctctctgccctttcccatcttaggcttctccattttacttttatccatcaataaaatgttaacttcaaaaagaatatggcaattcttgggtaaaagatgctctggaagtgtgagtccgggagtattatgtgactaatgtcttaactaagaataataatatattatggactagttttaatctcttgtttcaccttgaactgttcaggaaggaaaatagcccacggaaattttttaaaaagtctttctctatctgaattgagaaaaggtgacaggcatagttggaacatcttttaggcagtgctggtgaacttcaggctaggccttgttccatgaaataataaaaattttcaaaataatgcagaccattcccttccagggatgctttctctgtaatgttttaaccccaagaaatctttctgtaaaaatctataaaaatctggagtgttccaggatacaatttgcacattctccaatttaactaaaacacaatcgattttttgttttctttttctttggcttagcaaggttttaagatagtctctttctggccacagagggagatgatttgcctctagaataccctttctgtgcttgagagagtcacaagactgcaagctcatggaggatgagagtcaagtagaggtggtgacatctctcccttggccaacatccctctctttctctttccttctgccttcagtggcagtagcaaaagtcctccttctctttaggtagacagtcagccactacaactgtggcttcctgaaatcctcagtggagctgtgtacttggcacagatttgtcttgaagaagggactccatttctgagccagttgttgaatggggatacttagcagtacagtgaggcatttccagtaggattgttcaaccacaattgcccactttccaggcccaaaggaataattgaaggctatgtagacttttttttttttttttttttttttttttttgagatggagtctcgctctgtcgcccaggctggagtgcagtggcacatctcggctcactgcaagctctgcctcccgggttcacgccattctcctgcctcagcctcccgagtagctaggcctaatatatatatattatacatatatatttatatttatatatatatataccaccacgtccggctaatatatatttatactttttttttttagtagagatggggtttcaccatgttagccagtatggtctcgatctcctgacctcgtgatccaccagcctcagcctcccaaagtgctgggattacaggcgtgagccaccgtgcccgaccatgctatgtaaactttttagcagaagctttagctattgtgtcccgaagggccccaggtcatgatgaaatgtctttttttttttttgtctcttttcttcttaattactgagactgtcaaagaatatgtcaaagcatgacatattccaactccaggatccataaaacaccccaagttctgtggagaccctatcacatctgcaaaactctccaggaagtccagagccctcctggttaatttgttttagggactaggcatgcggtatcccctgacaacactggatcagcaattctcctacctaagtcagtcccacaccatgtgcagcagagtatccagtgcccctgccctggtctgctcacattggtttgctctccagaataataattcctcaatatccacaagagattgattccagaactactccgaggataccaaaaatcctcagatgctcaagtacctggtataaaatggcacagtatttggcatatgacctaggcatattctctcccatatactttatttatttatttatttcgggacagaatctcattctgtcgcccaggctgtcactcgcttattgcaacctctgcctcccaggttcaagcaattctcctgcctcagcctcctaagtagctgggactacagacgcatgtcaccacgcctggctactttttgtatttttagtagagacagagtttcaccatgttggccaggctggtctcaaacacctgacctcaagtgatccgcccaccttggcctcccaaaaagctgggattacaggcgtgagctaccacgtccagccccccatatactttaaatcatctctagattacttataatacctaatacaatgtaaatgttatatagttgttttaatgtattgctttttttatttgtattgttttttattgctgtattatccttttttatgttttattttttcaaatattttctacccgtggcacccacagttggttggtggaacctgcggttggtggagcccatggatgtgaagggctgatagtatgagaaaactcagaggtgcagagttggagagcacatcggggagaatgtcagcatgggttaaaaaagacacactgtggttggagatgatcacatgaatggccacttcaaaaatgaatgggtctcatcctcaaagcaggctctcctgggcactgcttgggaaggtgctaattggagcttcaggcaacaataataaggggatacaggtggggatcctgccatgggcgtagcttactttctctggactcttctgggtcttaaggccagtttcctcatccactcaaaagaatgacagcaaggtgagcaaagcaaggcaggtaaatgaggaggactctttctggctgtccaacttttcatcaacttcccaaaggtttttggatgggacatgaacactcattccttctccaccctttagctaggccctgtcaactccaggaggaaggtagaagaggtcagagctgtggtctttcacttattcaagatgtttccttagtgttttgtgtttgggttttttttgttttttttttttttgacagagtcttgctctgttgcccaggctggagtgaagtgaagtggcataatctgagctcactgcaacctctgctttcgagttcaagcgattctcatgcctcagcctcctgcatagctgggactacaggcatatgctaccatgcctggctaatttttgtatttttagtagagacggggttttgccatgttggccaggctgatctcaaactcctgacttcaggtgatccagccaccttggcctcccaaagtgctgggattacaggtatgaaccactgcacctggccccttattgttggtttttaaaagagaaactaagctgtgcttccagaacccagtttgagaaagtttgaagacctggcatagagccagtgacatataattgttagttgaagaaagagagctccttgatctgcaaatagagcacggccccatatttaaattctgcacattctagaagcattttgcaagaatcaaatgctttgaggattttgctaaataaccatggaggaaagcactagacaaatattttcagatggcatgagagttatcattcataggaattatatttccactcctaccacttactggggacccaagtaagaaattacttggataagcagaggagaatttaaagttgaatgtggtggaacttattatggaaaaaatatgtttttctgaaaactggatatgtgtatatatataagttcagttgtcattttggaaccatccttactcttcctagctaaggattaacatacataggtgcaacttgactaactctgcctggacccaattcagttaccttttggtgggtagggttcatgaagaagcagttatttgtggagtgtatagaaaccactctattgtaggttctttagttggtactttcaaaataagtgacatccaaatagtaacttaatattccaaatatggctgcaaaacaaattgtcgattatggatgactactactgccatctctccataccagtccatcttctgccaggctgtttggtcttgatttgtcgaccttttaggtttctccccatgtattccacatgaccttcaccaaccccacttctatctccaaacgtctttctgagttgtggggatgcagatgtattctgccaccatcacaagggctaaccgagccctggctgcggatcttcattgttgttcacattatttccattcttacaccctacttcatgtttgtacactattttcttacatttgctgtctcttctaaacattctttgctgcatccactttttctctatttgtgctctaggtgctgcagaggctaatgctgggtttcctttcattcctccttgcactcagcacctcccttctcaattccttttgccatgtctccactttaaatcttaacctactccagatagtcttttccttcacactattggcatctgtgcttgggttgctttcagtctattctctgatctatgatttctttgcatgatcaagaaggtgccatgaaaggatcccttaagaaagcctgtcatttagccagaacgaactagcttcatgatagcaccaggaagactgatatctcccaggaaacaaaccactcatggtggtgctctttttgccttcactatgaagtgtttgtctgcctgtatgtgaaaacgagagggtttaattgtaaggatgcagcacagattgggactggcatcagaaagccattggggactgaggtagctctagagaccgctttctgtctccagtgctctccctcctgggtgacatgttttctgtctcctggcatctctgcttctctctatgggcttctttattatttgcagcttgcaatggtaccccaaagtcctagctcatggctcctctctgcatatatgctttctgttcctacccacaaagctctttctattcttctagtttaaattttcaagagaagaaatctgatttttttttaacctggtcatgtcaaagaccactgaccacatatgagctggttgccctgtgtcaagtgcccccttctcccaccctcttcccctccccatctggtctgtcataactgaatgatggagtgggaaattgaaattgccatgggaattccatgataagctatctaaacagttttatctataagtggtagacagagtcacttagaagggagtcccaggtgagacaggcacctgtcaactccaaactggcacacattctaaggtctgcaacaccccagagagagcactgattttgtagtggcctgtactggggcggtaggctggagaatgggagaaatagccacttcagaatcccccagcccaaatgcatcaagctcactatagactctgcagccacgattcagctggcttctgctcagatcaacagaaaacattcttagtgaatgatgcttgtggcacatatctcaaggctaccagggtcatttcttcccatttactttttctctgatctatcctctccaggacactagcgtcagaagataatcttccgtcgttttcaggtacactatttgggtactgagtcactttcaaagcctctttctgggtttggatttccagagcagcctgtgctgtaaagcaagacagaaagcttccctgccattcatgcctgccagggatagaatgacagtactcctgaggctctccctccccacccctcccctgctggacagctgatctgctggactcagccagagccagcaggcaccccctctttatcctaggagctgcaaacttgatgcctttccaggaaatccccagaagctggagtatcctcatctacatgtggcacagtgtatggttgtgtcaggtgctcatgtcccattgcataggactggggtggaaaatagggaccgtccttttgtgtcagctccagtcaatgagtagtggccatccagggggccatcttggaaaggacttgtgaggctgtatctgcgctcagttgtagatgtgagaagaaaaggccaaatatctgccaatcctagtcctgggattcaagatagaaagaactgcatggagtgaagaaactaggagtctccatttcactgagatgcataagaatgaaattattgtcactatttcttcaatactgggccaatcctaataagaaaaccctttttgagtctctcttttctttatcctacatataacacagaagctttttctattccctggatgaacccacagggacagaaattcttgttggacaggtgaagcagataatttctttatcagactagaatcttccagaagcactgctaacctagtgagttttgtactctagacaggtggttctcaagccagctccccaccgcaggcctttttcatggtctgcccctccctgtggaacccatgttttaggttattagctgataattggatttctattttttctcataaaatacagcaaaagatagctagtgatattatgatgagttaatgtaattatagccaaagcagagagaaacaacattttaattaacctgtgtggactgctggaagaatataaactttctattttgggggttgagtagagacagaaatgaacacagccaagggctgactgtcagaggacatttaactgatgtaaaatgctttgaaattattgggcactcattgtttaaagttgtttttgatgatggtaactccgtaaggggatcagaacatgctggaaagaatgggcacagctttggttacctgggccttaccactgttattcaggcctctgagaaagcttactattgttgttatgtttcttacataataaaacttctaatatttgtatgaaaacatagaattccacttttaaagatgtaaggattttgtcataccattagggttactatgatcacttgattctaggtctaagaaatattaagtaatttacccgcgaacacagagttttaagggtaagtatcaaaaccttgatcttctaataccacatattctcactcatatgtgggagctaaaaatattgagctcaaaaaggtagagagtagaattgtagttattagaggatgcgaaggaggatagggagaggttggttaatggatacaatgtgaagttatgtaagaggagtaagttctagtgttttgtagcactgtagggtgaatatggttaacagtaatttagtgtatatttaaaaaaaaatagacaggattctgaatattcacaaagaaatgataaatattcagctgggcgtggttgctcacgcctatattcccagcattttgggaggccgaggtggatggatcacctaaggtcaggagtttgagatcagcctggacaacatggtgaaaccccgtctctactataaatacaaaaaattagctgggcatggtggcgcacacctgtagtcctagctacttaagaggctgaggcaggagaatcgcttgaacctgggaggcagaggttgcagtgagccgagatcacgccactgcactccagcctgggtgacagagtgacactctgtctcaaaaaaaaaaaaaaaaagaatgataaatatttaaggtgatagatatgctaattaccctgatttgatcattacactttgtatacatgtgtcaaaatatcactctgtatccatacatatgtataattattatgtgtcaactaaaaataaaaggaaaaaaatcatttcagtgtatttacaaaacatatgtaaccattaagaataatgttttaaattatatctaagggtgtgataaaattacagtataagattgtgcttgaaaaagtgcaataagaagtaaatatgtacagatgagaaaaagtgcaaagaactaagtcctaagcagactatacctttcctactgcatggtacttctctggccttttgctttgaaagattttgcacccagcatggcaagtggttagcagaggcagccattctcacttgtgcgttggctttgggagccatatatgttgttcagctgggtgtggagtggaaaggctgcatgttgtattaatgcattgttaagaacctctaagagtgatttcttttgggaagtgagactgacggtccgaatggtggaaagacaacttttaatcttttactttacactttgtgcacttttaaatgtttaacatgagcatgcatttctttaataataaaaatacaaaaaaattttagccctagatcttctgattttaaactgcatattctttctattgtgttacatattttagcatgagaataaggttatgaagctggaagtagcaggctcccttttcctcatatgtaggaagttaagaatgcattctacgtttcttctttaaggagttggcttctttccttttaacataggggtaactgggcccagggagtttggcaagggccaaataaagtccttaatgcccagctcagaaatctggattcaccatccttgactgctggctccaacccaccctcacctgagctggtctgcagaggattcttgtttgtgtcacttcatcaccagcaactaccgacagatgatgctttggccggctgcctgggtaacagggcgaggctggctcaggaccatgttttcagatcaggggacctcctttgatgccatgtccatggtgtccgagggcagccaggatcaagggctagacggggcagtgatgagatgagagcaggaggggctcagctgcagccccaggagagcctatgccagccctgttgaccaaggaggacagaagcaacaggagagcggaggcagaggggtgagtgtctatcgctcaatgtataatcggcagacatttggggagctcatactgtgggctaagcacagggaagaaaggcacagtccctgtcctcagggaggtcacagttgatagggaagacaagcatatgtgctagctgctatagaagggggaaccactgagggctgtggccatacagaggcaacacccccttcttgtttttttgtcagggattcagtttggcgtcattagaagtgacttgcacaaccccctcctccagtcaattcagaaggacttgttaagcaggaatgatgaattagcttcagcttgtggggcacacacagatggaagtataaggtggcctcaggagtaagtaaatccccatgcaagctgtgtccttagaccagagcagcacccggttcttccccatttctagtaaaggtgcctcacacaccaccaggacacaatttatgcctgcagaatgaatgaatgaatgaatgagtgaattcctggaacctcttctgcttatgtgccacaccaggttgcagcaagcccagggacacctgggactggaattgggctctcaggtgtaaggaccagggagcacccaccattttgcattcttcagcccttcctcctctcctgtcccagcttcagcaatatccacagagccctctgagcaactctgagcctctccacagcctgacgcctgcctgggcaccagctcttcagagggtgtttctgtgctgctcagctacctctgagcctgggctgcctttgatgctcaggagacaccctgtaattcaattaagccttctctccagggagcatgtaattatgtcctatctgggccttgtaatgacagccccctgccactctacagggagttgccctgctcagctgcccagaacctttccctgggaggaaactaatctgcttagcccagattggacgcagttctgcacagcacttttccgaatgcctctgaaatgagtcctcactgacagaacgggcccactctgggggaactgagggctctcttggtcctgcactgctctttgccatacagatctgtctgcccaggatttttcttgggtgtgtaggaggctgagagagctcccctttcttctcatggctaaatcccttggtctttccagccctcctgggggttagaagggagagggaaaaaaaaaaagactgaacttgttgttgttgttttgttgttgttgttgtttgcctgttttctatgttgtcttgtggggagagggtataagattgattgacagagtggcacacttcccctgcaaattcatcatttgaatttctcaggtaagatgttcacatttctctgttaagatgctccaatttctctggttaagatttctctggtaagatgctcatgaattggtggaggtgttggcgggatgtgggaagtgtgcctgctctttctgagttttgggggaagttgccttaattctctgcatgactttctttgctcctttgggcttcatttctgtgcaatgtagtctgacatgaatactgctcagggaggtgttgcttcccactgcccacgccactggaaaccagtagcccaggtttactcgagtcctccttttgaggaacccaaattctttcatttcttttatgtgagatctgcccaaaatgccattggcaagctgtactgggttgaatagtgtccttcctcctcccaaatgtatgtctactccaaaccacaggatactaccttatttgggaatagggcttttgcaggtgtaaccattaatagttatgatgaggttatactagattagaatgggccctagatcctatgactggtatccttacaagaaggccatgtgatgacaaagacaaagaatggagtgaggcacccaaggaactccaaggattgctaggaaacaccagaagcttggaggaaggcatggaacagattctcctctcggacctctagaaggaatcagtcctgctgataccttgattttggacttctagcctccagacctgttggggagaatacatttctactgttttaagctaccacgtttgtggcgatttgtcacagcagccataggaaactaatacatacaacctgcacaatgcctactccagcattccatagcaagtcaagggcctcacaattatgtccaaaggactgatagaagagcgacctctgtgctacttgccctcaggacgctgacccacagctctcaaggcaggagtaggccagagctcattcaacaactttgttatataggggttccaattgtaaaccttttgaattcctgtttgcaagtagatgagggttgaaaaataaatggccactttctctaagccacataccccaatctgttttgttacttcattacagctgttataatggcctcctcttctatcttccaatctccatagccctggttccttgatagttctttttttttttttttctttttttgaggcggagtctcgcactgtcgcctgggctggagtgcagtggcacgatctcggctcactgccacctctgcctcccaggttcaagcaagtctcctgcctcagccacctgagtagctgggattacaggcacctgccaccatgcctggccaattttttgtacttttagcagaggtggggtttcaccatgttggccaggctggtcttgaactcctgacctcgtgatccacccacctcagcctctcaaagtgcggggattacaggcatgagctaccgcgcctggccagatagttcttaaacaactgcccagaagttccagcctaggcaggggcagccatgaactgcattgctcatttctgctttttgaccttttcgatggctgaactctaggccatggaaaacaaggacccactgtatagttaagagtcattttgtgactagggagacaaaaaagggcctattctccaaatcccctttccctctggagttcctcggtgccttaaagcttgtcctgagctacaggtgtgttacctgcttatcccaaaatgcaggcatgttacctgctttcctctgcaaagagaggcaggcctggctggggcacagctgaagatgtcaaggccaacctaagggcagccaagctatggctgtctgtgacaagaggagagcagcggtgatgggagggtaggaggcattgagttcatgtccgggtttgcctcctaccctcctatcactgcttgatgatcctatcactgtcttgatgagttcaagacagaagtttgcctcatcattgccacaataaaatcaccaataacagaagtgtgaaagcagcgatgtgagtggaagcccatatatacacagggggtaatagagcagcatgattaaatatgtggccttgttatcagacaggctgatttggagtcccagctacttgttggtgacctgaactagaggaagttatctaacctttcattttactcatttacataacatggctaataatagcacctaccttatagggttattgtgaggattgaatacaattatgcaatataaaacgtttagcatagtgcctagtctaaattcctcaccaggggtatgatgtactagtttttagttaagtaattagtatcctggacatgtcacagccatttgacctatctgggccagcgttttgctcaggttcccccagcagtaattgtattccctccccaatcccgggattagcttttaggaagaaacagttgatctaaagatagaaagtcagagtactgtctggaggaaggtagagggaaatgtcattatctgggttttctttgatgatgtcagggaacatgacaggctgctcccaaagacagagcagccccaggacagggaagaaggtgaccttgaggttgactcctctgcatcccgatgtggacgttatggacttgttttggagatgaagggaaagaaagatggaatgtagaaagtgaaggagaataaaagaagtgggaggaagaagggctgggaggaggatgggcaaagtctttctggtctcaaggataattacatgtgaaatcacttgccagtgggactctggggctggagcagctacaataattacagtacaggctgcagagggctcttgggcatgtcttggagcagcctgtaggcagtactgaggcctctctcactagacccatctcccagatcacatagtacacacaccttccacccccgggcctgttaatgatcaaaaagcttaaacagaacaattacagcttcagagtggaaccatatctctgggctcctgtgatgaaaaccacaagcctgtcaggctggggctgcttcacatggagggccctgctcttaatggccaagtgatctggagcaagacccgtgactctcccatagtgctgtggatggtgctgcctctccccacgcatccccagaagaggaagttcagtaactaaggaattaactattctccagcctgattctgcttttcccaatcagggctttatacctttctttttcatccctatatttggagatgagtcacccttgccttcattttacctaagcaaggcagtttcctgtaacctaatgaagtgccaaacaatactgtgatttatttagtacttactgtgtgccaggaattccagcaggtgttggacatttatgatgtatgatccttacactaagcctgcaatggtgcaaccccagccctgaccactctgtgcttcccttttcacaacacagcttgtcactaaatccaagtcaggaattccaggttaggcttgagttgtgcagagcccttaactgaaatttgccatggttgaggcatgattgcaatcactgacaactcctcccggctctacacacctacttgtcatattcacgccctgatcacggccccactcgcatctcttcccactttagaagttctttcctatagaacacgttgctgctgccctgttctggtcactgatcagccctggcctaaccactggctaagctttgtgcttgcacatagctggttgaatcgtatgtattgctgtttgtgtacatcaaaaatataataataatatcggcaattttatgtgtttcattcaacatgagggacccagcattcttaccttgtcgctttgtaaaccctgctgctctcaaatctccactagctgtttcctgagcagaaggagataaaaggctggctcacacccccatgtttttactggtcacagttactgccaccatccaaggctgaagagacttcctttgtgttagggctaaaaccttagtcattgtatctaaatgtcttctgtattcctttcctcaaaagaaaaaagtaccctcttctgccaaccctctcccatgccaactaaacaagcaagcaagcaaacaacaaagaaaaggtgatattacagatgctgctcagcctatgatggggttacatcctgataaacccatcacaagggatgtaattccattgcaagttacaaataccataagtcaaaaatgtatttatttcatataacccacagaacgtgatagcttagcttagcctacttgatcatgttcagaagacttatattcgtctacaagtggacaaaaacatataaaacaaagcctattttaaaataaggtgttgaatatctcatataatttattgaatattgtactgaaagtgaaaaatagaatggttttctggatactcaaagtatagtttctactgaatgcatatcacttttgcaccatcataaacttcaaaaattgtcggtcgaaccatcctgagtcaggaatcctgtctgtacagggtataaaggaggaaagcatcagctttggaggcaggtggacctgtgtttgaaccctgattctgctagagcttgacaatgcatattcgttttctattgcataactaattactacaaacaacacatttatttctcagttttcatgaatcatgagtccaggcacaatttagctgcagttaaggtgttagctggggctgctgtcttatctgaagcatgggggtgggggtgtggattccaaggtcaggtggttgttggcaaaattaattttcttgcagctatagaactcatggcttgcttcttcaaggacacggggagagagaatctctcacatcttttaaagggttcacctgattaggtcaggtccactcaggacagtttcccttaaagtcaaggcttaatagtcaactgattagggaccctaattatatctgcaaaataccttcaccattgccatgtaacataatcatggcaaataatcacaggtcccaaatgttcacaggtcccactcacacttgagggaggggattatatagggcatgttcttgcggagagaaggaatcttacagccacattggaatctgtcttccatgctatttgacctcaggcaaattgactaatctcttgaaggttcaatttccttacctggaataaaaggacaataagatcagccatataaggctatgacaaagactaaatgagatagaataggctggaaaagtcttgcagatagcagacacaagtatataacaatttccctcctactgttccttttgtttttcacctatcctgcagtctctgtcacttcaaataccatagaaaacctttccaagcagcccaaatcatgcccccaaatagtcacgcctcattattcatagcagttatgttccataaagttagcacaaactccgaatgagtgaatcctaaagcgttgctcctggaggaaatacaggctgctggtcacaatatttttatcaactgatcaatatataccttgtcttatgtgtgtttctgcttcaagacactttatttaatatatacgttgattcattaactctgaactctctaggcaacagcattataactcctgccttcacaaagcttatctaacacacacatttcctcctcaggcacatcccagccttcttgcacttaggattcagcagtatgcttaagggccattttcaacagcaaactcatcagcgcaaacacaaacatgtgaaaaacgtagcactaaagagactgcaaaaaggacactggcttacagcatggaagctggaaggagaaggcagagaatcaccttgttccacttcagctatgaatatgcagtcaggccacccagtcattcaaattttataaatatactctaatatatatataaataccaggcagggttatttttttcctcaagtcatttttctaattttttttaaatgaatagatagaagagctgaagtaagggtcaggagcaagagctctgcttccttttcccttgctgggcttcgttagagagccatcatctcctcaatatgtctcccaactcttctaggcattggatgagtttgctgcagatacgaaacccaactttgccagtcacttcatactaacaggtgaaatgtagtggaggagccttttgaagacagggactcagccccccattagcctcattgcagacctagattcctgccaaaattaatttggctggaacttcccagccatggcattgtcgacattacacatcttccactgtaatgtcaattaccattttattcagccgaatgctggagagttaatgttcaagtggttagagctggctacgggtgggctgaacaagatgccttttccttcatttcccctgcctgtggtgaaggattgtaaccagccctggctggcagcactttgaagctcacccagagtgctcctggggacatcttctacagagcctatcatttggacatgctgtcttctgggcctgtcttccttccttccttcttccctccctccctccctcttttccttccttccttccttccttctttccttccatctgctttaaaaccagctgccttgagtgcttgtcttggcgcccctcattagtgccattgcaatcatccctcctgcctaccctgctaaccacagcttgttagtccacaacagcaacagctgtgtgctggggtgcagcagctggagggccaaaggtagggctgggggacagggtgttgggatggttttctggggcagatgagtttatacgtttctttcatgtccccttcctcccacatagacttttatttccccaaaggaaaacagaaaacaatgatctgtttgacagtgttgctatcattgggcatcaaacctatcatctaaggggaatccccctgtataatcagtcagccaaatggagcaggaccctgtgttttgtagctgatacaacagggcagcatctctagtgagggggccagggcttctatttccttcattaaaaaatgaaacagcagacctgattccatatttagagattacacttagttgccactgtgggtgtgcaggcaccaaccaaacccagttggcaccgttgtcttttctctgcaatgatgtattgaatttaataatggaggtatatgaaattcagagtgattggaactgaaggtttaggggctttgtgtaaaattgatatgtaagggatttggaagtaggtgagggattcttccccaatacttattcaattttggagtcaaataaccaagcatttacaaatagccaaaaaagaaattgaaagagggtttaatccaataaattttcatgcctcatatgaaccacatcttataataagaattatgctttttcatttcatactcagttaacaaatatgatttgtgagcacctggtaagttcagggcactaggctgaaaggggttaccaaatgtcttcatttaacaaagtccagctgagctcttacaggtaccagaactgtgcctgggctgtcatatgaagatgaatgtaagagtgtgtcaggccttcaagagcttacagtgtgtcaggagacatcaaacaagtgagccaataaaatgatactgccattttagaaatagcctgaaattcatggagttcacagtcttgttaggaaagtgaaacataaacctataagcattaaaaaataactgttgaagacagtaacggaagaatgcaactggcaactgaatgatataggttgtgatgactgttaaatatcatgaaaagagaccatgatgagctgaggcactccaagagacttctttttggagatatgtttggagccaaatcttgaagatttaattgcttttttctttttttttttttaggtggagtctcgctctgttgcccaggctggaagtgcagtggcatgatctctgctcattgcaacctctgcctccaggttcaagcgattctcctgcctcggcctcctgagtagctgggattacaggcgtgtgccaccatacccagctgatttttgtatttctagtagagatggggttttgccctgttggccaagctggtctcaaactcctgacctcaagtgatctactcgccttggccttccaaagtgctgggattacaggcatgagcactgtgcctggcctttttttttttttttttaaaaaaaaaaaaaaaaaaaaaaacaggaagttttcgttagtttttttgtttgttttacttcccataaaaactctttgtgtcacatggaggtgaatggaaagagaggctgtggcaacagacggagacttttctgatatcagaacccagtcccatagaccagaatgtatgctttcaatccacgttgtctgggtccatcctattgagtgccctgcccccacagcggggtatggagaagagtcagacacagccccagtcctcacgtagctcacaatccagtggaggagacggactcagaaacagatagagatgaagccatgagatcagtactgtccgaggccatggccacggttttgtgggaacccacgagagggaatgactaactgtggggaagaagagggagaggaccaaaatgcaggggaagtgctcacagaggataagtaagcagtgaggtgccatgaaatgagtatacacctgacagccgtgtaacagctcagagcctgggtagaggggaatagagctgctggttctctggggggaagagaggggtatgggattctggaacagaagcaccaaaaccagcaggttattggagctgttagtgctcagatcagcaatgggtgcacaaccaaaccattctcctagggatgagttctttcctgtggatgagggcttctcagcctggcttctcccgagaattacccgggaagcttgaaaagtactgatgcctggaacctacctccagagagttggatttcattgtgttgacgtggggctgggatatcagtatattgtttaagcactccaggtgattctgatacgtagctgtgattgagaacccttgccctaagctatccatctgcactccaggggtgctcccaggcccatctgtttgtaaatggacaggtgtcttgaggtaacaaatgtgccaaggctctggagccaagcacgcctggctccttagtgcctacttagtgacctcaggcaagttactaaatggcttaaactttacaaatccttaatttgtaaaatgtgggcaatgatagtacctcctcacaggattattacgaggtttacacggaatactctcagctcataataagcacttgcacaggcctcatgggctaggccctcaaaacttaacgcatctacaggcaacagccatatgaaaggaattttataccaccaagtcaaaaaatctgtgagcactgctcagaagcaaaagcctgtctccaacagcgctcatttaaggggtgggcgagctacagagagaagaatgagcccccacagggtaagctgggggtagctggggacagaatgagactcaggaaatcacttgaatattgattatatttgtgctcaataataaaataacgaaatgagtacagccctagacctaaacattgtgggtgaggcaaaggcaatgcgttaattttgcatccactgaggaaaaactctaaaacggtgacttcttttttaagggaccagaagaatctagattatatttagtctaagtcaatacatacgacagaaccttgccctctagacttgataagaaagaagtaaaataagagaaagaataaaaaacccttccaccaaaatactaacattcagataatgactttttagttaggtctcctggagaggaggttccctcagaaatgaatagatttctcttctagtgcaatcatcaaaaggtaatgcatggacttaagtgtgatccccaagagaaaatcaatgacctttctgtgtttgcctttgagaaaatcagccagtctatggttaaattagacatattttttctccttggtcaagattagtgggaccaagaatgcagtcttacactccttctagcaaagaattacctgatgccttatttcacacaaatttgcaaagttgtatggacgttgtatcttattttaaggagaactggtgatcaaatgatgactatttcaatagtggttcatttacaccaccaccctcaccccacatcctgctttcacctgaatctgaacgatcatagtcagtctgagattctgaaggtttgaaattccttttctgagctctgcaagaacagcatctcccaagagagctcagggcagactgtctgggagagattggaaacctgtcttttgcagtaacatgaattggttgaatggtcaccctccatatcaggcctgcttctcccattgggtttctgatcagcccaacttgggtctcacccttctgatttctctctcctggctcacatggggctgcactggccattaggtgccaggcttggctccgtggaacccattggccagctgggctctgtggagccctaaggcagggctctggtcactggtgagagggaggccattggagtcactggggtggacctacagaccctagggttaacagctaggtgggtgtcctcttcagagaaacgggttacaaagtgaaagaaagttacactgtgaggtcagccagggaggaagacagagagctgatataagataggtactgattccctggggatgtgaaaggagggtaatattcctaaaatgatagcatttagcttccagtatacattaattgattcctgatattcattaaaactaaacgctatttccttgatgtctcatccaaagccgcaccactcttcccactaagtctgaggggagcttgttttgttgacaagtgtaagaggttgaagagggacccatgaactcttttgtcctactgaagagatccacagatggaaacaaatgctcctaccacatttatgaactgctgctttgcagtcccgcttctgctatcatgcacaggaactgactaagctccaaagccagaggatgtaaatctccctgtaataaatgtaagtcatttattagctacatacacttcagcaagtcacctaacctgcaaatttcaagcatgtgaatcttggatctttcatgtgctagctgtgagactttgagaaatgtatttaatgtctctttgcttccttttctacccacacaatgggtataataatgtctaccatatatctttgcagcaaggtctaaatggggtgatacatgctgaatacatttccaacagagtctgtgcaatgataagctctttccaaatgttagttaaagctaaccaactaacccaccaacaaaccaacctcttagccaggactgatggaaggagtctgtgagagaatgcatttaaaacacttggcaccatgcctgacaagagtaagtactcgataaatcagttattgttattatcgcatcggtattatgaccattatcctcttctctataggcttcaggttttcctgtctttttatcacagcagtattccagcagaagcctttgatttaactaagtctctactgtgtgtgtggctagatgctataaagcatccagagaagtgagaatttggtcctgcttttaagtagcttatagtctaattagggggaagtaatcagatagaaaggaaactaacaatatgcaaaaggaaactcatagtttgtggtaaatgccaggtgctgctgatagtggcttcagagagatctcatagatgctataggaggtcaaaggagaagcgtgcagcttgagctaagttttcagggaaaagggtgaaagaattagtcattaatgtacacctacattacctgccagactccattcaaaaatattcttaccaaatcatcacaataccttgttggtaggtactattactattttacagaggaggaaagtgaggcaaagacacattaaataattttcccagaatcccaaggtgtgaggtggagcaaggacacaaatccatggctctaagtccctcctagtatatcctgcaaacacatctggaattaatgcagagaggaaggggagaggcagtgttctgcaggagttcagagccatgataacccttcttgtgtggcttttggtaagttattttacctcttaccctctgtttccccatctgttcaatgaaggttgtatatacacacattatatggccgctgtaagtgtgcagtgatatgatgcatggggactcagttcatgaggcagtgtgaattctgaaggtatcacaatgggacaggtgtttttttctccactcattttctccgaaagtcttttgttttgttgccctccctctttggggcatatgctttcagctcataccttaatgacatcagaatctgcaatttcctggcaacttttgtggttaaaattattctgcccttccattttaaagcactaatatcaaaggtattaggtgcaaaatgatgataaaaataattgcaatttttaccattaaaagtcatggcaaaaccacaattactttggcaccagctgaatattttgaaactccctactctgatgttaaccaagttcatgattcaacgaacttgcagaggggtaggggaatttcaagggaaagggggagatgcctggggttgtcacacactctgtctttcatcctctattgacatgttggttatttggagatggtattcagttccactatagcccctcagtcactgtagaccctctcaaaggggcaatcatgtttcccttaggtcaggtccattcatctaacccctctcccgggggcatcaccttgtttgttccagcagctgtctggccaaactcacacctcctcctcaccctctagcccttatgatctgctttggggagccatgggaacccctagtttcctctttcatacccactgagattcacaagtaactaaggtcaaggcggggcttcattgcctttctgcagataccttacgctactgttcctcctcgcctggctggctccacactccagcagaccttctgctgggcgagaagctgcaggcctgaatctctgtgttctcatatggccccaactcttgggattacactagctcttgtaagaactcaatgctctgctctgctcattttgatgccatcaaagagggcttgcaagttaccagctgggagtgaacaccagtgtcctctttttagaggtacccctaatctttctgaacaattttgctggcaccccttcacttggctttgccggggtaagagggggcacttctctcctttccctcatgaaaggagggagagaagccaaaaatctccctactagtcaacaactcaggcacccctccttctctcctctattttatagactgggaagggagtgatggttgttggaggtggcagagccagttcagctgccttttgtgaagtcctgaaggaggtgtctatcctcaactgctggcttctgtccttaagcctggggagaattaagtcctctttgcctcagtttggcactccaattgccaacattgggacagcaggaaaagttccatccaacatcccattaaatatgtaatgtgtattagcacagcgcctggcactgggcaggtattttctaagtgatagccaatgcgaagcctactttattattttcctctttgcttaacctacaaggtgtctaagaccatttgtttgtccacacatagtaagataaacagcactgagactgtggtcctttctgccctgtgtccttatcccacctgggaatctggaaagccaagcctagacacactcgttccacaaatgtttactgaagcttgttctattcaaagcactgtacagctacaaagaccatcttttctgaactccaaaccaggccacatggttggaataacttcaagtatggagaccaagagaaaaggtggttgttgtcagcaaagctctgagtccacaccttccaggaacttatagttgatgcaatggtgggagaagtctgaacctggattcaatctgcttgattccgatgaatggtgcagtaggcagagccatgagttcagagcaggaagaaaccactggttcaaagaagcatctgtcacatcgaagctgctttatagtctgttgggaagcatgcataataatttattctttctttctttcctttggtcaacaaagatttcttgagtccctactatgtgccaggtactcttctaggtactgaagatgcagcagtgaacaaagaagatacaatccctgcccagcggagcttacattctagttatcgaaagtccctttctcagtggctgctctctttatttgagaaaccatgggctgttctcctcccatcctagggctgctggctccacagaggcacacagtccatcaggatgctctgccagccacccacccactcaagaccaagggttacactgtcagtgtgagcagggacactcccgtctctgctacctcctttctcctgaaaacaagatctcagggaacatctgccatccattttccctccctggggagtgacaggaaaggtgtatggaggagattgagcggagtgatggattgaggcactgtgaaagtgaatcattgcctgacatgggaatgaggagacttgcttaaaggacaagccatgctaagtcatccatcgttctcccctaaggaggtgaattgaagttcccatttttcccagggagccaaattaacaaggtgctgggagatttccaaattagaaaaaaaaaaaaaaaaaggcaccaccagctctcaaatcagagaggctgttgagttgttttttggagcagatcattgtatttggcatctaaccttgaaatagaggagaaagcatggaatttctgctgaaaactcatcctcctctgagcaggtggtacaaataagcatcgttgtgttctcagaggcaggaaccacatttgcaccttgataccaactacctcaataaccacagtgctgaattttcacaaattgcgaattaggaaattgttgctcattttacaatttggtttccctcaggattccttttaagtagccagctaccccagtacttttgaaatatgacttgcttataaaaatttgataggcttggcacggtggctcacacctgtaatcccagcactttgggaggccgatgtggggtggatcacgaggtcaggagttcaagaccaacatggtgaaaccctgtccctactaaaaatacaaaaactagccaggcatggtggcacatgcctgtaattccagctgctcgggaggccaggcagctaggcaggagaatcacttgaacccaggagatggaggttgcagtgagccaagatcatgccactgcactccatcctgggtgacagagcaagacttcatctcaaaaaaaaaaaaaagatatataaacaagtttttataatattctcaatatgaactagtagaaaaaaagcatgtgtttttaggtcttagaggcctggttcccagttttatctctgactctaatgaggtatagtattacctacattgattagcccttctatacttcataggagatgctccaagactgctagctttcttcattcaataaagagagatataacaggatgggccttaaaagtagcatgcatttcttctttcattcactcattcaaaatattttcatgcgtgaaaatgccaaggatgtttggtcaaccaactcttcccagaccctggctgtgagcctggcttagaacaattccattttaatggtccatgccctcaggcacttgtattctagtagaagagcaaggtaagaaaacagcttaaaaagttaaacagttttaggttgagatgggtgttgtgagaaaaataagcaggatgctttgaacctatgcaggtaggaaggtctggaaaggcctctctgatatggtgatggttaaagcaaaaccaaaaagaccaagaacacatggaacacatgaagggctggaagaacagtgttttatggggaaggactagtacacacaaaggctgcaaaggcgagtgggctcattatgttctagaacatgccaaaaagcgggtgcagctggagagggagtaagatggcacaaaaggtgagtgaggtggacaggagccttatcacgcaggcttacacaggctctcagaagccctgcgtgttggtttcttgggactaccgtaacaaagctccacatactgggtggcgtaaaacaacaaaaatgtattgcctcacagttctggaggccagaattccaaaatcgggtgctggcagggctgcgctccctccaaaacctgtagaggagaatccttccttgcctgtccctagcttccagtgggttgctagcaatcctgggctgggtgactccagctctgccttggttgtcacagggcgttgtctttgtgtgtctctgacttcacatagccctcttcttcttctttttgtgtgtgtctgtgtgtgtccactctgaggcacagaagtttttatttatttatttattcatttatttatttcattgataaacataatagttatgcatagttttggggtacatgagatattggatacatgtgtacagtgtgtgataatcaaatcagggtgattggaatatccatcacctcaaacatttctcatttctttgattggggacattataattcttctagctattttgaaatatacaatagattattgtttactataatttccctgctgtactatcgaatactagaacttattccttctgttgagggtgtacttttgcacccattaaccaacttttctttatgtcctccttcccacttcccttaccagcctctggtaaccaccaatctactctctaccaccatgaaatcaactttttttttttatagctctcatatatgagtgagactatgcagtgtttgtcttctgtgcctggcttatttcactcaacataatgacctccagttctgtccatgctgctgcaaatgacaggatcttatttatttttttatggctaaatggtattccattttgtatgtatatcatatcttctttatccattcatccactgatgcatatttaggttgattccatatcttggctattgtgaatagtgctccaataaccatggaagtgaaaatatctcttcaacatactgatttcctttcttttggatatatacccagtggtaggattgctagatcatatggcagttctaactttagattttaaaggaacctccatactttttttccatggtggctgtattacttacattcccaccaacagcatatggtcatctcctttctccacatccttgccagaatttgttatattttgtctttttgataatagccattctgactggggtaagatgatatatcactgtagttttgatttgcatttcccttataattagtgatgttgagcatttttttatatacctgttggccatttatatgtcttcttttgagaaatgtctattcaggtcttctgcccatttttaagtggattatttgtttttttgctactgagttcttcgagtttcttatatattctgatacacagccatcttcttatgaggactccagttatatacgattagagaggtccaccctttttcagaatgaaattatagcttaactaattacatctgtagtaactctatttccaagtaaggtcacattctgaggtacaagggtttaggacttcaacatatgaattccagtgggacacagctcaacacatgacaccatggtagggaactttattctacttgcaagttctgagtgtcttacgcaggtagatggactggtgtgatgtatgctttaaagaccgctgtgtgaagatggccttagggtgatgaggatggaagttggagactaataaaggactaagaaaatgctaagaaaatccaggtgagaggtgatgatggcagaactaaggtgatagcagtagagagaagagaagtggatggagattagacatcttttgcagaacgaatgacaaaatacccctatggattggacatgggatgaggaaaaggaaggacttgagggtggtgtctaggctttttactttaatcgtgaagggaagctggtgccatttaccttgttcggacaaacctggagaggatcaggttagggactgcgagtggtatggacggcaaaggaatgggaagaatgcagggattaaaaattggaaatccccctccccagtcaacaatatcttacttttatctgaaaaatactaagtaaaaaagcatccttttgttggaaagctcaatccttgttaaaatgaagacatctctgggagaggaaacatagtgagcacctttcccaaaagcagccactgatttggagatgagacagagtagcatacaggacatcagagagaacatgctcaggacagaaagagcaatgtaggaaaaggcagtgtcttggcatcacagtctttcctccgactggctgtgagcaagtgctcaatttaattccatctcagtgctgggtcaggacaagtgcccaaaagcaaattgacaaaagtaccagcatgatggagttagaaggtagcaagttccctccacagagcccagctggaaaggaagatagaggggaagttgacccctggggatggggaatagggtgagaggagaacatgaaactgagaaaagggctttgagtgaaatctaggctaaaagctaaggtttctttagaaacccaccattgacccaacatgaccagggctttctcttgacttgattatttttgataccccatcttcttctgtattcctggaactagctctcccaagccccagaattgtgcttctatcagagctgggttttcatcagagtctcccctttatcctgtatctctgttgccctattttgtttgaattcctgccaggtcagctgaatttgggcatttggggtgaaaaaccatcaagggtggcatcctggctttggcacctggcacagtgtgaccccactggtctctccctcacatttgctgtggtccgtgcacggaatttgtcaaaagacctcctcagtatcagctttcctgcagcctcaatgcaccttgttctgaataggatattaccccccaagagtatattagggcattttcctatgccagaaggggtccttaggcctcttgcagttttttctgggtgacagtgaaggaggaggtggctgcagagcttactgcctgtggactgaccaccccagggcctggtgtcaggaccatttgtccagcctgttgagtgaaggtcattctgcctaaactgtaagcacaagagagagttcagcatcatttgcatcctattttattgtctttcttctcttttctttcaaggcctcattttttttggcttgaacaaatggtaaaggccattttattacaggtaccaagccaaactttccttggttttgtggccatcctgctggggaaggaagtactcctttactttaaataactttaaaaacatctgtttggtctcaggggctgcagctggaaagattttctaactaatacttgttttatgggggtgtttttgggggggtttattgagtgtcaaacctggcagtaaattagaatcagaagacaacagttagtgataagcagagaagccaaggatgttaccataggcaggcagcagagagaggggaattggtggctggccccccaaaaacagatttgaagatctccttctgtcatgtagtgaatccccaagtgcctagggtgggctgtgattacttgagctcctgtctccactgtctcagctcacttgccttggggtggacacacaacacacatttgctcatagcatcaggtattcaggagcaaagagctgaatttatctggttaatttagatacccctaccccctcttttaacaccagattgccaggatcatgacctcaaaaggctaccctgaaatgcaattgacaaatgggatgaaagatttcccgtttcatccacatttgcctcctgagctacttacagcagcaggtcaccgcagccagagcccacctgcttgcccaccatgcccgcacacagacaatgctgcttctgtggctggaggtcggaacacctcagcactatctcagtttggctgcagatcctctgtgtgcttggtaaacaggtttcctcatctgtaaaatgaattggctcttccacaacttttttaaaagcactaacatattaggactctcactaaatactcaaatgctaaactcaaatactaaaagagtgcaaagggatgggctcccaaatattacagtgaaggctgcagcattttctgaccttgctgctttttctggtgagtggcttttatttcttagtttggtttcttctctcccattctaatcaagcaagaagtgaccaccaaaaggggcactcaccaaaccagaacaagctagttctttcatctttaattcattgcaaccaaacagatgccacagaaagagccaagggctccaggctttagctccagccttgccattaactacatatgtaagtcagccatgctggtctgcaggttcttgctttgcatgatcaagggacaacttggaaggtctccaatcactctattcccccagatggaaatgtattcacttatttcctggagatgtctgtcctcctcccagttaaagacagaccttgacccacctccacttccttctctgtggccctgtcttatctgtcctcttgttcttgcctcttcaattgttctctcaccgtgtttgtcacttctgagctatcactgtgatccccctgattgtttttctaatgtccctgaacttcaacctgattttcacgcatatacaatgtcttcctaaacacttatagactctgacacattctgtaactgacacatttccctttatcaaatgcaatctaagaagctcacagtttctctcagtttcaacaagagaaatcaggagcacttgaattatacaacttgacattattagggctgatgtctgattttgtcctgtctgcccctgtcatttctgtactaccttttacaaaacctctcctatgacctgtgtcctcctccagctccatttgagaacacctgctgtataccctgtgggctagcttttattatgttcgcctcaatgatgaagaaacaggcttggaagttaaattatctaccccaggcccacagcctggaacctaggattccaaccaaaccttgtctgattctaaagcatagcagaggctccatactctgcctccctcttctacatcatttcagtttcttcactttcccacctccaattctcacccaaactgaatgtctcacagtctctgtgcccccactttgctccatcccttggccttctgcagtccaagctccattctgagatcatccaaggcttctcttctgtgttgatccttggccttcttggagtctctttctcccatgttctccacaacagagcattctcctgactgttttcattctgcatctcactctttcatcagtatctttttctctaccatgccccataaatttgggtgctcctgagggtcctgtccttgtcccctgctttcttgttgtacaacctccttgatctacttcatctactcaagtttggtccacaatttctatattgtgaagattcaaatctgcatctctagccatatatccatttgcctgctaggcatttctacctgaatattttataggcatgccagtggctcttactctatggctcttactctaagtctagactacagcagaaagcaatgctctttttattaaggcatagtgcctctttcagaataatttacagcatacaaccaggcctgctgtgcagcattacaatttgtcattaaaactccattcctcttgccagagtaaatgagccatttacagccagggcgccaagatggactgttgttattttttctgcctttgtattatgagtgttcatggctctcctcagacaagctcctggggattcccagtggagttgccttaacatgcaggtcaattagccaggctcaagggtagtttcctggatattggtatcccccttgcagaggactgcaggaaagctgaacagtgttcccccaatgtgggtggtgatcctgagaaatatcatttgtatctgcatgtgctgtctcacacacactagctcacatgtgcacacacacgtgcatgcacaggacaaaaacaaacacagggcaacccagcatctgccccccagccatcagcattgttacacctttatagggggcgggaacaggttggtcagcaggtgaacgtcaggtgagttgagaaaagttattaaatcttaaatccttaaggaaagttattaaatctcttctaaaatgcatgcataggcgggctcagtaactaacatgcaaatgtttagggtctgaagctcctaccgataatctttcagatctcagaattccagccccttgtgctgttctgggttgtctgacacagacgaagcagagaacagtagaataaacagctcagtaaacaattcattgagggaaagagagtgagaagattcactggacagctagaggaggaaatactgctggtgactatggaagaaatttgccctaaggcctgcaggcaatagcttggtcttatttatcctggtgtcccaccctctcctccaacacatactgccctggcaggtacgtagaagatgcgtgaaaatatcttttgaattgagctatgcaaaaaatactggattctgccctccaagagtttactgtttagtttcacagaaagcacatgccctcctttctctgcctcttgaagactgacctatctttcaaggccactggcccaattctgttttctaagtaagaccactgagtcagtggtgacctctccttctccctaacaaagtctgatttacttgaatatacaactatctccctcttggcctgtgaatttcttgtgttagggaacatatctgatttatccttatctcttccacagtacctggtgtaaaatgcccaataaatgcattgaaatattcatgaagcttactaaatgctctgccttatgagccatgaaatataaagtgccttaaactttgtttttctcttatgtaaaataaggataataataatgacacccctataggattgctgcaaggattaagtgtgataatatatataaaactcttagcacaaacacctggctcacaggaatagtagctactaccataatggtaacttcgagggcaagttttctcagagttatttagccctccttcaccctgtgtccaggagtgcagatcagaatggtcagattccaggacaccaagttttctgtgggagcttccctaggaatataactaaggaatttaaatcaggttcagctcatgctgttacactctcttcctccactcaggcattgggtgtggcttttccaagcttgagaagggtgtgatctgagatgggcttgggtatagaggggaattatatttaggtctaccctgtataggaaaaagtgccttcccaaagtctccctggcctaaagtataagagatatgtgttgggatttagacccagagcccaagccaataatgggacccccttctcacacgtggctacctgctgctatcaccacaacagctatcatacccataactacaacagaggccaattaacgtggtgataattgacaaatgtcaagacatcctacattgaggcacactgtgcgttttgcgtgagcttttaaattggtagggaaggaaaacttttatacctacacctatcatggaaggcagaaggtaagagctaaaataaaggtatgccaagaacaaaggcaggaaagaagggttttaacaacttgaggcctgatccattgattagtgaagaggaaacatgttcaaaaaccactctataaccaccttctccaagttttttataattttgcttcttcggatatcttctcatcatagtcttaaatgccatcaaattaactgaaaaatgctaaaaatgcaaccactctaagagaatgggttagatgggagatggctttgttaaagaagtcggtcttaaagcaaaagtagggctttgtcatggtagtatggaaggaaggacatttttggtcaagagaagaaagtgcagggcctgttgaggaaggaatgagtagtaaaatatggctagaacagggtgcagaggggaagaacttcagagaatgaccaaataaacaggctgaaaggtgtagacattataggcaataaagcaaccacagaggtttctaagccatagggtgacatgatagatctgtattctagaaaagttagttttgcagcagttgtgtccattgaaagggacaggataagggagatagataagaagacatgctatgatgataactagatttggataccaagtggtatggtggaaaggaatgagagaacagggtcaaagatgaatgactgcccaatttcaatccatcataacaggatgtataggattgcccttaagtaagatggggaatccaaaaacgaggaacaagtttgtaaggttttgggggccaatgatgaattccatttgggacatgttgctttggatataccaatgggacattcatgtgaaaatgatctcggcaatcctatcctggaattcaggataggatcagaatgagggacacagtttataaggtaaacagaatggaggtgatatagaagataagggcatagatgagcttaccaaaggggagagtttagaatgaaaagaaaagaccaaaggctaagcctgtgctattctttctcctcacaatacgcttcagacctgggcacaaaccatcagtgagtgtcatgataacactactgtgggcaaatcccccctctataagggcctgatttcctcctctataaaatagagggttgaacagggtggtccatatcctgttaattgtgtttggagagcacacaacaaaccagctactatccaaaggggacatcccgaggcaggactaagcaaaggaaatccagcacagggaaaacactttctggtgctggtcccagttaggcagcgttcagtttaacccatcaccatcaccatcagtagctttcagctgctactgaccacacttataggaagaaaaacaattagaatggagagctaactctttggaaatggtcaaagaacacgggtctacaaaaccgtcaataaagcgctaagatgcctgggcggggtcaaaaagtctacctgggcggggtcaaaaagtctacctgctcagcatatggggcccagacatctgacctttaccaactccacaataaccacttcatctatggatccagtcttggtatcacctagtcgctgttttcaagtaacagaatatttggttctcaatggtaggtgactggaatacagcttactttctcccacccctacccccaatcctttctgcccccttatagtttaatttgcttgtaaattacttgggaatacatttgggagccattatagggaaatagaaggcagacatgatgaacagaatgcagggtgttttttattacttcacattgtgctcaacaattaggaggaattctagaagcccctcccagtggccaggaattggtcatagcatgaataaactcaatataggttgagtattccttacccaaaatgcttgataccagaagtgtttttggattttggattttttttttgaatatttgcattatatacttaccagttcagcatccctaatccaaaactgaaatctaaactgctccaatgaacatttcctttgagtgtcatattggcactcaaaaaggttccaattttggagcattttcaattttgggttttgggattagggatactcaaccagtggtaggtttgggatgatatcagcatgctaaggtcaaagagacctagctgggaagggtgggaggaacatggaattttcattctctgggcaccccttgaacagtcttactattagggccccaaatttgttctaagtgtgtgtgtgtgtgtgtgtgtgtgtgtgtgtgtgagagagagagagagagagagagaattttctttcttcctttatattctaagttcctcaggacaaaattttgggtttctttgtattctccctgcagctcctcatgtagttctaagcaaataaaggaattcattaggtccttgatttcagaagcctcccagttctctatgtaggaggaatcttagggtggcaagataagttgagggacttttcttcaagcacatttcacaagtaagagaaaatgttgactgtgtatatctaagaatgggtggggctcaatgatgcccccctaagttactctttactattattgattgattgattgattgattgaagaagcaatgttttgattgattgaagaagtaatgtttccaatggctacagcagactggagcaaaagaacaaaatgaaagaaaatacattaggctttccatttcttctaattctggggcatctgatgaagctttggatcccccaaggtaagagctggactctgctggtgaaaactctttaggaaaaacaaaagaatattgtcagaatctgatgcaccttagaaatgatgcagcagaactgctttattttctaaaaggtgaaatggagacccagagaagcaaagtgatttgttcatgatcatacagctattcagtaaagccaggacttctgtgatccactgtcctttccttaaaccagtggttctcaaccttgggagctttaaaaaactgctagtgttggatccatctcagactaattaaatcagaacccatggggatgaggcccagacatgagtgggttttttgttcttttttaaaaaaaagctccctaggagatttctcaaagaactgaaaatagaactaccatatgatccagcaatcccacttttgggtatctacccaaaggaagataaattattatataaaaaagatacctgcactcaaatatttattgcaacactatccacagtagcaaaaatatggaatcaacctaactgtccatccatggatgactggataaagaaaatgtgtatatatacacacacaatggaatactattcattcgtaaaaaagaacaaagtctgtcttttgcagcaatatggaaggaactggaagccattctcttaagtgaagcaactcagaaacagaaaggcaaattccacatgttctcacttacaattgggagctaaataatgcatatgcatgggcacagagtgtggaataatagacattggagactcggaagggtggggggaatgggagagggtcaatgatgaaaaattacttaatgagtacaacgtacattatttgggtgatgaatacactaaaagcccacactttaccactatgcaatatggccatgtaacaaaattgcccttacaccccttaaatttatacaaataaaaataaataaataaaagctccttagggctgagaactactgctcctgtcctatgggtccccagctttattttaactcaaaatgagtttagaaaaatttatgaacccatttaaaaatatttattgagtatctcctgtgtgcaaggcactgtgttatgttaagtggctgaagggaaattagactggggaaaaagacgaggtcatggcctaggtttcaaactaatataaaagacataacgaataagaaaggatgccaccttcttccaaccctcatccctcttccttttgacagttgcagatgttgctaattcattttggcaccctttttctctgacccaaatatagtcttataaaccttttcaacccacggctctaggcaagtatcaccttttgctcttttggcaccagatctcttgaacactatttactggttttggaaagattatacatgtatgtctggagttgaatgactgaacagagcaataataagagttaaagcaagaaagacaggcctacaggagatggcagagggtcttgcctgtcaggcattgattttgaacttcattgcataggcaatcaagaactattgaagtttttgcacaaaagactatagatgagattaacctggttaccgtaaaggacaaagtgattgcaggtagaatgaggccagcttcataaatgaatcatcaggatatgagaagcaagggcttgaacatgagaggccatagtgggaatggagggaaagggacaatgtgagaagcagtgaaggagaagggctgattgagtaaagcagtggagaagacagtgaaagatgtcagatgactaccatgtttggcgactgagtgagggaagaggtggtgatgatattactgaagagagaggcaaggggtggtcactggatttagagcagacattatcaacttgtggtgtccagacatttcaccctgggagaaacctgttctgaagtggcttcagcatctctgaggtcagattcctagttctactatttttctactgactgaaatggaaatcgagtaggcaaggcttttgatttgtctcagtggtctcttctgtaaaatgggggtgtttatatccatagtcttatcacagggctatttgggggattaagtaagacaagtgtggcagagctttgtaaactgtaatacactgtgtacaattggataattatggattcttctgactcatccacatggatgtctgctgaccctgggggaccggagcctgggagggaggccagacctggaaatggaaacttgaaaatgttctctgtagaaaagataattaacatttgaggatggttaagtcctcttaaatagatgtcagaaaaaatggaggtcatgtagacagaatgttggataacactactttgtaaaatattttatcttatttccattataaaagaaaaaaagctgggctgggcacggtggctcacgcctgtaatcccagcactttgggagactgaggcgggtggattacctgaggtcgggagttcaagaccagcctggccaacgtggtgaaaccctgtctctactgaaaatagaaaaattagccgggtgtggtgacaggtgcctgtaatcctagctactcgggaggctgaggccggagaattgcttgaacccaggaggtggaggttgcagtgagccaagattgcaccattgcactccagcctgggcgacaagagtgaaactccatctcagaaaaaaaaaaaaatagacaggaaaataaaaaaagccacctcacatagtctactaccaccaaacacatcattaacattatatttctttattccatgctctttgtttttaatataaacaattacttttaagggaaaatgagaaaaggagagagtgataagactttattttaaaaggtggaataattctaaccatggagagtatttataaattttttttttttgagacagagtctcgctctgtcacccagggtggagtgcaatggcgtgatctcagctcactgcaacctccacctcccgggttcaagcaattctcctgcctcagcctcctgagtagctgggattacaggcaaccgccaccatgccctgccaattttttttttttttttttttttggagatggagtcttgctgtgtcgccccaggctggagtgcagtggcatgatcttggctcactgcaagctccgcctcctgggttcacgccattctcctgcctcagcctcccaagtagctgggactacaggcgcccgccaccgcacccagctaatttttgtatttttagtagagacagggtttcattatgttggccaggctggtcttcaactcctggcctcaagcaatcctcctgcctcagcctcccaaagtgctggaattacaggtgtgagccaccgtgccaggcccataaaatattttttatagacaagtgagagcagaaatcacaggttcttatgagcaggaaaattttgaaggtcatctactctgaacgtttttttgtttgtttgtttgttgttgttgtttgtttgtttttgcttagtttacatttattaaatacccgttatggtccaggcccttggctaagcgccatccatgcaatatatcacaagatatgcccagcaatcctaggaggtagggtttattactacccatcgtacagaggaggaaactgagtcatagagttttagtgtcctgatcctggtcacagagccaggaagtggcagagcaggccaggccaagtctgtctgacatcagagctcatcagagccctccccattgtccttgaaccagtaaagatggagttcttctacaggggtggttgggggacaaggaccccatgggtgtgtctgagtcagaaacatctgcgagtgggctgagaaatgagtcttctgtgaaaaagagcaaaagaaaaaatgggtcaggagccaataatcattgtccatctttgtgtgaatgtatggtgtgggagtgggagcaataaacgattctaaggtcacacagaaaagatgccaccttctccaatcacataccgcccctcgtcccccagttttctctgaaatagctcttcttttggctctatcctggcttcttcacacaggggtgtccagtcatctcatcctggtgggacagggatagagctgtggcagtggagatgaggaagctcgcctcctaagtgagtctgaattcttaaatatggagccactccataatcatttggagtgaatattgggccatggccctttttcttgccagctgagctatgaaaaaaggatgtcctaagaccagaggctgtgggaccattcccagcccctgcaggaatcaaaggagctgacagaattgtttgtttgtttttttcacaaattgaaaaaaaaatgtaaaatttttgaaaagaaagcctcattgaaaagaaatccctctccccagctgggctcccaggcagcctcctgcagaacatccttagcattgcagagttgttcccatggcaaccgagtaaggggctttttgttttccttagaagattgaatcctttcaaccagaaggtaaccactggttcttccccacaatccacactccaaaccccctacccttatttgactacatgactagttttgcatttatggatttttttatgcctaattgaaaaaggctaaatatacagaaactgaggctgaagtggtttaaggaggcaactggcccagtggtttctcagcaaccacatgtcaaagctgtggacgttagacttgacgagagcaagacatatcagaatctgtagcaggagcatctagtctcccagttcaatagtgtccacaaaagaaatccagaggtttttgaagcaaggaatttgggtggcactgctgtgagaaacaatcacctggctcctccatggggcatagagtggagatgcttcttcaaataccccttcctttccaaggccatgactcagaatgactggcgtagggagcctggacctgatctcttcaaggaaggggaatcagatgagctgtttaatctctcttgtaaaatgaggggttatgagaccataggctcattttggggggggtctaaaatgcagtattttttgaactgatatggggaaaaaaagacatttctgaattgttgtcatgttgcagattctgggccgttccagcataagcacctttcttagagtacttggctttgtgaagtagtccttatcccctccttccactattttacatcaagttaaaatagaggaagatgcctagaaatggccgtatagacagagaaaactgcactaaaactccctccgtcatgcctgactcctctctagactatgaccatcgtggggccagaaatcatatcttaaagatcactgtgcctccagtacccagcacggtgtttaataaatgtttgttgaatgaacgaactagtaaaattttcaaatcattagagctgaagtatcctttaagattctttagtccctcattttacagataaggaagctaaggctcaagacattgtgtggcttggccaaaggcacacagcaagctaaaggcagagggaggacaggacccggctgtctcaaccccctggctgctacacttcctgcagcatttctaattcttttaccattcttgcgagggattttacaggcatgtactgctagagccgaaataattagaagcctcttactactcatcagaaaagctatgtgagcccctagggaggacacagctagcctagactctgcctctttgccctctgctgcttattagcagaatgtaagtggttgtgtatgatgattagtgtaagtaggatgggcaaatgcacacctttcccaccttcaaactcagaagttgtaaccaagagtcacactgactaaacactccaatttccctttctgttttcttaacatatgtcctattttaccaataatagccatggtatattagtcatggtatttcacgctagctgcagaaataacttccaaatctcattggcttactcagtgaaagtttatttcttactcatataaagttgaatgtcctggtcaggcagttatctaagccacaacttggggatggggatgcaggcagcttccatcgtattggctccaccattcagggatggcagagttgctctggcataatccaaccaatagaggggggaggtttggcacttgtcagttaaccacctagcctagcattgacacacaccacttctacatacactcccctagtcatcattcagtcatgtggcccaacctagatgcaaaggcatctgggaaatgtagcccctatctggtcagcaacaactttgcacttggaaggggagcctgaatcgttattggtctccaacacatgtaactagcaattatacagaacgttatttgtcaggcaatgtgccaagaattatttcatttaatcttcacaacaatcctatgaggttattgtcctctttaacgtatagatgaaaaagttgatggtagagatataacttaactaatgcaaagttgcataagtggttggtagcaaatccaaaattcaggctgttctctccagagctcaggctcatgattgctgcattctactgctttgagcttctgatctgagaaaatgcatcagccactaagtagcctgtgtagtctccagcaattactttcctccctctggatcttggtttcattctctgcaaagtgaggatgtttaactggataaaatctgatgtcacctgccagctgggacatcatatgattctcagggtaagcatatcaggtgggtggggtccccagtgatgcttgaccatagcaaagccctttcaaaggtttcttagcacaccacataaatggaagcctcacagtgtccatgtaggagaaagcagggcaaagtatttccatttacccaacaaagaaatcaacatatagtaaaaagagagtgttttcccaccaaggcctcagattgactagcggtagccttggaaataggactttattttgtatagtacttttgccaccagggtggggggaaaagagtgcttctttgccccaaatgctggtttcataaaacctaaagatgtcacatggaaacacaccattcccccaatccccctcaaaaaactacttgcacttaaatgaaagagtaaagctgtaggactttactgagcagtgtcctgtggggtccttgcactgccatgctcttgaggggctcgaggtgtatgaattccccagcattacttctccttagaggtttcagatgagcagtatgagctccaaactcatgctagacccaagtatttcatgaaagaacaatccttgaatgactttatacagcaaagctatatttcactgtgtcctagaaaaccaattgtgtgtgtttgtgtgtgtgtgtacaactgcttgtgttctttctacctatgtccccctgatgcctccacacagaacatcccaaactccatttcaggttcctcttgagattcccaaacttggaaacaggagatgcttcaaaggcctcttggaatgtcttttgaggctttatattgtgatatgttggacagatggttaagaaacagaagaagagcatcaccaaaaggatttctcattttatgtggagatctattaatatttgccactagcaaaggcattctttcttgggaatgaattatgcccctagaatcagattgaccccacagaaacaagggagaataaatagagacttgagcttagaccttacaacatggccagagctgaaaaggctgagctctaggcagagaagatgcaagagcagcttcagaagacctgagagcttatttgggtaggttcctctggtgtaaagggttcttgttcacgttttcttccagaataagaaaagaacgcaaggtgtcagagggtggatggaaacagggtataaagcaggagcatttggaatctgccctttgtagcctggcccagagagcgtcaggcagcttgttgggtaataagtaacactggcatttttcccatggttctgtcatcttaaagagcaggatacataaagggattcagatgtcttgttggtttggagaagcttctttttaataccttgttttaaaatttacctggaatttattttaatcaggtgtggtaagatgcacagacatggagatgacagtcatgaaggaagaagtatttatactcacagatccctgtaaataggaagcatggcctccatgcaggccaatggggaagcaccagggtcaggcgcaaggcagaaggagcaagaggaaaacatggacaagaggctctactgtggattcagtggcaaagaatgggaggggcagagtaagcaggtttaggattatcgggtttgaatgacttgattgagctgtagggtgtagagactgcctctactgtctggcaccaggggtaattagggcagctggatagtggtctggagtgtgagagctccctaaaggaggtggttggaggtgtaggttttggattggttgatctgtatatgaaaggtgcacgtgcagggtgagtcctctactatcactagaaattggctggtcccaggagaagtagtctctctagagacagcaatgccccagatgtcaaagcatcagaaaatacagaaaaaaaattaaaagcatgattaattcatactcacaggtctagtttttgtgtagttaagagcaacctaaagaagttgataactcgtgttgcaggtcaggtttcccagaaatcatattctcagatgaagatttgcatgaaggaggtttaatgctcaaactaagccctaaggctccatacctgtggaggaagtgaaagaagcccaactgggcacagaaggtggaacacaatgccagtcacacaaagacctcagtggatcctgggccatgaggagctctaagcacagatgacccttcagaaatgtctccaagtggggaaaggaatcatgctagtcactggatgtgggcttcccactccaccccatgagggcatgaccttaagtgagagagctctttggacacagggcatcctaagaggggcactcagcagccacattgggcaccaagactctcagcagctagaagaagaaggtatagtcccaaaggggaatctgggctgcacaccttagtatccattagaactggaagtaggctgaatcccaggcagggatcccctggagaacacaggtaatttttaaaaaaatcaagctatgtgtctgaggctatgtggtaagacatctcagttttctgctaggaaaagccaccaaaccagattggcttattcatgttgaaaagtctgagaatcacactcagatgttgttgataattctgcttggataaaatttatctattggtatgcttgtgatatagcagtaccattgctaaaaattccatgcggagaatccaatctgcatcattttctttctcaatgatttgtttttaaaggcagaggttcggctgtgcccctttaaaccttctgtgcaagtgccagcttcctttcaaatggagaagcagcagccctgtcagaaagggtggctggagctccccttttgtgagaggaggaaaacttactgggaattacctgttcgagagccacacatgaaggcataccactgcttcctctgaccttccagccggtatattaatgacatactgttgtacctgagaaccaatgatgaagtgggtgatgtgcctggcaccttaaaggcctgggcctgctttgacaggggagatgatacacaacatggctgttagccagctctcactgcatctggaagcaccatgttccttagagccaaagttctcaaactgtgcttcctgctgggctccacagatccttcccgttccaccctgcacacaaacgtgcacacacatacacacacacacacacacacacacacacacacacagtgttctcaatgctcgccatttagttagtatgcaccaaatatgtgtagtatctggttccacccctggcctctcagacaattattagtatttttgggagcggggaggagagtcaggaagacccaagcgccatatttattatttccccagccaccccggcccaggctacatccaagttcaaagtctatgaccccctctctgagctttcagcactacctccctttgtgggggaggggggtgccaattctctttcttctcatcatctcctgttgcaaaataaaagcctaggcattcctttgagaaacttgggcctggcattggaaggcgtctgacaaaggctttgttaaatgagtggagggagggacggtctgggagatactttttcaggtggcataggacctccgcttcttcccttctcacatgagaaggaagatttttctagaaatctacaggtgtttaagctggaatgtgcctcagacatcatctggttggaccctttcattttgcagctctgaggcctagaaagatttggtaacttgccccaggtcacagttgacagaattgctcagtgaaaagtccagcataaataccccagcccatgtggccactggctgtgtgctcagctagtgaggcacacttacttcttaatttgtgccacccacttttcaggctcccttaggacagcctccacctgctcctactgtgcttcccatcgtccctctcctcaggcacaggctgaggagtaataagagcacctgatatgtgtcaggccttactgtgtgctaggaattgtgctaagtacttcctatgaattttccatttattctttataataactttgtaaagttagagccattattccagaagggaaaaccgaggcaatgggagtcaaagcaaagaatttgggcttttaaccattacactgttttgcacaagtagccagtaatgaaaaggctgctctccggaatcatctttgcaaaaggtaatttctttagcactttatcagaagaagggggctccttcctcaaattctgagggaagagaagtggggaagaaaagatgactgaatccaaagctcgggcagggaaagcacatcgagtgccaagtgcgctgcgctggggtctagtcctgactcagccgccatcttcccaagtgcttcctggaattctctcctctcgtggggcctcagctccttcatcttaggaaagaagggtaaagatctacagacaaattgatctttaagtatccttagagcactaccattttcagaatctaggattctatatccttccaattatctctgtgtagggaattattggtcgtgtctcctgattagggagccggacactcgtctgtcagccccacctggctctgcaaagtcccttgtgtatctgccctgcctggtcacgggagaggaagagacaaggaaacaccaccgctccgactctgtggagcacgcgctctctcccacccacacacccgctcaggagaggaggaacctgcacatttgagtctcctcagagcctctgcagactcccagcaggggtctggctttcctctcaggtagcacagtcatgctgtaaactcatttgggtcttgcttggtatgataatgcgtttagttgaagggttatataattgcagagtcgatgatgatctctaggccaatttaaagtcaaagctatttttaatggaattgccagaggagggcagggatgggggcagggaggagagatggttagagagtgcttttgaaaccaacctccaacaatttcagccattgcatttccgaacctgaattttcagggcagaaattggacaatgccaattaaatcagagcaggtgtatgtgagagctgggttcaccttcttgcagctacagttttattttgaatactgttgcaggtagtgaaaatatgactaggctgaataagagatctcagtctattcccagctcagccaaaagcccttagtgtgtccttgatcaagttacttcccctatccatttccttacctgcaaatgagaagcttgaaccaaactatcctaatgtccctttcaactctaaaatcctagatgatcctcagatgtcaacagtgctgaagcccagcactgtaagatgtcaggtggtccgcagagggtgaggctcttcctgctcaaattatttcttccacccaagactcctcagttacctctgtacacaaccttgcaggcccatctaagtatccaataacctggggctttagtttacaaattttcttggggaagaaggtaaaagggatctagctttctgggttatgaatgccatgtagggagggcatggtttgagttagtcctggtgctgggagttcatgagacttattctcaaatcttcagagaagaaaattccgtgaacacctgggaacatcaggaaaaaaaaatgtcccctaggctactgtcaggttaggctgctggttctgatttgaccttgaacttgctataattgaacaagataagcatgtgacctaatgaaatactttaaaacttgtagcttccttcagcacagaagtggctctctgaaccaattttaagcaatcctggctctatctgtgcatgttgatttagcctgtggttatagtgttaacaatttagtgattcacctcatttttaatctctctttccctttagcaggatcattttctctgtgttaagggatcaacattgaggtaagaatggctaaataatagcatcttctggaatacaaatgactttataaataaaagaagataaaaggaagaagtaggatgatttctcagctctaatacacttggcaaatgccatatgctttctcctgcgtgtactggtcaggccagttctagatacaatcatgcgctgcataatgatgttttggttaacagtggattgcatatgtgacagtagtcctttaagattataataccatatttttgctgtgccttttctaggtctagatatgtttagatacacacatacttaccattgtgttccaattgcctacagtttccagtacagtaacctgttgtacaggtttgtaacctaggagcaataggctataccatacagcctaggtgtgtagtaggctataccacttaggtctgggtaagtacactctatgatgttttcacagtgatgaaacttcctaatgacaaatttctcagaatgtatcccagttgttaagtgaggcatgacagtactatatctcaagactgtccccaagctgaagtctccagtggacacaaagaccaatgtatttagttgaatcgtggaccccaaaagttcaagtccacccagaacctcagaatacaattttatttagaaatagggtctttgcaaatgtagtaagttaagatgaggtcataccagagtaaagtgggccctaaatccaatatgactagcatccttgtaagaaaaggaaaaggaacacagacaggggagaaggccatgtgagaacagagacaaagactggagtgaggcatctacaagacagggaacaccaaggattgccaggagccaccagaagctaggaagaagcaaggaagcatcctcttctggggccttcagagacaggatggccctgctgacaccattgtttcaaatgtttagccttcagaactgtgagacaataaatgtatattgtttcaaaccatccagttggtggtactttgttataggaaactaatacattcaggatggagaggtgtctgggaagcccatgagaacaaatggaaagagccagaagccctcaaccttggctcgtctacagtccattttcttcattcccgcatccaggctttgagatgacaggaagctgtgaaacctgtgaattgtctccaccgcaaatcctgctccctggtcccacctagactgtcagggttgtgtggcaaggctttcatgcctctcactgactgcctagtacgtcccctcaatgactggtccacatctttctcacctttctcatgcatggccccagatccaccccagtgcctcgtcctcaagaggtgatttattccgagacactgatgagagcactgtccttcctgtgtctgagggaaggcatgtaactcttgcttatcttcacctgtgctctagatcctgaccttctctggcaacctcagggaccttgcaccatccattcttctcgcctaatggcgagactcagtctctccctctccctttccactctcccttgccattcttagtatctttctacaagcaggtcttccaaagtactgcttgaggtctgagttggagggaacatgcctctaccctactaaaaagagaaattcctctgcagaagacccaagctgactgacaaatccctttactgtaactgcagctctagctcccaccattttcctgtacttactctcctgctcaggttccctggcattgctgatgtctttcagcctttgtgccctggcccctttcctcctctcccctcatctagcactacctgtcaaaatcagggacttactttaaaatttatcccaaattatcattgccatcatctccactgtcaccttatcatatgtttgaatagcgtttccatttcccacatgttttcgcatgcactttctcaattgagccttacgaatcctagagctgagaagggtaataatttatgagtcctttgacaaatgtggaaactgacatcacagaaagtaagttgccagccgatatgtcactgtcttcaaactcttctttgtatttttattatctcccattatattctgcctcttgtaatgattatttctacattggtcatatctttccttctgtactgatcttcgcttatgataacaaataataatagtttacctttgcatcacacttgatggtttacaaaatgcttcaaattcaacatggcccttgatcctgaagatatttatcacttaagaatcattatcgccattttaaaatacaaatttattacttgggctaaattttcttattatagttgggataggccttcatccatagggtgagtgcagtatttgtggactgtcatggcagcttaaacatttagtacttgaaaatctgatgcattgatcatcagagaaatgcaaatcaaaactacaatgagatattatttcaccccagttaaaatggcttttagccaaaagacaggcaataatgaatgctgacgagggtgtgaagaaaacggagctttcatacactgttggtgaggatgtaaattagtacaaccaccagggaaaacagtttggaggttcctcaaaaaactaaaaattgagctaccgtgtgatccaccaatcccactgctgggtatgtacccaaaagagaggaaatcagtatatgaaagaggtatctgcagccgggcgcggtggctcacgcctgtaatcccagcactttgggaggccgaggcaggcagatcatgaggtcaggagatcgagaccatcttggctaacacggtaaaaccccgtctctactaaaaatacaaaaaattagccaggcgcggtggcgggcacctgtatttccagctactcggaaggctgaggcaggagaatggcatgaacctgggaggcgtaactttcagtgagccgagatagcaccactgcagtctggcctgggtgaaagagcgagactctgtctcaaaaaaaaaaaaaaaaaaaaaaaaagaaagaggtatctgcactctcatgtttgcagcagcactgttcacaatagctaagatttggaagcaacctaagtgcccatcaacagatgaatggataaagaaaatgtggtacatatatacaatggagtactattcaataaaaaaaaagaatgagatccagtcattagcaacaacatggatggaactggagatcattgtgttaagtgaaataagccaggcacagaaagaaaaacatcttatgttcttacttatttgtgggatctaaaaagcaaaacagttgaacctatggacatagagagtagaaggatggttaccagaggctgggaagggtggtggggggcttagggggagggtgggatggttaactggtacaaaaacagaaagaatgaataaggcctactatttgatagcacatcagggtgactatagtaaataataacgtagctgtacatttttaaaaaacttgagtataactaaattgtttgcaactcaatggacaaatgcttgaggggatgaatatgccattattcatgatgtgcttatttcacattgcatgcctctgtcaaaacatcatatgtacccaataaatatatacaactactacatacccacaaaaattaaaagtaaaaaaaaaaattaagaaaataaaagaacaaaagtagatgtattctacatgtctccatattgtaaaactagaaccagtcagttaactttagaggaaggggattgtggacttgatataaagacaactttataatatgcagagcagcctaatcctacaattgtcaaaaagtatagtggattctttatttatttgtccatgatattatagaggtcatttctgctttaacaagtaggtgggagatagctaggtaggatatattttgttcttattttttattttaaaatattgggctgtggctggacatggtggctgaaacctgtaatctcagcactttgggaggctgaggcaggcagatcacctcaggttaggacttttcgagaccagcttggccaatatggtgaaaccccatccctaccaaaaatacaaaaattagccagttgtggtggcatgcactgtagtctcagctccttgggaggctgaggcaggagaattgcttgaacataggaggtggaggttgcagtgaactgagattacgccactgcactccagactgggaaacagagtgagactctgttttatatatatatatatatatacacacacgtacatatacatgtatatatatacacattattattgaaagcagccaaagaaaaataacacattatatatagagaaagagcaaatgatgagtgactttatatgtatatatatgtgtgtgtgtatatatataatgtgtatatatatacatatatatatataggttaagaaccttcagcacatgtatacctatgtaacaaacctgcatgttcagcacatgtatcccagaacttaaagtgaaaaaaaaaaaaaagaaccttctgcatgccagtaactgtgctaagtgattaggatgcaatggtaataaaaacaaagtccctctccttaaagaattttctatttagaagggaaaactggtaaataaaaaataaatatataaattacaatttgtgaaaagtgctacacatgaaagagtgctgagacagacatcaatggataaactttagattgagaagggctctgacaaagcaacatttaaggtgcaacctgagagaatagaaggtaaacaggcagatattggtgaaagagcagtctaggcagagggaacatcatttgcaaaggcccagggtaaagaagatcctggtaaggaaatgacagtggaagaaggttagtgtagcaggactgtggctagggcggagaggcagggaagtagtttagaatttcaatgcaataggaaatatggaagattgaaggcagttttgcattataaaataatatgattgctattttaaagctactttatctaaggatggaagattcttaaataaacttgtgtatacttggaccacaccaccatgagcagcagctgctctaattcagagcagtcctcctgccaaacgctgtgtgagacaaagctctgattcataaaggggcatttttctctgggagaaaaccagtgatccatctgtagaagtacctgagtctaaggggagacgaagcagcaaaagaaattggcttgtgaggacagggacattgtaagaatgaaaagaggaagggaggtgctgagccctttttcttttttctttttcatttttctttttttttttttttgagacggagtcttgctttgtcgcccaggctggagtgcagtggcgtaatctcagctcactgcaacctccggctcccgggttaaagcgattctcctgcctcagcctcccaagtagctgggactacaggccctttttcttaatccacaaccttcagttggattttgcaaatgagtctgtcttcactgtttccattcagtggctggagacaacttggaagagaatctcagaaataactctggctgctcacccagttgtttgtaaatttttattgagactctactgtgtgccaggctgtaccaggcactcagatatgacagtgaatgagataggcaacatctttgccattggagagcctacactgaagtggacatgagggagttgaaagcaactcttataggaaatcatggtaaagacgtccaagagaagaaagatgaagggcaaacacatgcacggatgccaaacatctatcagagagaaaggaattttcagacctgacctgaatgatgaaaggaggtttttggaaaggaaaatagaagggaaggacaagggaaattatctgggcagcaatatttatctgctgtggtgcttcactctctctctaatccttttccaccccagccccaaatttgaaaggattgcagggagctcctgctggagtcatttctggtattaaaaatgtacagaaaggaaagctttggttctgagtttgcaggcttccctgtctttcattcctattgtagaaagcagcttatataaaaagatgtgctgtgtggccctttgagctgctgtgattgtgttaggaccccactggatggtattcgcatgaattaatctactgtagcatctctacaaatcaagaggctggcttctgtttgaaatgtcccaaggctttgtgcacagggcaagctaaatgtctccctacagtgagactgaaaatgccttgggtgcccttgtcgataggatctgatgtatagatgcatgtctacaattgcacagtggctgctggcaacatttattacaatctgaatgtgaaatggctattctgttcaaggattctgataaaaagtatcagccacagtagatgtataaggagcctggtttcactgcaactgactacagttatctgattttttttttctagttcatttttagtctgtggagcaaacagagatttcctccccaaatgatgtcctttctcagtcaccagggtgtggttatttggttttatgtagaggagatagaaaccaatcagtctaaatcatattctgttgaaatcagaaccaaaggatccacaatctagctccaatctaactttccagcctcaactcctacctgttctttgttactcttacccctctaaaccacttgtgggatcctgaacttgtaacctgtgctcagactggtgcttttgcacttctctgatgggaaagatttctctcatcttttatgattcagctgaagtttcaatgcttctgaaattttttcctgctcctgctggagagcttgtttcttctggattcccataggtcaggtcctgtgtttggcattgggatacaaagccaagtaacatagcatccatattctcaaatcctcacaatttggtaggaatatagacaagtaaatacaccctgtgcaaccttttgtaacagaggtataaaagggtatgaaataaagaatttaatcaaatcaaattgaatatgggcttcaactctgagatcttcttccatgatgaggttcccagtttactctagtgaggtcatgattccatactggcactcttctaggcacataaggctctatcctattattaaataaagattattaccattctcactgcaagcagcagcaacctgacaccatcatcatcataaaataagtaaaacagagttaattaagtgtgaactttctaaaccaacattgtatgagataattactcataaaaatgattcttcactttccaaaggtgcctctaaatactaagatttctgttacaataaaacttagatccaatttacagatattaaatttggtccattttccaagaatattttcttttctcataaaataaaaaaagtatgtgagaatattagcacaaaggggttgcaaaataaattttatttatccagatgtgagataagaggcacatgcgtcttttttcttgttttactgcactggttaggacctctagtatgttgaataaaagtggtaagaatggacattcttgctttgtttccagtttgctttaatatgttttctgtcagtttttcatagatgccttttatcagactgattaattcagtctattattatttcagtatgttattcagtttattatttcataataattttttaaaccatgaatgagtttgaattttgtcattcctttatgtatctgttgaaatgatcatatcgttttgctttctaaagcttctaatatggtttaatcacatttattgatttttcaaatgtgaagcaaatttaaattcatggcataaatcctacttggtcatcgatgtgttatcctttttgtatgcttctgggttcaatctgatactattttgttaagtatttgtggtgtcttttcatgagagatgttggtctgcaatttttttttcttgtaaggtttttgtaagggtttaagaaagcaaggtcaggtaagcttcacaaagtaagtcaagaagtattttcacctttatcttctgaaagaatttatgcaacgttgaaattatttgtttcagagatggtcaacagaatataccagagaaactatttggacttagagcttccttgggggaaggtttttgataaataatgcaatttctttaatacatagtacttatattttctatcttaccttgtgacaattctgatgaattgtgtttttcaagaagtttgcccatgtcatctgagttgttaaacttactacaacaaagtctttgataatattcctatattagcctttgaatgtctataagatctgtcctgatgttccctctctcacttttttaaagaagtcttgctagaggtttaccaattttattttgttttattttattttattttttcttatttgagacagagtctcgctttgtcgcccaggttggagtgcagtggctcgatctcggctcactgcaagctctgcctcccaggttcacgccattctcctgcctcagcctcccgagcagctgggactacaggcaccagccaccatgcccggctaattttttgtatttttagtagagacggggtttcaccacgttagccaggatggtctcgatctcctgaccttgtgatccacctgcctcggcctcccaaagtgctgggattacaggcgtgagccaccgcgcctggccgaggtttaccaagtttattaatcttttcaaaggactacattttggctttgataatttttcctattttttatctacattatactgattccaattcttatctttattcttttcttccttctcttcactttgggtttaatttgttcatttttttttctggcttcttgagatagaagctgagatcattgattttgaacctttcttcttttctaataagtgcatttaaacttacacatttccctttaagcactgccttagctgtatctcacaaattttgatattgtcttttcattgtcttttattcaatatattctaatttttcttgtgatttcttctttggcccataggctgtttagaaatatgtagttagtttccaaatattcgaagactttcacagataccttactattattgatttctaatttaattctgctacaatccaagtatatacattataaagtttcagccttttgaaatgtattaagaatattaccagagataagaagataagaatattaccagcgataagtagggatatttcataaataatagacgaattgattcatcaagaatatacaacaatcataaatgtgtatgtgtctaataacagagtctcaaattatatgaaacaaaactgacagaactaaagagagaaatggccaatcccacaatctttatctttatcaggtgatttatcttggtgaacattccttgtgctcttgaaaagaaagtgtattctgtagtcattgggtataaaattctatatatgacaatgaggtgattgataaaattatttagattgtctatatcctaagttttgtagaattatttcatgaattactatgacaaggatgttaacaacctacagctatgattgtggaattggctatttctctctttagttctgtcagttttgttccatgtaatttgaaactctgttattaaacacatacattcatgattgttgtatcttcctgatgaattggttccgttattatttatgcaatgtccctatttatctctggtcatattctttatcttgaagtctttttaactgatatgaatgtagccacttcatcctttttatgcttaccatttgcatagtttatatttttccattatcttatattcacactatttatccctttatacttaagtccatgtcttgtagacagtatgcagttaattgtgtcttgattatttttactcctttctgacaatttctgcctttccatataatatgcttatcaatacagttggagttaaatctaccgtcttgttatttgtcacatctcccatcttttgttgttgttcctcatttccttgtttattaccttcttttcagttattttttttttgtattccattttaattcctcaattggctttatagctatatatctttgtattattttttattgtttgctctagggatagcaatatgtatacttaccacagacaatttagaaatcatattgtaccacttcacataaaatagaagaagcttgcagcagtctatgtccctttacactcccattctttgtgctattgtttccgtatgtattacatcacgtacattgtaaaatccacaatagagtgttataatctttttccaaatccttgtgtgaattaaaaattttatgagtagaaaaatacatataacattttattcttacctacatacttaccagttctgctttcttttcattcttacctgtttcagtcttatctgtaaacccgttttcatttggtgtcatttccattagcatttcagtgcagaacttctagcaacatattctctatttccatgtatcttaaaatatctttattttgccttcgtttttgaaatatattttaattggacatagaaatctaggttggcagttttctcttatactcttgggtttcattgtcttctgatttctgttgtttatgaggaaaagtcattgattatttgctctttctctatacacaatgtattatttttctttggctgtttcaagatatttttctctttatctgtggttatcaacactttgattatgatggcctaagtggtattattgttgtttgtatttattccacttggtgttccttgagcttctaacttctgtgagctttttatttctcagcgaatttggaaaaatttaagccaattattatataatttttcttctccattctttctactctctttggaactccagttgtacataggttagactgcatgacgttgtcccatagatcactaagactctgttcatttttcaatttttttctctatgttcttcagattggacaatttatcttgatctctattaatgttcacttatcctttattatgccaccttcaatctgatattaaggccattcagatctagaatttctattaggttattatttatagtattaatttctctgctaagattttttgtctgttcattcattatgaccacaatattaggttcttaaacatattttaatagctgctttcaagtccttgtcagttaattccatctgagtcatcttggggttattttctattgagtgatctttaccttatctgtcggtcacatttttttctgtttcttcacatgtctagtaattatttattgtttgctgtatattgaaatgaaatattataaacagtatcaattacattatcttccttttaagggtattgagttttgttctggaagtagttaaattactagtagaactttttgttcctgtcaaacttgatcttattctttgttacagtgagcctattttagttttaaagttagtcctagggtacaactcttgctctattgtatgctccttacttctatcacatttatttctattgcctgagatagtcaatgagttctcacctgagcaggaactgcaacatttcttgacatggtcttacctatgtattcatcattcatctctcaggcctgtaagaagagatctctgttgggtcctgtggaatcttgcttgcacttggacagctcagccttcagccaaagacttgcaggaaaaccccatagaaacatctgggccctctcaatatttgatgtttaggaagctaaacgtcaagtatagcctccttttctagggaccctatcttgtgaatttcactcaccttaacaactcagaactcttatcttctgccttctcaggggagctaaactgtcactttctgtgggctccatcttcctgctccacaataggaaagtatctgcagagaaaaggctggacaattgtgtagtaattgcttcacgcatttcccttctctcaaagattgtaagtttgcactgtttgctgttcaatacctgaaaatgatttctacaaattgtttttccagttttatgattgttttcaatgggagatcatttctagtaccagttcctccatcatggccagaggtacaagttcaacttggatcattttaaaaatacaaactggggcatgtcacttcctgccccaaaccccttggtagctttccattgctcttagaataactttgtgatctacaacatcttcttcaaggccccgcatgatacaaattctggctatttctctagtttcttattgcaccaccttgtccctcatccaccttttttttagtcttctctctttctttgaacttctaccaccaggttttttcacacgttcttctttccccattaacaatgatccaccattctctttctttatccactgttactcatcctcataactgaaacatcatttcctaaggatggccattcctggttcagtcagtctatatttcatcccccatcacatactcttgttttaccctatatttttccttcaaagcacttatttaagttgtaattatgtgttgtttattttatgtctgtctgccctcacagaatccacagtccaggagaacagaaatcctgcctcttttatttataccacatccacagtattattagtgcctgtcacctagtaggtatgcagtatgtacctattgaataaatgaattgacttctgtcttttagatcgtctactcattttatcattgatgacaaacataataccttacattcgtgtagtctttttcactcctcaaagaggattttctgcatagctcctctgagcctcacaaaaccctttaaggaagattgtgaatattatcagataaagattgtgagacacagaaaagccagatgatttggcaatgctcatagtaccagaggcagaaatacagctagaacagtctcctggcctctaatcaggagttctttccagaacactgcttcatcttccattctcttgggttctttctatccttactttatagggcaaaatgtgtgcaaagtataatccctcttttgcaatgtgtttttagtttttcagattggaatcatgtaggctttttatgcccttaataaatatcagtgagcacaaaggaagtcctgtgagggcttataatcattttgctcccattaattccaacactgagcagtttccccatttccattcttggccttgtgaagctctttgctatccctgttaaaatctaaagttgcttgaaccttcttattgcaaaaatgcatcttaaacattctaatacctcttttttaaaaaaccaataaagactacgtcaaaaatcagccatcaatcgagaagccctgcagtcatttgtgtgctgttgtccctaagtagaagtgaatgtgctgagctctgcattccccacctagctcctctgtgatcagggtggacattcccaggacaactgggccgaggctggaaacaccatctgaatgtctgaccacacaaagttgagtggctgatccaggtttaaccttgacctcatcagcaccaccttctaagcaacactttggctcagaagcccagttatttattccaagggatgattgaatgcagtgctagtgtttcttcagggcttttgaactcatttatttatccagtcatttataaaagatgaagaggagaacaaggtaggccaaagtggctttgtactattaaaggctgcttgatttctaagtacatgttctttgccacctttctgccattccacattctagaagccatgggtaagtcagcacagggatcttaacatgataacattggttttaggaggtctcgtgcataatggaccagacttagagcacaatgctgtaaggtagtgatttaggtgagcagcagattctggctttaggagtttattatcagatgctttttaaacgacttgtggcccaggatccctgcacccatgggaagcattgtagccttagaactctgggaattctgaatataattcctgaatcaatcgtaaggatgcatatctgatgcttagtgcaaaccaagaggcagaatatttgcaggcagtgtatccttgaaaaacaaatctaggtcattttcctgccatgcttcaagcttacttttccatccttcctgatggtagtactaactacatttgtagaccatttacgtggtcaacactgtgctaagctgttagcttcattctctatgagacaggcactcttagcccaactttacaattgggaaaactgagactcaatgagataaagtaaattctttacagtcattatgctagtccatgaaggagctgcgatttgcaactaaatctatctgattccacagtctttgcttttaaccagaggttagcaaactacttctgtaaagggaagacagtaggtatcttaatctttgtgggcaacatagggtctctgtaacgtattcttctttctgtcacaatcttctggaatgtaaaaaacatttaaaatttacaaaccttacaagaacagctcatgggctaaatcagacctggatttagtctgtgaatcatagtttgctgaccccgctttttaaccagtatgtaccctccttctcgggatgtgaaaaattagtgcaattgcaatggaaaatagcaagaaaatggtaagggcctggaagaggcagcaggattacatcaggtgctatccctgctctggtgagatgaaactggggatcattgaaccacctggcatttgttaaagagttctgctttccctctgagattctttcaggaacctcacacctctagcagcccggagaaccgtgggctgcaaggaaatgcctcctcaaaggagtagaaaacctgcaggatagaaatcatcacatctgtctggcttttctcaacctttctcttctgcactttcttggatataatcaaagcactaccaggaactccagagtcggcaccttttcatttttgtgttttcatttaattatttctcagctgctaagtgtttgactgtttaagggactctagtggtaaatatttgtctttagcctggcagaagctgtggtttcctttgatgagctcacacggtgtggcttttaagatgctgctgaccaggacagctgactgtccccagtgggtgcagtccccagcagtgggctggaccccttccagaaagcgctgctgggccaagaggcttcctccaacttcccgctgcccccatctaaccaacacctcagtctcttctccacctgcttccctgccctcttcctttccctcgcagacactttcttctgcctggcaaaaggaatcttgtttccatggaagcctcattaaatctgcatcttgctcagtttgggtttgatcacggctgccagaagtatttttagcccatgcagttgcgtaatgagatagagattggggaaagggggaggtgactgtataggcagagggttttttttaaaaaaaagtgagaaaaagaaggaaaacctctaaagaaaagagttttatggaattggaagaaggatggagcacctcttttgggagcatgaggctggtgttctctggttagctcttcccactggaagcccatggacacttgccataatacctgtcctggtcacatgtcaggggaacctctgatctccctttccatgagcttagttggcccagccagggtgacacttatgctagggagtgtgattgatgttgctgcttacagatttcccctcccacagacctgatggggcagccaggatagtggcagagaagaagacagagcaatagcaggaaagagaggacaacactaacacattggaggtttatgttcaaagacgggatctagggggtcagagaaagcacacctaccatgtaattggtgctggaatctgatgccaagtgcacccttggcttctgaggttctgagaactcttgcttgtgcttttcagccagactatgccctcacctgcccctgtactttaaagagctctttaggctggagtggttgtttgcattggattgttggagtgtgtgtgcatgttgttgtgttcttgtattacaagacaaagagattaaaaaaaaaccacatgcagctgtcacagctaatgtttattgaacttttactatgccacatggtgttttaagcattctatatgtgttaactcattttccctaattctatggactagacacttaaacagtctccattgtacaaacaaggaaactgaggcacagagaggttgggaaactcatttgaggtcctccagctaattaatagtggagccaggttttgtacccagacaaccggatttgagaatctgcagtcctagattagtaacgtgttgttggcctgtcacacattttaaatgacattctgtacacagaaccatttatagtaactttgtattgttgagctgaaagcagtctgcagatgtgctgctgggatttcattcatcttcaaagaggtgttttttttttttttttaaaggaaaatgcttttctgagggtggtatctaaattcataaaaatctttacgatcaagattttcacaaatttcattctgactctgttgcattgcccttcttcccatattcccagttagtttgtattgattgctgcatctcccttgagcccatggtcccccacaacatttcttgcagaactgtgtcctgccttcacactgtcaggcagcaggagcctctctagcggccagcccacagtcctgcagctccttcctcaggacgtttaatttcccacatttctatgcagttacctcacagaaggatggctacgagggcctcacttggcttggcaagttggtcccctttttactcacaagactctgtttatctctttgtttatctttgtttatctctttgttgacctgcccctcttcaaggcctcagttttctctgaagtttacagcttccctcctcatcccgcaaaagaccaaagtggaaaagatgaaaccagaatccactgcaagccccacctgccacagcctctcctctaaatgcattctctgttgtgtttaggacttgagaatgaagagggacatgaattgaggatttgtttattattctttacaatatccctgtgagctgagtactgtaaatacccccatttgatacatgagtaaactgaggtgtggagtgatagaggaatttgctcaaggtcacataactagtaagtgggtggagctgtgatgtgaaactgggcagtctgattctgggacctgtgctcttaatcaccaatctatattgcctcctacttgaaaacatccagggaaaatgttgagatagatcagctgaaatcttcttgcacagtaaagcaggggccacctgtcctggagttacattcatcttgttcattgtcaacgatttgtgttcagtgacaccctcttcagcccaagaacttacctgggtgctgtgacaattggacatgactaggaacaaccagtgacaatgtagcccatccaaacacagggtaggaagtggatgcttgtcactctcttttggttataagaagcaggaacccagtaaaggcaccttttatatatctataaagttgaatatataagatatatgggggccaggcacagtggctcacacctgtaatccgaacattttgggagcccaaagcaggtggatcacctgaggtcaggagttcaagaccagcctgaccaacatggtgaaaccccatctttactaaaaatacaaaaattagctgggcgtggtggcacacacctgtagtcccagctacttgggaggctgaggcaggatacttgcttgaacccgggaggtggaggttgcagtgagcagagattgcgccactgcactccagcctgggtgacagagcgagattccacctcaacgaaaaaaaaaaagaagatatatgggtatgtgtagaactcacagaagggcaaacaggccttaacaggtgctgaaaacaggaactgggaagttgccagtaccttcctgtcttttcccctggaaccaaacggtttcttacttgcttctctctgcacctctgtctcatttccctctctcttcagatgatttttcattgttgcatcacacacatagaaaaatcaggatccaccctcccaagtttacatatcgttgtttcaggcagccatagtatccttaaaactccacattccagggagaaagcttgggtcaaggattcagccaaagggcagcgaaatggagtaaagatgcaactgccaggtctatgggcagcaaggaggccgggaaggaagccgctgttgtggtccaagtgacaattcaacagctcaaagcataagtaagttgtgtgcttttcacagatggagaaactgaggcacagaaggaacctggctggggtccaggtctctggcctttgtgtcaatgctaggtcactggatgtggcgtctgatttctacaggaaatgtggtttctctactttgtcccagagcccactcagagcactggctggccagggggtcctagggccctcttaggatagtctcaggccaacagccccaggacagaagcaaccaaagtgaagttatgaaagaaagctctttgctgatctgtcaatggcacccttgtagagccaatacttagaacacctggatttgaatactcatctccaaaacctgtgttctttctaccacgtgacaagcccttgtaaacctcacaacgtctctatgaggtgagcgcttgcagatccacactttagataagcaaatggaggctcagagggtaagcagctagttcaaggttatgcacctgagccaggatgtggacacagctctgtgtctgattcctaagggcctgtgctttagccactttgcaatactgctgctgtctgcttcatttcctcatctgtcagatgggaacgataatactcaactcacatggatactgtatgaggaaaaacagataaaagaagagaaagtgctttgaaaacataagcagccctggcagatgggaattatttttgctgctgacacacatcctcagccttgagggctctgctgagccatacccagctcagagctctggaggcacctcctccccatcaacagcaggggggacattctgtcttcatcctgagcaggctgacaaactgaaccccactcctccctcaatgtccccatgctgggaaggagtatagctcatgctgtgttctgtcttgttgctgagagaatgcagaacccagaatttgggtctcagcaggttggggagaaaaggaaatgtatttcttcccccaagatttctttttgaaatattttcatttgtggaatcagattgtgcatgcaagtttcttccagaaatgtaagacgtcgtaatgatgggaactgttggttttataattgaaggatgggaaaggaaactgatatttatggagcacctgttctataccaggcagctacccaaccatcagccattgttgcaatgttatgcaagctttattatccacatttcacagtctgagtctgactcagcaatgttgtgttctatgtgctagttcccacaggtaggtggctgcagcgctgggatttgaacccatctccaaagcctccatctttctaccactgcctcccattggtggggaggccatggactggctgtcagagatgtcctttccagtctagcagactaggaagctgctggaagctacttatgcaaaggtcagcaaggaaggaaacagagtcagaactagatggggctcccctggccacttttccatgctggcccacatgtccggctagcagtcaacattgggtcttatgcagagccacctgtgttcaatggaaacatcctggacactgcacaaactagtgggagcctgggagggaacagcctgtcaggttcattgaggttcagcccaactcatgagctagggcaggtaccagagggtgtgttccacccaaatggggcaggtaggcaggggacacaggctccattttcatgaccaaatactgagcagagaggctctctgagcagtggcagaatgggaagtgtcaagaagctttgtttgacaattgagtcaagaggacagaaaagacagaaagcagacatcagaattgggaaggctcaccccagctccttgacaaaggtgcatgaggccagttcttgaagcagtgaccctgccttatgtcatgtgtttatcaaagccggcccatcagccctgaagtggcctctgtgtttagaagagggcctgacatgattctctgagaaaggatttgacaacaacaaagtgttgccgtatgtgttgtctcatcccctcaatagtcctgtgaggtatgtgagacaggtgttactctctccacttggcaaatagggaaaagagggcccagagaagtgaagctgctttcccaggaccacacagctggtaaacagtgtccatctcagctgttctgtctcccacaccaaataccctgtgcaccacgcaaacacaaagacaactggacaaccaagtcatctaatgagtatgcatgctatggtctctctcattttgtctttcagggctataccctaggagagctaatcattcttggttagataagaaatagccaacacttctgcagcatggtaggccaaataccaccagaataaactcagacccaaagagatgctcagaatgtgtggagttaatacttcactatacagctctaaggtataagccttgtccatctgtcacattatgacatgtgcttgctcccacctcaattcctgattccacattacaacaaatacaatttcaggctttgaactaacaatgccaatgtttctgaagcccatattaaatgccaaaatctgagtcagctactggaggtagagacatgaataagatggtccatattattttagaggattctttggttgcaaagggcagacacccagcttgaattcactttggagaaattgggatttttttggcttgcataagcaaagcatgagaaagaaagttccagggatgatgaaaaccaggaatgcaaatgtctccagaattctttcttttttcttttaggccatcttttttctctcaaactggttccctccactgggctggagacattactaccagcagcactcagacccacatcttcagtttaaatgttggaaatggactgtcagagaacatttaggccattcattctgtgggagagataggctatgtaaaaagatagccactcccatgtgaacaatgtggttaggattagaggcatgaatataccccaaaccaggggtgtgggaaggaggttgacactctaggtgataatacccagaccttaaggagctttctgtctagagggaggtatggacatggacaagtaatcaacagctacaaagcagagctgccagctctgcaacacaagagccctgagaggcatgacaggggcagggtggggatccatgtgggtctggattgaagtgaggaggggcatcaggaaagcattccaggagagctgagggacacttgagcacaccctcaaagaatgactgggggtcatgaggtatacaagggaggaagtgcacccgagacagaaacaatcacataagcaaaaatgcagaagaatatgaggatctgggaagggcaagtagctcagtagtgttggaggccaagggacacgaaggaaggtgataaagccctgatgttaaggatagaaaaatcaaagtcctttgaaaatcatgtggagttaggatctcaagaaccctacaaggatttctttagaatagaatcaaagaaaaacaaagtttacagtctgtgagggttgcataggaagtaacgtggtgagaaatgttggcttgagaaccacatatccataacacaatggtgttttagaggatttgggggaagggagagaaaatctcaaattgtctcagtaactaatgagctttcatgtacatttaaaatagtaataaatgcaattgtgaggatgatggtgagatgagcaaaataatccagtttgtaattgtagttatcaggctggcatatcctgcaggtcacacttctaaacatgacttcgaaaaatcaaagatcagctaagtttgaagtaagtattgaaagagggagattatgttgcctcaagttaaaatagaacgtaaaagatggtgattcaaatgatcaaaagcaccaagcttccctgttaggattcaagggaggggtgcgtggctccgacaccagatatctgcaaagcaatatgaaatgagatcaatagtagacattgaaagattgaaactgatataggatattcaagtaccagcttcaagaaaatgaaatgagacctaataaaagagagtaggagtcaagggggtatacgatattaaagaaagtgaagagccagggtttgtaggaaggaagggagaagaggcaaagagagcagctcttttaacacaggagcttcctcctttcccattctccctcctgctaaaagccgagtttgttttagctgaaatgattgtaagacaaatttttgttattaaaaaaggagctattttgtgttggtttccattataaaatcagagctctgctgccataaaattaaatcccataataaaatgagtagaaaacgtgatgtcctgcagaaaggaagatggcagcccactcagtgccatgctgggcttgactatatacaagccgtgcatctcctgctgcgagttgtagctgctgcccagcagtgcacattatcgttgcagctgttttcctcacattctgaggtttatgaaatccctcatccatcaataattgatctttagctcttagtccaggggttgtcaactggcactccatggacctttagaggattgatggctaggttttcaaagatctttgaaccccctgaaattatatacaaaatattgtgtgtgagtatgtgcatttttctggtaagaagcacctgaattatcgaagcagtttgtgatcccccaaaaagctaagaactacttcctagagcaaagggagattttgctacacttagagatttacacatttgaccagggcagctcacacaagtgggatgcggtttcacatttcatggcagatctgcttccagctatacaaattcatcaaggaaatattgtaatacttctatatgaatcaggaattcactatatttaacttatttggaataagaaccactatatatatacaagtttttccaaaagactgaaggttcttcctgtggcaggaaggaatatgattagattcatgaagcgcctttatgtttatatttcaactctgaaagataattgtgactttactaaatcaaacctgtataccacgattaggaaaatgtggactgatttggggttctaggggtaaaatgtgacccctgtgaagtaccaatgcaccgttcttttatctgtgaacgggcactgagcttctgaaattaattagtaggcaggaggacatgcgcatatgacgtgatagtttaagtactgataattattcacttggaagggaagagaataaaattcagaacacagtattccttaatgggaaatcaacttagaggaggtaggagggagatcaagcaagaatatttctggtaaaacatgcataaatcaatggtcagccaatgtgttgatcaaagaaattatctttcggggaaaacagtagaaggcaattgaaaaacaagcatcaggctgcataaaaacagcaaacaaaagtcacaatggcttgattgtgtgatgaggtaattaatggctgcagttagcaaaatatgttaaaaaaaaagacagaaagggtagttacaggagaaaaacatccccgcagatcttcaaaatcagaaacaatgaaaataattatttcaaaaattaagaaaaaaactctctaatttatacctgaattacctggataattggtaaaatttcctgcgtatacaaatcttggtcctctgctcctctctctataaataaatagaaatgtatgaatcaatagtcagccaatgtgttgatcaaagaaattatcttttgggggaaaattggtagaagccaattaaaaaacaagcatcatattgcatgaaaacagcaaacggaagtcacaatggctcgacggtgtaatgaagccacacaatatgtattaaacacatcatctacacagatggattcaaagataccttctttgtgtctaagtcccaaatctgtgtttcctggctctgttccctcatatctagtcattctccaagtcagcatgcccaacttgaaagtgtcattttcaaaacctgcttcttctcttctggaagttcttcctctgcccattgctccacaatccccacctctttcacccagtagcaaaccttaaatttatcttttactttgtcttacttccccttcttatattcaaaatgtttctcacttgcatctcttttcattcatttcataagcatttatgagctcctgttatggtttggaaactgttcttcatgctggaggtggtcttataaacaagtaatttcaattgagtatttagtatgttaagtgccatcccaaaggcaaacaccagctgtgggaggctccccaaatcagtctaaggaagttgggaaaagcatctcagagaagatggtgtctgagatggggaggatgtgtggaactgggcaaggaagagaacaagtaacaacattctagaaaaaggcctctttcagcatgctaagaagtttggaggacagaggagttaccattcaaaatttggagggaaggaagagcatactgaggtttgccacttgaacagataacttcagctgtgttgggtgagtgaagttgagtgggtacaaatcaggtcaggaatataagttaggagactgttactagaatccaggccagaggtgatggtggccaatatatgagagttttagcagggaatgaaaaaaagaaaatgtgttcatgaggtagaagtaggtaaaaagaacaggatctggttcctgattggaaatgggggtagtctggagaggaagccagaatgcaggcaagaatgcatagtggtaccatccactgacatagggattaaaggaggagaagaagctttggtaaagaaaataagaagttcagctatggaatgtttgaatttgatttctctgatgaggagtagttctaggtgatgataatgctcagggtgtagacttgagagtggatgggtaaagtaaaggttgaggctattaaaagggaaaaggtcaaggaactgagggccaaggatttataataagttatcttgggccactaaagccacgcaggatgctggcaggaaacctatgagccaggtcttcaatgttgagtccagtgactcaggtgtcagaagcagcaggagaagcattgatagcctgatggggaaggagccgttacctgagagtagcagagagagttatcctagctgacacagctctcagggatttgcttctaaagcaatccttaggaaagaaagagcagtatccacaggagactggtgggcactggcttccccagaaaacctacctagatgaattctattctcaagggactcctatttagataaggggctttgttagttctcagagcaacaccaaacagatgtatatctcattacttgcccccacaacctttctgctctggccacatgggcctacccactgtctgctaaatgcacttcatattttcttgtttcagtgcctcagtattcataatcttcttttcctaatctctgcccctcacttacctgaatcttttgtattctcaatgacctgctccatcccagccctttcaagaacctttaatacctaccaagtgaatactctctccattgattacacacttcctgtagcacctgttctataattatgaaatattacctattgtacacatatatttcaatctcttggtggacagagaatccaatttatgccttgtcaatttgtagcacatttccttgcatatgtagatgcaccatgaatatttagagaacttgttagttaatttcctgtttaacatgggctgcaaagttctggtccatgcacgtcttttataaaatagaaatgacggatggtgcatggagcttaaattccatgaagcagaaacatatgagagatggagctgaatttgtttgcctgtacagctcttacagcaattgcttccaatttgtttgatttacctaagagctaaaattgtaaatggcagctcaaatgatttttctgtacattcagaaaatgagtttgaatatttgttggagagtaactgcttaagacatgaaaaagggggagattatagcttttaactcttttttatggcagagcattaaggaaaaaaaagtgcagataaatgagatcaaatggcaagtgtctgaacctgctggacacaagtcccggtagccattgatagacagtgtttatatgacttctgggccatcaatagatagataaggtacatcagcggccaatgttccaggaagtttgagaagataaatggaagttgcacagcagcctaagagcttccttaggagggctgtgctcctccagagcgccatctgtctgtgtcttcctgttcttcttcttcacattaaatgcttttccttttctcatttttatgatggttatcctaaagatatgctagcctggactttgacaaggacatctggagataagaaagattctgaattatttttccctttgggcaattgtagcaattttaaaactatgttagatggctagagattcttgagaatatttcttttcttggaaaatcataaggctttggatagtggtacctatagaagctgacatcagcagcagcctgcctccagtcgatcagggcctttggaacttcacggggctcctctactgacagccccatcggtttccctccagcacacgtaactcagcattgactctgggtagtagagggtggtttatggaatctgattcatctcagaaagaggtggatgcaaacacattcccagagcagaaggcttggcatgtctggtcttaggcagagggaactggagatacttgtcctattgttcttgagattccagcaaaaatagcccattacagaggaagaagatatcaggtcaaatgaaggctttggtgctacaacattgtcttagaaaaaaaaagaaagaaattggccaagtgcagtggctcagcactttgggaggctgaggggggcagaccacttgagatcaggagttcgagaccagcctggccaacatggcgaaactccgtctctaccaaaaagtattaaaaaatagccgagtgtggtggcgggctcctgtaatcccagctactcgggaggctgaggccggagaatcacttgaacctgggaggcggaggttgcagtgagccaagatcgtgccattgcactccagcctgggcaacagagtgagactccatctcaaaaaaaaaaaaaaaaaagaaaaaagaaaaagaaaaaagaaaagaaagaaattaaattaaaaaaattgttttttaaacaaaggaaggctttgggcttggagtccaactaagctaggctggaatcccggtttcatctcgcttctctgtgcaactttggattttactgaatctctcttattctcaattccctcctctgtaaaatgaagataatgctagtacctgtctcatcaagttgaaggagacttaaatgagatgtgttgaaagcatttagcatagtatgtggcacataaagaacactcaataaatgctggctataaagaagccagagagagactcggaggtgatgagagaggccacaattccctccatttcattgaaaagcaatttttattatctcatttgaaaggcagtatagtatagtggttaaggacatgcactatggagctagacctcctcagttcactttctgtctctatcatttattagctgtgacttaaccttcttgtgcctcagtttttatcatttttgagagaggagtaataatagttcctactctggtgtgttgtggagatttgatgagttaatacatataaagcacacatagtagtgcctggagcatattaaatgacatgtaagtattagctgttattttattaaacaacatgtggcataggacatattggaactttgaagtctttgaggctcttcccagtttcataaatcagagactacagtataaatatctgcttacatgtctgctttccccattggactgcgaaatcttgaaactgttttattcatctctgcatagtgttggcatcgtattatgatacctgacatttaccaggtgccaaatgggactgggcatgttgtagggattcagtcaatgtgggtcattgcaggcggggaggtgggtcgggttaaaggtaagagaagggccttggggcatcacattaagtagttaccagattgaactgcaaacattgctatccaggagaaatcaggtcaatatttcaccttcatggcaataccagtacagtccaaggagaatgcatagaaggaaagaaatcataatctgattgtatgtgtttttttagtagtaaataataataattattactattcctatataattttgtgtgttggtgtgttttgttttgttgtgcatgaaaaatggggtgctaatctattccccttcccaacaccagtgctcagaagaaatttccacagatagagaatctataggttatgaatttggccttgatggattctgggtcactatttctcaatgtttgtccatgtcatgtgaagctcttaagataaagaacaatgtcttactcgtctttttaacttctttaccccctaatgcctatcacatactttgcccatggaaactcaatagacatttgtaaatggaatttaatttctgaggtccagtaaagcctttttccatccttcccctactacacagtttgtctaaccatgtcttcccttccatcatccaccttataaacgttattactcattcttccatcacattcttgacacctcccatgtccaatgtcaaacaagtaccatttgggaaacagaattctaggaatctggagacctagagctcttcagaccctgaaatccagttttctgagctgagacagtttcttaatttctcactccaactccgtttctcctctttctcaatggatattttccaagtctccattaggcatatagcaattccagaaaacattcaattttcccttctcttaatgtcatgctccaaaacaccacattccctctagacattgagcattggagagagatggaaaagtactttgaaaatgtgtgcatgtgagaaaaatgctaagtgttctgtctggtcacttcaatgacaagtttgctactttagaaacttgactaaacagagtgtgaggaaaaacatgaaaagaaaaaaatgtgttcagcttggctgaataatgaccagcagggtgaaaagataagataaccacccgctcacaggatttctatcctcaagccccagaaggttgacaacagcagacactgaaactactcttaatggagggtgtgctaaagaagcaacattatagccgcttttaggaaagcaaataggaaagttggtgaaatagagaagatgcctaagcatgtgagataccacctccatcttggaaaataaccaaggtgatacaatgttatgcaggaccccttaattaaaacagatttagtgattaatatcaggagcattgtcaagaatcacaacaacagcaattagttactattgagcaatttctgctaagtaatttgcaggagggcatctcacttaattatcacatccttttatagatgagaatatagaggcttaaaaaggtgcttttcccaatgttattcagctataagtggtcagtcatgactcaaacataggtcaacctgacaacaagatcttcactcttaacttctcttctgtgttgtaatacccttgatccatggaaatggaccatcttcatatactgcttttttgcctccggaatgtccaggtatggattgggtaatgctcaaagacagagaggaatagagtattaaaaagatccctggcctcattttctgaagacatgagcctaagctgagctgtaccatttaccatctatgtgaacttgggcagattttttgacactgctgggtctcaattcctgtaactgtcaagtggaagtgagcctaactgcatagacttcactgggctgttaagagaataaaatgaaataactgtaaacagaagtgcctagtgcacatgcaaaggattattggggctttctacccttcagggattagaagttgatagtaggcaacaagttataagaaatacagtcaattgtctgctgaccagggctagagttaattgtctctggaaaaaaggacttgcctctctttctcttcttcctccaaaacttaagacgtttgcagctgaatccccaacaggattttgttttcctttgggagagaggaaacagaccaatatacccccaaaactaaccccataatttcatttcagcagtaaagtgaggtccttgataactgccctgcccaacctgcagggtggttgggaaactctgaatggtcatgcatggggaagcattttgtccactgtaaagagctctccggagatgataaatctcatcagaaggcttcatgcttgaggcatggattcttggaaaaacaatcactctacgtatgtggtcagaatctaaaggagatgctggggagaggagctaggtcagtctccaaagtggaacagtagaaactaatcatgtggagcctaaacttatgaaggtttttaaaatcagaattggccaccttcctttggaccatgagctcagattgtgaggtgtgactaggtcacgtctccttcctgcccctgtttccctcctctccctacctgtccctccttgaccccaggaaaaattgccgggatatgaaagttaattatgacccaagggaattggtacagatggggaagaaagaaatgcattcaagagcatttccatcagtattgaaattacacagaaggctggtgaatttgggctatccattcttgcctccctctgtgcccataattccttggcctccttcaatttcattttccctttggttcagaggaatgcttgatggcttaagctagcctcagttggccaagcattggagaaacagagaggtgtatgacacagctacactcccatggggcttacagggcaaggtgagagaagacagaagttgtatgtgctgggtgccacgtggtagctacaaactagaaatgagaccaggttcggaagaggaagagggcttgcagacctgagtcatggggacagtttcttcaggaaatgggatctcagctctgccttgtatgcagggcttacataataaatatgtttcattgttgttgttgttattgttgatttaataagattttgttttaagaagattttgtaaaaacaactgaacaaatgcaatctcctgccagagcaggcagcagcaaaggagattaggaatataacccccttggagacgttccttcacctacctggtgctggattacctaaaagcttcagctaagtagggtcacccccccaagaaattattttaaaaaaattgaaatctgatatttttagaaaatcttatcaaggatatttaattggactatttacacctatttagggtcagtcggttttggacaagtatgcaggggtcttggaatcagaccactggggtcaaatcctagttctgtcacttcctagctgggtgaccttggacaaagttacctgacttctaatagcttcagattcctcatgggcaaaatagaaatgctactagtacttaatagtgctctgagaaggattcaatgagaaggattaaatgtatgtaaagcacagtgtttgcccataggaagctgttatttataagggaggggagcatcctaaggtcctccgaatttaggagaactaaaaatcttacactgacttctcccttcaacagcaccttcagaatctccttcatttttcatactgttctttcaaccctttgatgaatgagaaattaggcattctttccctgcagattttcccaaaccttctgctttggccaataaacatatttttagtcccaatcttgcatgctcctttgggacttttcatctgataaacatcccctcctgtgctcttgaatccaatacccttcttccctgccctccacccagagtctccttgtatctgctgttaggcacaatgatgaccccaccaaggtcagacaatggctgtggcctcacctggaccttgatgacccacatagcctagagcccagggatcagccactgatggaggcccagagggcagttggaaaacttcacaagacaatccagcctgattgttttgacatgcctgacttcaggctgctaaaaatgagctcgaggaatcagataggaaaaagagataggtgatgcaattttattccatctcccaattttctgagtcaagagttgtttgtttaactccagttaaattagtatttatccaaatttcctgggtgcttgtccaaagaaaagtaccccagatctacaaattagaatctgggactgggacttaggaattggcacttttacaattataccagatgtttctaatatgggtacttcaaccactacccttatagaagtgctgcctaggaccctctcttctggcaggtgaagtggaaggaggttttgtcgaagggagattctccacttcaacttgagtgtctcggcttgtatccgctttgtttggttctatttcaccaaaggctttcatcttcacataaattttcttcagctttaaataattagttttggtaaccattggtatactggaaagaacattagatttggagtccaggtggcttgagttcaattctctgctctgccatttaccagctgtgtgacattgggcaagttgccaacctatctatgtcatttcctcatgtaaagataatcccacttcaccaggccacttttgaggacccagtgaaatgatgtgtaaccattttaggaacactggatcattctacagtgcaattttttacatcagcttggagcctaccatgtaggcattcaaatccactgagtgtatggagctccgtgcacaaataaaaggacttctcttttctgcccgtgtacaactttggtttccttaatcaatagaatccatgacaatcctgggccatggtataaagatgggactttcttcctgtgaaggagtctggtctgaacatcttccaaactccaacataactgatgtcatttctccacccaaccccatttgctgtctcctgactcaattgctagagaagccacttaaggaaggttcctggagttaaggctgtgtctgggccagtgtagcgagcagttttcaacagtcagtcctctttatcttctcttttcctgcgagcctttactaagcactgcctcctcctgtctccttactgcatctcctgatggaatgcacaggtaaatctccttggagagtaccagccaggaacagtccacagccaaggccaccgatcctcaccgctgagctccatctttcctttcaagctgtccttcccctcccctccccaccatcaccatagcaacacagtggtataaaaaaatgaaagcgctaaggcatctaaatatagtctgagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagaggtaagagatttggccaaggtcacacagctataagcagtagaactaagattttaactcaagtttctatggccccagagtttatgtgtttctctctccataccacagggacaggtgcaagtgagagattttgctggaagcactgggctttttgagcaggccatataaaaattctgagcccagagctcaactaaattattggaagagactgggccaaatataaggcttctatctaagcagcacctgtgtttctcaaggactgaggaaaatgaagggggagggttggcaaggctgcatttcccagggtgcgtgattatatggcatgggggtgggggccattatgatgcccggacatggaacttacaccagtgcagaaagggtgtgattagaagccctaagccagagaatgttcagtgtgataaatgccattattttttccctcattcattcaatagattttttttttagatggagtctcactctgtcgcccaggctggagtgcagtggcaccatctcagctcacggtaacctctgcctcctgggttcaagcaattcttgtggtccagcttcctgagtagctgggattacagatgtgcaccaccacgcctggctgatttttttttttttttttttttttgtattttttagtagagacagggtttcaccatgttggccaggctggtctcgaactcctgaccccaagtgatccacccacctccacatcccaaagtgctgtggttacaggtgtgagctaccgtgcctagcctcattcaacagatatttttattaagcatctgatgtgtgcttaactctggaaatataggggtgattagaacaaatgcagctcctgcccttgtagagcttattaggatagtggagaagacaaataaggaaacaattatacaattgattgattctttacaactgtaacatgtactataagtacataacagaagaatatcacttgcctgatgacttcagtgaaagggaaatacagaagttcttacaaatcaaagcaatcccctgggccaattgtaaaggtgatgcccactttcaaggtggacagagactgtgctagaagcttagcctcaaccatgggtttatatgattggtagaccctgcagatccattcccaatggtgtatcttcatactaatcatgaaatccatctaatagccatacaagtgaggttttaaaacccaacaaactagactcaaatgaaatctgatgagggaatttatgatttgttcttcctacagcctttggtatcactgacataaaactgaatgtatgtgctgagggtgcttgtgtcttggtgatagacaaggtaggtggtccagcccatggtactggcagcttaaagtcagccagccatcagtgggaagtgcctgtgaattatgcaggagtgggaggggagggagtaggcagtaaagtaatgcatttctgtggatccaaagctttccaaactacctgcaagtcagcaaatatgggggatgttgtatgactaagtgagaatcagataatataatgtgtatggagctctttagttcttcagaaaaaaatgctgtctaaacaaatagtgctgatatcaaagataatgatacagtaccctaattttaatgctctgctacctacctgccagctgtttcccagggatgtggtaaagatgaatgggcaagatctgggaaagtgttttgaaatccttgattaaaggccctccaggcagatgtagaattttaaatgtgttatattactgccactattgttatgctttcttttatcaccccagaatttcaccatctcctgtttcaggtgaacgagtctgcctgactcttacctgccctgaatggcattggaaaggtagcagccctgagatgtgccatataaacaaacatgtttttaaccaagggatcaggaggccttcctggctggctcctgtcagctggtcatcacctctctataactctaggctttcccaagcttattttatttccatcaataggacaggaatatgtaaatgtcctgcttgaaatgagtattggctacaagccatctgcctctgaacagaggtgaaaagtggaaatcggaggaagggcagatgtcttttgcaagggaaacagactgttttctgccactgcactctgcccaggcaaaagagtaaaggaacagcactcaggagaattcactgaagcgagggcagagtgcaaaaggaacttgagaaattggtactgggacccaaaatcagattctggcatttctgggaaaagaaatgggcatgggtgggggttttatctgtcaataaaagcatccagaatggggctagaaggaagtaaattcagttgccacctctgcctactggacagccacggagaacttctccttatccaaggtcgaggagccctccggagtacatactgataccattggttctcccacacatacccccatggagataaaaacaggaccctggaagccctgtccgtgtttaaccaatgggattgaaacatggaaatgaactgccccacaatccaccctgtgagagaccaaagagcagtgttggattaacagggaatgttaccctgaaaaggcattcagcttccactggggcagcaggtacagtgcaaagatgatcccacttaaattcctaagacaggaaataaggaaagatgttgtggaaactcaagacctctcaaagcatactcctttgtagttcttccgcagaccagaccacggaattcagaaaacaccctacctggttccaaaccagcacctgccaaacttctcaccctcttctgaccctgtcctgggagttaagaaaaaaaaaatcactttattggttgctccagttataacttaaacagacagaccatcatcaaattaagtgacatgtacgactgcttattgtatgccagttactgtgctgtggggttttggttccattatctcatttaatcctctcaaaaaccctgttaggtaggttttattattgcactcatcttagattaaggaaactgaggctcatagagattcggtaatttgtcaaaagccctaaaacataattactgcctccagacgtctctgattctaaggcccaggctcttaatcagtaaatgatcaaatgaataatgattttcatggcatctgtcatcggaaagaacaatggagaatatgcttaaccaaagtcataaccaaataaatgaacttgacagcagagccgtgattctagccaagatgactattttcatgcatgttttgaaggccaggaaaaggaggttagacttgtttgggaagggaaacaggagctatcaaggtgaacttttcctaagagtagcccaataatagtgctcgggagggagtaatgtgtgcaagaatagagtcagggagaccagccaagtgtgtgcctcagcatccctagcacaaatcacacactaagcattaagattgtctctgcagtgagaaaggcctgggaccaaatttgggctccaccacttactggtattcattaatcattcatgcattcattcaacaaatatatattgcgtgtggtctatgtgccagagactgtgctgggtgctggcaaagaacacagacaaggttcctgctctcatggagcttttattctgatgaaggaaacagaccacttacagataaataaataaacaagataaagggaaacagatatgatggagagtagctggagggccaagcagaccgggcagacaaggtggtggcatgtaagctaagacatttaaaaagaacctggtcatgagactatctggagaaggaaagctccaggcagaggaagcaggtagtgcagaggccctgaggcaggaatgaggacaagatatttgagaaaacagaacaaaggcaggcatgaccaggccgagtgggtggtggaaaagtagtagaaggtgagtgggggagtgggggcatcaaggtcaggctttgcaggcttgatcagcgttctcactgtggttctggagccagcagcatcaatgttacctgggaacttgttaggaatgcaaattctcaggccccacccagacctgctgagtcacaaactctgggatggggcacctcattgtgttttatcgagccctccagatgattccgagtatgctaaagtttcagaattcctaggttggattatgcagttcaattttaattttaaatgcaatgggaacctatgaaagatttaagtaggggagcagcatgttataattttctttaaaaaattgtttttaagcactcctgctgaggagagaatggaccataacaggctaagagaaatggaagcagggagataaattaggtggttattgcaagaggccaggtaagaagagaaagtggtttaagtagggtggtgtggcagagaagacggttccaagcagagggggaccacgctgacaaataagcgcgggccactcacgcaagcccaacaaggcagaaggcagaaggcaaaagtgaaggccagagaaaactggacaccacctttccagagcacagttcaaaggcaatgtcctcaaagaagacactccaccctcctcccatttcctccctattgcctaaaaataagaaggatacgcggcctatggcaaaccttgggcaggcacgtgggagctgagctcttgcaaagggcagatagttcctctggtgagagagaaaaggaagggccagtgaggagtgaaggaagagacgaacagagagcccgaaaggctgagaacgttgtctggcttcctgaaaggcttaaggggttagctctggagggtgaactaaaagccctagttatattaaacacacacgcacacacgcacgcacacacatgcgcgcacacacacacacacatacacacagttgaaggagacctgcagtttccaaaaacaagagttgtattttttttgttcatatcatgacccataacaatctcaaaagagaaacaatctcttgtcttccttgtttaggcttaggagaacctgtagtaagtaagcagcagcagcggaactcaaactcgactcttcctactgtcattctctctattacaccacaaggcatcagaggaccactagagtcgcctccctagggttagggttagggcaaggtaaatgaagtgagtcagcaagggcaggataggaacctgtctttattaacattttgatattttgtttatcatggatttgttgcattaattgcaacttttaaaaatcattgcattaaaatattattgatcttgattactgagtttttaggtgtacccttaaatgttgcacctctgacttactagtctcaccctgatccctgtcctggatctatgcctgtctgttctatatcagcctcttgctttgaccataagaataacttcagacctttaagcatagaggaaataggatttctgtctcccttccccacctttgtgataatctcagcttctgcttttaaagtctatctcccaagtagtttgcctactatgttcctcccaaggtcactaggttctgtgaaactagcagcaggctagattgtcacattagcacaaaggatccactattcctgcagccgagctgggacaagcacttaggcccactgactccaacccttcaatagcctgggacctacgttgtctccaggtggtataaaacaagaatttcccctttgactgggagaaaaagggaagaactctaaattggaaaacaggtcatctcgaattctcacaggtggaaatttctgacaacccctttgggacccacaattcaacacaccccaaatggggacagtagctaacatgcaacctgtaggctgttctgtcatccagtgccactgtgctgcacaccaccagggggcagcattctcattggcttctatgtgcctggagcccagtgcagttgtgcaacactgcagctttgctttagtgtagtccctgatgggttcagtcaagaaaatgtctatagaatcagctaatctcccatgcagttaagtctctaattgaaatattttctctgctcagcccagggacagcaatctttcctggatttgctatttacaaggatctctagaaattatccaccagaaatatgggctttctcagagcttgagtggacagggaattaaggtggaaggcagggcgttttgactgcatttgacccaagtcctgaagagccagctcctctctcttcctaattattagaaggttttgtttggacccagtgtttcacgtgtatacaatacaaacttctctcttttctacttggatcaaatttgttctctcaaaataagattcccagcagtgagagaagacaagacagagagatccaacatctctaaagccatgaatcagataaccagccacttgttctcttcagtgctgggaacagatacactgttaaataaaatgattttatagattcttctcactgcctttccaagaaggggatttatcaacttcagggcacagcaatcatttattcccagactactggcatgcatatatatatatatttacttctcttgacttagaaaaaagagagaattggagttgtgaatattcctgtctccctcaccccagcccccttgaagtgagtcaggacaaacttggggcccaaatggagctgtaagtaactgagtcacatgcagagatgaaaccttcacagacccactgatatggaggttgaagattaaattcccctttgagaataactgggtaacactcatacagagactactttcaagaaggccagatcctccctctaatgtatagtgcaacgttcctaaccctcagcccactccgtcatacccccactcacatgaatacacacataagcagtaatataaagcacttcccaccatagggcagcaaagaaggagggaaatctttattatggaagagtggaaggaaggaagggaagggaagggaagggaagggtaagaggaagaattctcagggtgagcagaggaatgacatgtttggggcataatgaagataattgaagtgcagagtttgtatggaaaaatttgaaaatatcaggtggcaggccaggcatggtagctcatgcctgtaatcccagcactttgggaggccaaagcaggcggatcacctgaggtcacgagtttgagactagccgggccaacatggcaaaaccccatctcgactaaaaatacaaaaattagctgggtttagtggcgcatgcctgtaatcccagctactcgggaggctgaggcaggagaatcatttgagcctgggaggcaaaggttgcagtgagtcgagatcatgctactacacttcagcctgggtgagagagctttcttttttttctctcacaaaaaaagaaaagttcaggttgcagagatggatggatggatggatggatggatggatggatggacggatagatagacattacagagagtttccaattcttaggatgaattggaatccttaagtctttattctgtaagaaaggaaggggagaataaaattttgtgattttaaaatattttctaccctgtagagctaccctacaaggcatgaaaaccttaaaaaaaaaggcatctactttaaaagaataatgtctaaaaaattagaaattccctctttttgccctgacctttgggaaacagagtgagtgatccttttgaggtttttggcactgccttgcctgtgatcatatcctgaaccctaggtccataatcatgcagttacctcagatgtccctttccctctagccacaggtaacacgctctccaggcactgggaaagtgggtaattaggaaagcagaggagtacccatgggctgtgatgcccagttataaacccagacatttcagaattaacagaatgagcatcaagtcctcaaatgggtctacatccataaacatgtccagcagtcagctctttactgtcagtagagacaaaatgttcctacactttccctaggggaagccacatcctcagtaggttatctctgatgagtccagctagtcacaggtatgtagaagctgcatgcagcagagggctcaaaggagggtccagaatagataccaaagcaaaaggggagtctgtgcacgttctcacacgcaccccgaaacactctttttgttcacaaaatagatggtgtagggtagttccaagagatcatttagctcaggttcctgcctccataaaataaataagccttccatattagttgtctgttgctgtgtagcaaattgtcagaaacgtagaggcttaaagcaatacccatttattatctcgcaagttctgtatctcagaagtccaggcaggcttgactgggttctctgtccaagttctcgtgagactgaaatcaaggtgttggccaggctgggatcttatctggaggctctgaggacatatacgcttccaaccttattcaggccatcagcagaatcccgtctcttgtggcttgaggttggaggtccccgtttccttgctggctgtcatccagggaccactctttgcacctacaggctgcctatgttcctattcacaagacaccgttcatcttcaaaccaaagcagcatgtagaatctttcttgtggctcgtatctttctggctttcccttcttctttagccagagaaagttctttgcttttaagcgttcatgcgattcaatcaggcccacctggataatgtccctattttaaaggtaactgtgataccgtataacatttcaggagtgataacagcacatttacaggttccaaggattggggcagaacatctttgggggaacattttagaaactctgcctccccactcacccataatccttttaaaaaccaaatcttgaagcctttttttcccaaaggcctttttgaataagcacatttatacctaacttcatcagacacccactttgagcaaacactagcatgtggcaaaataggctgtaaatcaatcagaactattctttcccaccacaatctttctcaaacacattgggagaatctgacactgtcagtggtataccagagcagactcctaccatctcacaagagctgactgttaaatgtttagtaattgtggacattggttgttaaactattagtagcctgaaattgactatagtgagagtattttcaccatggaaagcaaccgttccaaatcagggtttctctttattcctgggaagctggtttattagctcaccactggctgtagtcctttaggggtcattacttgacctcctgtagcatgcaggaatcctctccatggccttttttatgcatggacatcatcctattttttaataccaggaatggggtgatcactctcttataagctagttcatctccctgatggaatggtatgtggtagagttgaaacccacctccctggaacttcccaccaacttcctttggaagcagcacttgtgacagccccagaaccatttggagtaagtagcatttcctccaggagacatctctcctctggatccacaaatcaatagttagatgcaaaatctttagagccacactgtttgaattcaattcccagctctgccacttatttagttataaccttaggcaagtctcttaacttttctggtcctctggttcttcatgtgtgggaatggggataaaaatagcacctacctcataggttattatgaatattaaatgagataatgtgtgcagagaaaatagcacctggtctggcctctacctatctaacaggttagttgtgaggattaaattacttaatataagcaaaatgcttagagctctgcctagcacaaaataagcactatgtaactattggtaagttaatttgaaatgtggtttctagatctctcatcatcctagtcaccctactctggatgtactccaaagtccctctcaagatatagtgtcagaattgacctaattagtccagcatttgactgaaacgctagactttgactccagccccccatccttgactggcactagcattcaagccgcttctcctctttccctgggtctttaatagagtcagagcgacttctccaggggatcttttggccatggaccagtagcatccacacacgctggggccttgttaaaaaggcaggctctcaggccccaccccagatctactgaatcagaatccacacattaacaagatgcttgggtgattcatgtgcacattaaagtttgagaagcaccgctttcagggacgagatgacacacttattttaaagagaacgccaattagagaccctaagccttctcatggaacaggggccttcccctcagaccttgggagaggggtcagggaaatatcagtgttgggttgttggtgacaggtggcggtggggggttcagtccacgttcaaagagccagaaacctggcaggggaagagatggggcagtgacacccaaccggaaaaataaaggaaactacaagaagaacccagctaagagatgtgaggcttctgaaagctcccatggaaaggttcgcagctcctccacctgctcggtccagctgccccaggtcaaggaagctctgtgagtgttagctgacccggagcagcaaggatacattcagaagtgatgaaagggaacgcttcttgacagggtaaagagtcattcagtaggaatgagacaggaagaggtcacagagtcagaagcccagcctgtactcagagattatttctggcatgggagggccgaagggttaggaggccacctactcacaatacaatacagaggcagatccacttattacctgcctgtgctgctgggatttcagtgtggaaattctgtgcctcctcactgtggctgcagcttgggaatgacatccagagcttacccacctgcataagaaataagctataggtgtaatagggggacataggctaaaatcctagctcagctgcttaatagctgtgcgactgagcaagttacttaacctctttgagcatctgttttctcatctttaaaatggaagtaatcataattgaccaggcccagtggctcacacctataatcccagcaccttggaaggccgaggccagtggattgcttgagcccaagagtttgagaccagcatggtgacacctcgtctctagaaaaaatacaaaaattagccaggcatggtggcaggtgcctgtagtcttagctactcggtaggctgaggtgggaagattatatgagcccgggaggttgaggctgtggtgagccagattgtgccactgcaatctagcctggagacagagtgagactgtgtctcaaaaataaataaataaaataataatatctatgttaataaagcagaaataagaatgaaataagaggcctgacatggtgacttatgcctgtaatcccagcactttgggaggtcaaggtgagaggatcacttgagcccaggagttcaagatcagcctgggcaacttagtgaggtcccatctctaccaataataattttttaaaaattagctgggcatggtggcatgcacccgtggccccagctactcaagaggctgaggcaggaggacggcctgagcacaggagttgaggctgcagtgagtcatgatcacaccactgcactccggcctgggtgacagagtgagaccctgtctcaataaataaataagaagaatgaaacaagaaagttcttcttatggttctcatggtggtgagcacaatgtaagcatatatattatcttagaattcttccttcctgtataaagaaggcctcctccaatgtattaatcatctgttcaactaataaatgctgcttactcccactttcactctaaaggaactcaatggctaaagagaacccttcccctttgcagcaccctgaggatcagaggcctgatttgaatgtcctcgatgcaaaggactatttcaaaaggccagccaggcagcccagacatgtatttcctaatcgtctccaggttgtttgatagaagatctcctgggagcaggtttccgcagcagctcagccaggtctgttctgggaacgctgtgtgcattggcacctcccttggcagaaagcttggaggaaaggcaggtgcaggtcctggagcctctgacagcattactggctctaggagtagctgctcaggataatctgtccccatgaccattaagtaactgccactgtgcgggaagaagaactggaaatggggggcccaaaaaaatctgaaaaccctcacttgaaccagtaagttataccctgggttgctgttggagagagcttccttggagtagacaaatgtggtatgttaagtaaactggggatctaggtttgatgatactgggtctgcagcttctttgtcccactgaaaatcctcgggcattccatgaaagtagccttcaaaatatttttgtctctaatgacatatttttgctgcaaaaagatgagtggattcattttacgaagtctcaagtgtgttagaaattcaccatgagtcactcagcaagttatgtttgagggcgttctgtatgccaggcactgtgctgggcactgggactactgtagcaagtcagatagacaagaacttgcttgatcttggaagtaagcagggtggggtctggttagtccttgaattggagactgcctggagatactggatgctgcaagcttttgaaaaaagacaagttctctgtacttgcagagcttacatccagtaactaactaactaacttcaggctgtgttgagtgactgaaagtggtggagccaggagtcctctagataaggtagccatggaaggcctctccgaagaggtgataagtttactcagagacgcaaacgatcaggataagcacagaccccggtgaagagcgtcccaggcagaggggatagcaaggggattgcccttaggtgggaaagggcttgatttgaggactgggaagaccagtgtgtctaggacacataagcaaggggaggacgttatgaacgaggtctgaggggtcagcagcgactggatcatgcaagctcccataggccatggtaagggctctgtgtgtactacaattacaggatgcatgataggacctgggctgcatttttaatagttaaccctggctataatgtggggaagggattgaagaaagagggcaaaggcaggaacaggaaaatctcttaggaggctactgcaaagcccaagggagaggtgatggtgttttgttgttgttgttgtttgttttgttttgctttgagaaggagtctcactctgtcgcccaggctggagtgcaatggcacaatctcggctcactgcaacctccgcctcttgggttcaagcaattctcctgcctcagtctcccaagtagctgggattacaggcatgcaccaccatggctggctaatttttgtatttttagtagagacagagtttccccatgttggtcaggctggtcttgagctcctgacctcaagcgatccacccgcctcggccttccaaagcactgggattacaggtgtgaggcaccgcgctggccaaatgatggtgttttgatctgggtcttaaaggcagaaggaaggggggtagtaaattaactgtgctggggaagagagggaggcctgagagtgaggaaagaatgaggggtgattccaggtttaggaaaactgggcaatttgttagatgatggtgccattgacagaaatgggaaagaacaagtttggaaagaaaactcaagatctggctggtgacttgtattaaacttaaagcctcatttgtgacttgagcagaagtaaggactttctccagtgttcaagagctggaagggatttttctagcctccaggcaaggtaataccataagtcccaacagtgatgccctccctgggaatgatctcaatgggagaatcctataccctgcctcctccattcattccttgctctgatggtggttctggctggctaacctaagttactcttgccactagttaacgcctgtccttatttctcttgtccccacctaagatgtcaatcaaaacagcacgagccatgctatgtcacatgacatgttgtctgtccagcccagagcttgttgctgatgggggcacagactagattttgagagaaatctctctgttaccacccttaacattccaaccccctctaatagcccatttaggatttatcatactgtttcatccaaacctttcatgacctgatttctatttccagcttcaaccaccccttgggtcaccacctgtacttattgagtttccctagttttctgaattaatgactgaagatgataagcttcccttacatatgactctcaaaccaccaaactgggattgttgttactcttagtgataatggttgctatttatgaaacttttaatagggaacacaaaccctgcccagaaattcatataaattatttcatttaagaacatcacaaagtaggtgctattatttgaccttacacgtgagacttgaagaactttagagcattgcccaaggtcacccagctagtgaggggtggaggcgggatttgaatccagctcatctgtctccattacctggaagaaggaaggccagagcatcatggcctttcacaagttgaagagccacgggctttctacggtagccagccacgcttttccatgactggggtgggtgtggcaagtgatgagggtttggagttcatgtggtggggtggcagggaccaggtgtcttggtaactgctgttgcattcacttcaggagcaaaggaccagatctgattctgcaggatcaacaatatggacactgcaggctctgtagacatccaaagctctaatggtgacttggggaagctcaggagggcagggaggttgtacccatttagaatgtaaagattcctattttataaaaaagaaaaaaaggagactgaaggcctcagtctcctccaacaaagccaggctgtggggtagcagagtctcaaagggtgcaggcccatggccactgcccagggctcctgctcaggcctcctcactcccacaactgaggggagacccagttccacacccacccacctagcagtgtctcacacccaccgggagaggtctaaacatcttccctgggaaatggtcccaaaatgtccctgcagtaagcaaccatctggagaggcccaggtctacatctgtttttaaagctccaataaataaataaatgaaggaagaaaaaaagaagaagaaatgcagaacagggtgactaaaattggcatgtatttttaaatgtttatattaacaaactaacaccttttaacatgaaaagcaatataattgtgctagccacaaaatcatcgtaggactgagaaaggaatcgtgattctgagagccctagagttaatgtgatccagctggctcatccctgtgactgcagaagcctgtttggagatagtgtcagtagcttttcaggccctctgtgaattgccagaatgtgtgacatgagccaaatttccccccagcatccccgccgccgccaccaccacccccgacccaaccctcccgccggctcccatagaatagtcactgccatacagaaaaagagaagttctactatttctgggcaagatttccacaaaccagtttgtccctttctgctttcatgaaataaaccatttggatcaacgtcagctgattgcaaaaattttcccttgtctcaaaagcaagactgataaggaagcaaacatgggaggaccttagtggccgagcctttatgtgtatgttatttcattgctctcataactgccctgggatgctgtaagcatgattcatcctgtttgtttatcagttaaattatgtatccaagattacacagcctatccaggattagaactcagagccctcggctgtgaagcttgagctctttcttttcagtcttcaaatatgatcatgccatgaagcagcacaaagcccaggaggagcccagtgaggctggaggggtccactggcagccactctcctccgtgcccctgtggtgttggggcaaacttggatctttctgaatcttttaactgtttccttctcttcccgtttttgtctgctggctgacttgtcctacactctactccttgcttatgatacttatttttccatccacagcaaaacaattcacatcaaggtaattgatgatgaggcatatgagaaaaacaagaattacttcattgagatgatgggcccccgcatggtggatatgagttttcagaaaggtgtagtaccctgtcctccacactaacactaacattcttctctcctcttctgtttcttcctctccaacccatttgtctcctcctcctcttgtcttccacctctctggttccctttcccttgtctcctctcttgctctctctcctgctctcttttcactcctccctctcctctgtcctctctctgcccccagctctgtcctaacacctgccagcctgacacatggcatccatacgagggatgctcaagaccgatggtaattgttctgggataaggaaatgagtatggggaaagaaagagccaaaatgctggagtatcatgtgcggctcttggcttctccagaatggctgggcataaaggggggaaaagggaccacatagcccagcaccagacagaagagcagcactgagaaacaggctttcagcacaaatttccatggggcagttattctcagggctaaacttagagtcccaggaagttgagaatcaatgtatttggattacagttcattcccctcccaaaagcaggctttaggagccaccttatctgccatgttgctactatcaagacttgtttctcctcctgaccttgaggaagctgaaagtacaggtttgagttccagatctaggtcaaatatccatttgtcttcctatgtttttcctattaagaacacccaggtgtggaggcagagagttagaatagtggtggagatcatcctgacccaaatggaagcttccccaagaggtccatggggcttctcagagtggatggaatctttgccttcaacttcaatgaccccatacatcccatggcctccaatagacaagtcaagaagtcctttcctgaatagatcatactgtggagcagggagctgccagtactgagggcaatgttccttccccttccaagctgtccctcatgccctccagtacatgcctgttgtcacagagcaccccaatcccatcccacagcagagttcctgcagcagagaaacaggctcacaccttgtagacagccctggggtcccatatctagggccaacagaaatattcccaaaaaaatgcctcttgacaatcaatgagctttctcttttgtccgctgagcaaggtataaaaagatgtcaaaagaagtacccaaaaaggtaataaaaatgtacagtcgtgcatcacttagcaataaggatacattctgaggaaggtgtccttaagcaattttgtcatcgtgggaaaattatagagtgtactttcacaaacctagatggtgtagcctacaacacacctggactatgtgggcctattgctcctaggctacaaacctgtacagcatgtgcttgtactgaatattgcaggcaactgtagcacaatggtatttgtgtatctaaacacatctagacatagaaaaggcacagtaaaaatatcgtagtatatagccttatgggaccactattgtagatgtggtctgtcattgagcaaaacgtttttatgtagcatgtgactgtacttgtaaagtacacacaccacaaatgcacagcaagtcctgtgccctacaagcccctttgggtcagtctactacattataaatggcaaagccgagcacgcccacagaaggtagcaggaacatcagaggatctgaagagacatttaggtaaatgctctttaccctttagagcatttagttcttagcctcccctcccccaatctcccccccgccccccgccaaaaagaaaaagaaaaagaaagcagaaaattacaattctggctcactagtaggacctgctagccaccattgtgattccatgaaggaccagaagaaaccatataggaagaatcaggcccacacggcaacctctccacatgacaaagagccagtctttggagggcagtgaatttcaaggaaagttttcttccctgggtgacttgtttttaaaagatgttatgttttgttgagatacccagagatgaacagaaacttccatcaccttgtgccccagacccatgataattcacattgaggaaaccagttttggaacacatcacccctaagtgatagaagcccaaaggtgatttagaatttgatgatttacatcattttcttcacattttcccagaaatgcatcagctgtaaatagtaaaggattcctatgtaatattgtggttaatacatatttattttagttcccaccactgaagccctatgagataaagaatgagaaagatcacacaattctacctccctttcttctctctctctctctctttctctttctctctcactctctctctctctctctcttctcttcctctgtctggttttccttcctcataaatacttttcttttaaaattttctttctgaaactcacaatggaagtgagtatagacataaagaagggacacaagccctgggttctgttgacatattccctgttgtgggaagaccctgggttattcccagtgggttagtagtttacctgttgcccagagaaatgccactgttatcatgtgacacccagtggaatgtgctgcctgactcacttcctactaactgttggcaaggtctaaaatgactcctcctcaccattacccgccttctgccttctcctccccttctgtccttctggctcccttcctttgcccacctttccttgcctcctggctccctgccccctcacccgtaagaacaactatgaccaagaagacaagaaaaactaagaccatttattacctgagaacaacacaatccaccatggtcctgttgaaagccaccatggtgggactggactgcatgtgccaggaatgacggggaatgattttaaaggctgtgctccaggtgaccaaccaatctaccgacccagtcgacacactctctctcttgttgtccctacaggaaaaccataagggttaaaatagtagatgaggaggaatacgaaaggcaagagaatttcttcattgcccttggtgaaccgaaatggatggaacgtggaatatcaggtgtgagattctttaaaaacaaaacaacaaaaaaaaagaaagaaaaattaaaacaaactgaaaaacaacaacaaaaaagaaaaagcagctatatttttgtctccctccttttcttcccttctcctcctttctctttttgaccaatggatttttttattcttttccctcctgtattctcgctctcaccctgtttcggtatcatctctgccttcttagccttagcttattccaaattcctcctttaccgccttctgggcagcactgcagcctcaactcctcattaccctaatgagttatttccctgttttgctacaattttcaattattcaattgccatgggcccctgcactctcccccaccccacccctacactgtaacctgtaaatgtgaaaattccttggtgggtggggaggagaagaaaaaaaaggaatgtgatgcgatgcatgcctgtgccccttcctgccttcctcccctgccacccctcactctttagcctggattgaatgtgggggggtctgggatgggggttggggcctgggttgcaatgatgctttgacagttttctgctgcattccccaacttcctttgaacgcttggcaggttattcacttgtggagtggcccataggcccctctgcccttcgaggaggtaagtgtattttctggctgtttcacagttgggcagaccgtggcatgggaaagtgtaccaattgtcagaagccacggcttctgagagctctgagagagagagttgacttctggggtaatcatgcaatctggaattctgagctattcttcctcctctgggcatcccaccccatgccattctatgttcctagcccaaggttgggtgcctcattcaggctactttgggacaatgcaacctctaaagcagaaaattgagagttcctgaagggaaggaaatagttccaggtatgaaaattcccgtagccaggggccccagaaaaggactgacattgggcaggcctggagtgttgacttgtggattttccaacagaagagactctaaatgatgcagttggtgctgatccctgacagacaggtgttggaaaggtcacagatgtctgcctttgcttggcatctgcaagagaaagtaccgcccagatcccaagatagccctcatcccacactagagaagtggcctcatctcctgctttcctcaggacctgcatctgagaatacctgccaggggctcatccctaaaggactgattatgttgcaaccagggtagaagtaaggaaggatttcttcccttgaagaaaatgattggaagccactactttgaatggcttccaatcatttggaggcatagatgtgggaatgggttagggtgctcctgggaaataacaagaggacgttcacactcccattcaggagagatatgctgctgggagcctcctagcaaatgaagcagtgaaatccacctgtttgtcaaaaaggggtgatcatactgcaattagttcatattcatgtgacaaagagcagcataaaactttccacacgaggacagagctaagagattcagcaacaacattcccaaaggattctctacaggccttctcagtgtgattggtcatttctcattgtctgctggggactctcctgcagagctgaccacttctgtgcctgcgctggtttggacacacctgatgctctaggggcagaactcctctccttcttcactgctggttctcttcgtcaccactcaataaaacgttgccctcagcctgactgccaaaaagtgctggaagaaagaaattatctctggttctattgtttcccacattgtattcttgcccaacttccagttcttgccaccaacaatattctcagaggttgcctcagcacctgccctacctcattcccacctcccttgagcatttattccatgtattcataattggttggaagcagcagatacccaaggccaattgtaagtcaccttcatcagtttccacagtccaagctacttagatgcaaacgaaagcagcacatgtacagcgtacaggaaggaaggcagtggttccagacaagaggaagagattggaagtccatacatgcctttattccaccagtaaaaaggctcttctcttatgcctcccttaaaacctctaccaacagcaggacagagagtgacccaagataagtcttcaagagacctaaccaaatgcaaatgtctttggctaatccccatttaaggacatcttcctgttttgcacagattctttgcccaaggaaatgtcagcaatgccctcgtggagggagtaggtgagaagacaaggatttcagcaagctatctgtgtggtgtgcccccagatctccccagtgaccgagatgccaagatgaagagtgccaagaagaaattggtcaattttccagctgcctattttattgtctatgttttctaggcggttaatttccagtttcttcagtacttcccgtattttgacattagaccataaggtgaaaggtcataaaacctgattgtctagactcagaagcaaatggaaacccatccaaatttccagaattccctgctgttctcagagtgagaaacagaacagtggaaattgcttttcattatcactactgcatgggagagtctgaaacattcagaatggcatagtctttgcatggtcaaaatgacaattgcattaaaaaaatgagagactggatttgaaataggagactctatttttggcaaacaaaacagacttcagagttgagattaaaagctctggatgagctgggggatggaaaaaagggaaggaaaaaagggagactgaataggaaacacagttgctctggagtctagaagtggacttccgagagcaacactgagcaacataatcaagactgttgggcctgggcctggacattggaagccttcggatagaaaggaaagctctctgtctctctctctctctctgaagaatggggcctgtttggtcctcctttttcgacaaccgtgggctcatcttgacaagctgcccagatgcttcctaattactcacagtcctatgctctttccagcttgtccctggggtgtctgagcaggaataaatgactctcacctgacccaggggatcaatacaggggaaagttcagctccagcttctctcatgagcagcagcaggaaaaacaccctcgaggtattgtgtcagtcaaagctggcctacccaggtcttgctgacccatctataactgctgagcagaaagtcttggattcatggagacaatgaccagagaatgatggaattccagccaactgcaggccttctcactactctagggatgggccagatgttcggtggcatgtatgagtgaaaaccagggcatcagggacctttctggaagagctgcctttgtctgacccacctgtgttcatttatgtgctgggatctctgatctcccctggaacttgggggaagctcttccacgcaaactcccggaaggagcagaataaacaagctcttgcctatctatctatctatctatctatctatctatctatctatctacctatctgcctatctatatctatctatctcaatgtagtgaggaaagccattgatccattaacctttggaattctacatgggagatacctaaaaaagtgaactgccttgtttatgtatcatgcagactctggatccacatatatctcagtggctgtgaatataggatgattgatcacaggcctgagttgcattcctacagattcttaggaaaaaaattgattcacagacatgtcccccctggttcccccacaacacacactccttcctcagcaatctctatcagtcaccaactacacgttgaatatgtggcaagctcttcccagacctttatctgagagccaaggagtgaggggctgtactaagatatcatagaaatgaaaatgtggtgtgtcacaagtttccttaattcttagatcttaaactctaagagggttcagcataagtacaaattcaagggctagagacaacctgtattgggtgtgtctttaactcagtttcccaatccacatagggaccttgcatttgtcatctctcatctatgtatagctgttggtatgacagtttctctgttccagaatacctgaactctgacttagcctgtcctttctgaaacagaaaaatcacccaaccagagatctatgagatctatggaaaagacagttgccaaaatagacagcaaacagccaaacttaattgaacactaccacatgcagggactttgctaagcagaggtgatacaaaatgggaggagcccatagccctaacttccaggatatatctacggtaaagacaaaccattcaaggaaaacattctgcaggacttacctttttgctaagtcattcttttaggggaaatcaaagttctagtcaacgtggcagctaggaaggcatttgtggtgatggaaaccttatgagcactgagaagctgagcatgagttcagctaagtcgttagggatggaagacatagacctgggcactgttccactcttgcacaatgctacccatttccttgagctcccattcaagccccatggtcatttttgccactcataagttagctactctggcagggttgcaacttacacagttttcatgataactggattctcactcctttttttacagaatggatgtgataacctggtatcctacacagtcatgagtgaccaacctacccatttggttccccatcctcattcctccattcctagccctagggtagccgggaaagcataggagcaaatgcccttaccagggccctggtgctcagcagcctctccggctgctcacacctcttgctgctgctctgtgcatgctccaaaggcttctttttgcgtatggctgctgagctctcacctactaagctctctgctttccttatgctgccagcaaccacaaaacctggtgatactttcaagatgggacattaatgctctttccttttctttcttccatttttctggtatccatttgcaaacagcgctcctgttatctccaggtaagaggtgtcttgtccccctcttttctttccacttcttgccagtgccattatttggtttaagaccaatgtcctttgatttattgaataagaactgcaggctcaagttaacctgacaatttctcccaaggactgggagatttattttcccacatgaagaaattatgagaaagcaattgtgaggaaggcaattccttgagcatcacttctgtctggggacgtgggttaaggcatagctgatcctctctgggaccaggaagagaaattaagcttaacaaggagatggtgggtcatagacttctcctgagtcttaattcatctgccatctcatgttgtgggggaagagacagtgagattcagagctggaatctcctaatataattgtgacaggatttgaaaaaaaaatactttaatcccaagggatccaggaaataaccaaacctgttgtgagaataggaaatgcaatttttaaagaatctggaattttaccagtcctggagatcttccatctcatcacagctgagacttaaattgctagaattttggttcatttgtcattgacccttaaagtcctatgtgccgtgaacaagatgaattaggatgggggattggggcagtgttctggctggaaatataaattttagagaatttattttgaagagattctcatgcagaatctaggtgctatagaggacgtacacctactttgagagtatgcttgcatgagtggaaaccaatcataaacaacattcaacttcatgagcagatatgaaagcattttcagcatatctagcaatactataactctttgtgcaagcagagtggcctacacaagacagtttcaatatattttaaaagaacgtcttacatttcatcagtcctttgaacacagaaaaaaatgttaaggccacttaagaggcaaaacatcttacagagttcatttatattcaaagtcacctacaggctacatcttgggttcaggaaggggcggtgtacatagtaaggacataagccttctgggagccttaaacaaacaaaaaaaatgtaggtaactcctacatttttcttttgtggaaaaaacacagttactccagcttccttggctttttgcttcttttttataccaacaaaataagggctatcctcaaccctctgttcttcattcttctcccagggtattgatttcataacattgggtttttcttctctacttcactcatcctcttgcctgtgaaggtatgtaaggcttctttgttccaactctttcctccacccgccccccctcacataaatgcataacaaagattgtgatttaatttaagtttctttctacttttaacatatttgcaaacatcaatagaagctaaaatgggaaaaaggaaatgtttcttttcctagctctttcaatctgtaagcctttaatttaggagcgctgattagcctttcaattcgttggaaatctcaaatactggttttaattttcctaggtggacagagacagagggaatatgttcattctgagctaaccacccccccacccccaagctcaggcgccttgcaggaagagcactagctacatcactctgcagagtgttcacaacatcctattcttgtctggcctggcaagctctttgtccttccaatatttgttcaatcttccatcctattcatattctatctttctctcccctcccagcctctcttcctgttcctagaactgagagtttatttagtcagtctgaatatctagatcacctgccatttattctctttacttgaaattctgaggagtcacataaacaagatatcagaatcactatggtcctctaaattgaagacttataattctctcaagaaattaacaacatttgaatttaaaggaaagatcatgacaaaaatagaaaaaggcaggaattattgccaaaccgagaaactagaaactagaattaacttaaaggcatgtgactcaatcaattaacaaatatatacagagagcctctgtgggactgtgggagatccaaagatagaggattggttatttgtcaaagggatttttgcagaaagctagatggaaaaactgactgtcaccacagaggtggacaggtcagtaagtagatcaatatcctgccagatggatatagtgctagattgataggtagacaaggggttagacaggtacatttatatgtcactggagagctcattatattggtataaagttattgtgtcacatgtaaagtatgacatgggggaattggggaggaaggagtggaataatactgtcgctgctaagataggcattgtgatatggtgcttaaacctgcaagtaaaggaaaagagtatggaatctgtgtgtctttttctaagggctttttcccagagtagcttgcagtctggcttctagggttgctggcctatagccagaaccctagattcacccagatttaccttcagaattaactaatcagagactcaaattcaatagactaaatgaagtcaggctgctagaggatgtctgctgacttggacatatgcagaaagacatggatccttgagaaaacattgtttccaaaagtggccaccagcactagaggaaggacagcaccacggacagctcccagacattttaggattgccttctgtgtttggtgcccgaacactgagcaaaacagcgaactcaggaagtctccacacactctcataccatcttcatgcagtccaactaagaaaattcttacataaaatataaggctgtctgcttggtaatttaaacccttggcttatagtcttttcagtgaatttctttccttgcaaactcgagagttggagtctcacgactgcccttgcttcaccaattccccagctagagacaaaagaccttcttggcctctgacccattttgtccttgagattatccaaggactacaggattcccctaggaggtttactgtgtggaatgaaagcaattaaggagctgaataaaagaaataattgcatgtgagaatgtggacttggatgggaagatgtttaaatgagctctgaaagaaacaagctgccaagagcaattttctaattaaaggggaataaaaagattcaatctctatttcactctaatccagaaaacatgtcttcatggagaagtgctcttaaaatggactcatcagccaaagtggaaaaacaaaaaacaaaaaaactgttcaacatgagaagggaccattggtaaatgagtcaagatgctgtgaaaccagtagacatttcctttgaataaatgtacttctgcaccttcaagaactcttacaggaagtggttgaacaaacaggcccaaaagttcaaaatagttcaaggtcaaaacacttgccctttcttcccagttccccaacatctcactgagtgtcttgagaacttcacttgatgctatttctcaggagatgtttaggtcaggttgtccacccaggtataaaagagaaagaggaacgcttatcccagtctgcaaggcacattctcatggtctggttataaagtgtttagtacttcataaaaaaggcactaaaaatatatataaactccccattcccaagagttatttgctttgtacccactgcccatgcctaatactctgagctgtatccttccagggaatggaaaaggtgttaaagcgagtctgattttgttttgttgcagatgtgacagacaggaagctgactatggaagaagaggaggccaagaggatagcagagatgggaaagccagtattgggtgaacaccccaaactagaagtcatcattgaagagtcctatgagttcaaggtcaggcaaacagtgaggtctaattgaataataaataaattaaagtgggaggcagaagacctggggtgtttttttccactttcactagtgaatatgtgaagttgaaactgaacaaatcacttacccaccccaggtctcagtttccccatttgtaacatgaaacaaatagtgctgaccatttgtatgctaggaatattgttaggaaacataatatagaatgtgaaataagtggactagaaagtcctgagatgtattatcattattgtttaactgtgtttttaaagcaaaaatattaaaactcactactacagggcaagatatattaacatcattattattattcattattgtattattctaaatagccaatttcaaaagtcacaaccaggccaggcagtgagggactcacgcctgtaatctcagcactttgagaggccgagatgggagggtcacttatacctaggaatttgagaccagcctgggcaacatagggagactccatctctataaaaaataaaacaaaataaaaatcagctcagtgtggttgtacatgcctgtggtcccagctactcaggaggctgaggtgggaggatggcttgagcccaggaggttgaggttgcaatgagccatgattgcaccactgcactccagcctgggtgacaaagtgagaccctgtctcaaacaaaacaaaacaaaaagattacaaccaaaaacaaagggaaatagaaggattgcctcaaaagagatcgcccaaggccattccatgcgtaactgtcagaacaccttggagacagggcatctttcattcctttgaagaaccagactcctcattggttctgagcattctaacctcatggttccaagtttttctcttcttaacagactacggtggacaaactgatcaagaagacaaacctggccttggttgtggggacccattcctggagggaccagttcatggaggccatcaccgtcagtgcaggtgagaagtgtctcaggctggccttgctgggagaagcaggcaacctctgagaaggaagcgtaaagccacgttaacagcctgccagtccctaggaaggcttgtgtgttcagtcttcccagctctggtcctaggtgcctgcttggaaaagaatcatggcgtatctgaaaaacatggttatctctggtttcaaatcgttgttctgctgtgtgaactggaacaatgtaccctctctgacctcaatgtcctctttccaaaggggaactattgctacctttctcagaaaagtagaaaggtacagagtcttgtataaaatccaaactcaataaattctgatttctgtcattctttcttttcatgggtttggtcccgctcttctgtaaaatgtgggacaattctgatttagagatgtgggagttaggagtttataaaatgtgttgcattgactctccaacaaaacactctggatgattccatacccctccctcggcatttactgacaggctccctcagtagtgacccacagcacagccgggagtcctagaagcctgaggggactgctggttggaacagggacggaaaaggtctcccaaccaccatcactatcacctctcagcaccactgaggcctcctggccttgtcttttattgagagactttgttgtcatagcaacccacagggtcatatccccaaggccccagagccagagcaaaaagacagccaggaagagaggtttgctgctgctgctgctgctgctaccccacttttctcatcacctgctttagatctttctagctccccctctgatgacctgactgtgcccctcaagacaataaacggaatgtaggccacatcatctaccctgctccttttacaaaggaggggactgaggttcagaaataagagatgatttaccccagcttacagattttcttcatggcaaagctggaatgagaacccaagtgttctgactcctgttctttcaaaccccagcttctaccggttatgccaaaacatgacagaagttgccgttggcaaggcacaggcatgcctcagcataccctcccctccagggctgctgagtgggcaactctgcccacatttcctggcaaggacaatcaaggcccatcctgctttttcccatgagatgtttggaggagggcactggctctgcagtatattctcgtgatctggaatgacagccatccctcaggggacagataatgaccagaaccacaatggttattgcagcagtcaggtcagaaaatttgagaggagccctgctggcatccagtgaagagtggccacaccgaactgatttcacttctctccttagacaacaaaatgcagcctgtgcattctcctttctttttttttttaattatacattaagttctggggtacatgtgcagaacatagagttttgttacataggtatacacgtgccatggcggtttgctgcacccatcaacccgtcatctacattaggtatttctcctaatgctatccctcccctatccctcacccctgacaggctccagtgtgtgatgttcctctccctgtgtccatgtgttctcattgttcaactcccacttatgagtgagaacatgcagtgtttggttttctgttcttgtgttagtttgctgagaatgatggtttgcatcctcctttctttctgctccactgtcttgtccctcttaatctccttctttcttctcttccttattccctggccctctctctcccactctaccttggtgccctgcattcaaattgacctatgaggcagcccaaattgtttccccactattttctggcacgctggccctggcccccaccagctgcccagaagacagctggagtccccttctagcggatgatgcctgtggtgcgggttgggcttgactttctcatgaatgattatctgacttcgttacccgttctcttgcctgtttatcttgccttcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccaggtgagagtgagaggtgcttgaatttgcaaagaggattttacctggttcaaatgacccctggactccatctcattatcttccacaccatctcagatctgaacttaacagagcctctgcccttaaagtgcacaaaagtcaatcaaagagatgaataatgacattagtaatgacagctaatatttcttgagcactttcaatgtgacagacaccatgtgtgttcagcaatttacacatttacattttccccctgtaatgtttcccaaagccctattaaatagggtaagttattatccccacttcacagacaaagaaactgaggcccacagaggttaagctacatgcccaagtaagtggtccaatttcttaacctccacattatgtgagtagaccacaaacagtgaaattaaaagaatgtagatattgttctccttctatttacctctggcgatctctgagaggttaaagattagccagctcaaagatatcaaaggagaaatgcccacatacattcttggcctcctctacttggaaggacactgtgagtacaaagtatctcctagcaggacagccaaaggaagttccacagcttttatctttttataggatgaattacatactctttctttttcttaggaacactcagagacaaacagaaaggagcggacattcctttactcattgaacaaatatttactgagcacctattatgcctgttacagtattgtgctagtttttgggactatagtgaaaggcaagatacacatgcttccttctccacgtggagtttataatctactgaaggaggcaactctcaactactgtaattaaagttatcttgttaaatcctaggaagaaaaagaaaaggtactgcatacggaaggaagttgggcctgaatgtaggagttagcaggtagacaggggctgcactagcccaggttctttacttaattcagttaggggctttggggcctctgaactctgaacttctgccagggagctggcatcccagttgccccagaaagaaacagagcacatcctcctgcagggaagttaggctgaatctcatcagacaggacttttctggctgggccaagggaaatctttcctgtaccaagcaaacatatccttcaagagagtagctgaattcacatcaaattctaggaaaacctctttccaaaaccccagcgcaggccagcggtattatttgtccattagtgatgcaagagatttagctatcgtggaaatgcatcagaaggttggaaattagatggatgatcccaggaaggcctgtggatgagatgccctgtgatctctgttctccaagccttgggggacctgaactatcagaggggagggaggaaatatgggggaaagcatagaggtgggaagaaatatcagaggatcagaagcaaaaaacaacaataacaacagaaacaaaaacaaacaaacaaacaaaaaaacaaggccataggcaagaaagggtaagaggttttctctgggagatctaaaaaaaatggcaataatgaggtaagccaggcagatacctttgggcatctccaagtccttgcaattggccaagacaacagctaacaacatttgaggctttaagaaggttaccctgtgatccactcatctgatttagtggctttggctgaagctctttggatatagttgaaggtatggaaagggtccttacatgaggactttagggtcaagtctcttgctaacatcctatgtgaccttgggtaaattctttgacccttatttttcttacctgtaaaataaaagaattgggctagatgtctctgacagtcctccctgtatctacaatctgtgccaagatctaaagtcaaacaccctgcaaggccctgtgatacatatataaaccacaaagacagagccccgtcttccttgagtccacagttcaccctgcatgtccccatcatggttccccaacatgtcctctgtccccaaaatccagcacctcacccagtgctcaatcagtaggcattgctcaataactgttggtggttcgtgaataaatgccccatatgacagttaaaatcaggcatctactccaagcagcttcccagggtgtcaaggttccctggggagatattatgggatggcaaacttcccttactgaaaaagtagtcaaaggagaacaataagcccactcagtaaatatcagaactggaaagcccttcagaatctttcagatcactgcagatgaggaatgggaagcccagactagggatgtgacctacccagggccacacggcttgcttgcggcagaactaggagttaggagtggccccctagcccttgtctctcattcctgggttcagcccaccagctcaagctgctttttgggcatactggaagacaagccctgcacaccttagcctcctaccagttcccatgtgtctttgtccttttccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 161 - DNA, 30991 bp, Homo sapiens
gcgagaaagaggtgacattgaagaacaagcccacacttctggatatggtccaaaatgatcagaaactcactctgtcaacctagtaggtgtttggatggatacctcttttttaacagaaagatgtttggagccaggacacatggttttcacattttaatggcaatgctcataggtaactaactctcttcttatatacgctaatttgcaacatgcttagtgtttttaagatgtttatttagcaactattgtttaatgctataacagatattactatcaaatgaaaattcaaacttttgagaaaggaaaagtggatatatttatgcattgagtttttggctttagataatttctactttgatttctatttattaaaatttttaaaatcctaagtcaatcaaaacagatcaagatgaaacttcctcatttgtatatgtctttgtatatatgtctagtatatatatatctagggtaaattatataacttcatattagatatttcattaaccatggcttcagcaaagtgagaattatgacaaaaatcatcttcatatccaatgatattaattctaaatataaagtctacgttccttttatccattaatatgatttattctcaaggaaatatgagatataccaagtggtagaaatttttgctatcatgattatttttgaaatacagtattattatggaatcagatactgaactaaaaaaattttaggaaagtaaaatgaggtgacagtttttaattaattaaattaattgactttaagcaaataacaataagcttcaagtaatccatcccatactataaataattgcacataaataagcaatttgtattcaactaaaatacccaattaagaagactgaatggccccaatggtcccataaatatgtcctaatccttttatcttgattgacaacagatcttgttctttgcccagctcctccaataaccaataggagacatttttatcttttttcccacttttagttttctgggttcatcaaataaatatgttggactttattttacattggacatgtcaatagaattgattttaagtgaagtaaaagcataaatcgctgtttatcattctacttttcatacctaattctgtttgctgttcttcggactattgatcttaatacaggctttctctcctttttttgttctttttaaagtgatggtaaaatttaaaacttgcttttctgtttatatttaaagaaacacataatcaaattattgacattttatgaaagatcaaatgcataaattttagcaatcataagaaaaaaaacagtaggcaatggtatagaaagcatgaccatctgcacttatttgcccacaaaggataaatgagagtgtactgtaaattgtaaagaaataaacatcttatttcaagctctaataagcttatgtgtcaatagttttaatagctgcctagttggtcttcctgtctctactttcttcccacttcattctgttacatatccctgtgaaggtgatctttatgagaaaccatgttggttttctgtccaacaattacgtatgactccccactgccagaaaataaataaatacagctaaaaacctcgtaagttcccagaccttctccactctggctacatttaacctttgtgtgtttatttttctaggtaaattgtacatgccaaccagattgccaaactcattgtcacctctaaatgttaagctttcccatcgatgagtgttttgtttattcacttatttacacacacaaagacctctttttcttttttcttttttttttctttttcttttttcttttctttttttttttttttttttgagacagagtctcactctgtcgcccaggctggagtgcagtggtttgatctcggctcactgcgagctccgcctcccgggttgacgccattctcctgcctcagcctcctgagtagctgggactacaggcgcccaccaccacacctggctaattttttgtatttttaatagagatggggtttcaccgtgttagccaggatggtctcgatctcctgatctcgtgatccgcccacctcggcttcccaaggttctggcattacaagcatgagccactgcgtccgcccacaaggacctctttatcaacttgacctatatttgaaaacctatattaaattctatttctataagaccttcccagccaggcctgaagagatacccttctccagaggctctgcagcagctactgcccaaactattcacttagaatctattgtgtactgtctagtgaaatctcttcagtattgtcttgacttgcactatcatttagtttttcacaaatttgtcttacttttcctttattaaattcattgaggacagggactagttcgaacttcatgttatctgcaatattttatacatgatatgtaatcaatatttattgatttgacttaaatttaatatgaagatttcatatctaaagatgtttcattatctatcattcaaagtatttttcctaaaactttcctaaatatgctctaatgttgcctgagttttattctcatatattatcgacatctgctgggaacatactatgtacaatgcattttcataaatatatattttgtccttccattatattgtaaatacattcaggctaggtctacgtcttctagtttgtagtctgagagtactctgagagtacatcatagagtagctattctataaattgagaaaatggtcaattgaaatttcatctaaggggtcaagatatggttgctgtcaggtaccaaagtgaattatgaaagaaataaaaacacaagatgttaaagtaaatacagataacagactttaggtttttgaaaggtttatacttttttattttttattttattttatttatttattattttgagacagagtctcgctctgttgccccggctggagtgcagtggcacaatctcagctcactgcaacctccgcctcccagattcaagctattctcccacctcagcctcttgagtagctgggattacaggcacacgccaccacgcctggctaatttttgtatctttagtagagacagggtttcaccatattggtcaagctggtctcaaactcctgacctcatgatccacccgcctgggcctccaaagtgctgggattacaggtgtgagccaccgtgcctggccaaaaggtttatacttatgtcagggatgtgtgaaaattcttcagaggcaatttgaaggagtgggtctataaggagatttcgttggagaggcttgctgctgtgttgtgagttgaaccttactcatcaaattgagggctggatgccacattctaaaccagagtgaccatagcttccaggagtgctccagtgtcatctaaagttggtggaagggaaggaacaggaaacttagactagattctccacctgcctgaggaatccaaagatgaaaaagcgtgatgactcttaacccgaggtgtcaggaaagagagagaaagaattgctgctgtgctgtgttggaaagtaaatgtgctcccctcctactgcaggttaagggtacgtgaatcctgtggtctagatggggaacccatggtaggagcattagtaggcagtttgtgtaaaaatagttcttcccaataggcctctgttggaaggtcaaagaatcccactaaaagagttgataaagaaggaagaaggagtaaacgtcagtaaaccaatagcaaaggggttgaggaaggagcaaatatgagccgccagtaaaaagagaggcaacgtctgcctgccttcacagttctctagagtgagtctcagctgcaggaatagagtgggctccaaggaagtcataagtgtcccttataacaaataccaactttaaacacctcccagtctcagaaaccatggagccatattgtatcagtcaagtgaataatttctgtgcccccttccccctttttttgccaccaagttcagtcttctaggggacaaaacacataaatctgaagatggagacaatggaaggatagaaagagggaagaaggcttccaaatcttccttcaagacagcctgaagttagcctagcagacaaagacgattttattctaaattgcattgaaatttttgatcattatatgtgactgaccattcttattgctttgtttttttttttaagagatcgtgacactactatctaatagtgagccgaaaagtcctggggtctgctgaagacttatctagaggcaatgaaacccttccccagttaaatatgtttcaagatagggtaggagaaaaaatcgtgttttgcttttgttatgccatatcagttgttcaatagttttaccctcaatcaaatacttgttattaatttttttgttcttaaaatcctttgaaaatcaagtttaagtaaaatatcttctaatacaaaagtttcaacttttcatattcagttatattaaacttgtattggaacacccctttagaatatactgtagtttacctgtaattcctgtgtcagttttctgtgcttcccaggataattgtataacaaatagattacttccattcagttctattctttctatccatcaaacatttaatcattcatacccttagcactgtacaggtgctgtgggcgtctctaagaaagattataatatgtccacggttttcacagagcttgaaatatttttgaattgacaaagcttgtatgaaagtaatcccagtacagtaaaatataagtacagtagagtccaatcaagtgcctagacgtgtagatcataaatggcagtacatcgtcagattaacatttcatacgtttgtctaaaagtttacacaaaaagatcactttggttttggatcagattaaatgcattatataaatatttaatcactttaggaaggtcatgatgaattcattcattccaaaattaattactaaatggtgaatacaagccaggtactatgctatgttttagacatatattggtgaataaaacaggcattttccttccttcatggaaagcacaacttgatgagattctagactaatatgctgtccaagtaaatttctcatataaaattacgcaatttacaggacactacacatgcccacactttctaaatagtctctctcaatgactacagtactatttgaattttgtcattagagggtaattctttcctactactttttagtattggccaaaacttattgagaacttgttatataccaaacaatgttatgaatatttacatgtcttaactggtttaatctttaaaagagcctcgtgatgtaaatactattattaatcccattcatagatgaggaaacaaatatagaaagtatatgtgacctgctcacaatcaagcagcatagctggggttctgatccaacattatcaatataggaatctttggtttaaatttttaaaaacacacatttgggcatagagttaaatggaaaaataagacatgcatattaataacaaacaataaatgagaatacactaaattattaattaaaaaactgtgtgtcagattggattcttttttttttttttttgagacaagagtctcgctttgttgcccaggctggagagcagtggcatgatcttggctcactgcaatcttcacctcctgagttcaagagattgtcctgcctcagccttcagagtagctgggattacaggcatgcgccaccatgcttggccagtttttgtatttttagtaaagataggatttcaccatgttggccaggctgatctgaaactcctggccttaagcaatccacccagctaggccccctaaagtgctgggattacagttgtgagctaccgagcatggccaggttggatttttaaaacctagttaatttaggccaggtgtggtggctcacacctgtaatcccagcactttgggaggccgaggcgggtggatcacgaggtcaggagatcgagaccatcctggctaatatggtgaaaccccatctctacaaaaaaaaaaaaaaaattaaccaggcgtggtggcgggcgcctgtagtccaagctactcgggaggctgaggcaggagaatggtgtaaacccgggaggcagagcttgcagtgagccaagattgagattgcaccactgccctccagcctgggcgacagagcgagacacgatctcaaaaacgaaaaaaaaaaaacaaacaaaaaaaactagttaatgtagggtctgatgttagaagtgctttggaacttagacttcactctttctacacctcaatttactctgtgaaagagaactaagaatatctgctttgaaaacctcagaaaattgtagtgagcacaaatataataatttgaatgaagatgttggggaaaccataaagtcctacgcatatgtctgttcttattgttactctttgttcatttgaatctccctggaaaagcaacagccacgcttattaaaaggtgttatacgtattcatattactttttttaaatgaattctaataattccctaattagatatattttttgacttggaatcagaaaaaaaaagtagaaagtgaagttaaaataataaacaggaaaggagcttgttatggtatagacatcatgttttacactggcattgcagggaaggaggaaatggggccttccattcaccttagaagtccttcatggtgagagttgtttggactatttatatttctggcaaacttttaggaattatggggaagtataaacaagatataaggcaaaatcactgtttccaagtagaatagagtgaaatctgcagccagggacagaatatacaatgtctgagaaaaaagtctcgaaataaataaattgtatcttacatcagtgccaagagcgatcttttttcttgtttttgtttgtatgatattcagtgctgcatgtatatctgacagtgatagttggaatcaatcacagtatttggcaaattattcctagaggaagaatacaaagcctgccatgactgcatcttttttcttcatgacacaggtggaatatagaattgattttacttttccttattaagtgtttacattttactccattacagtcctaaacctgagctattcatgcacttctgcaagattatacaagtaaattacgtgaaacttctatttttgatgtgaatatatataattttagcccttttttattatttaacaggaatccactgcgaagaagacgtcaatgaatgttcttcaaacccttgccaaaatggtggtacttgtgagaacttgcctgggaattatacttgccattgcccatttgataacctttctagaactttttatggaggaagggactgttctgatattctcctgggctgtacccatcagcaatgtctaaataatggaacatgcatccctcacttccaagatggccagcatggattcagctgcctatgtccatctggctacaccgggtccctgtgtgaaatcgcaaccacactttcatttgagggcgatggcttcctgtgggtcaaaagtggctcagtgacaaccaagggctcagtttgtaacatagccctcaggtttcagactgttcagccaatggctcttctacttttccgaagcaacagggatgtgtttgtgaagctggagctgctaagtggctacattcacttatcaattcaggtcaataatcagtcaaaggtgcttctgttcatttcccacaacaccagcgatggagagtggcatttcgtggaggtaatatttgcagaggctgtgacccttaccttaatcgacgactcctgtaaggagaaatgcatcgcgaaagctcctactccacttgaaagtgatcaatcaatatgtgcttttcagaactcctttttgggtggtttaccagtgggaatgaccagcaatggtgttgctctgcttaacttctataatatgccatccacaccttcgtttgtaggctgtctccaagacattaaaattgattggaatcacattaccctggagaacatctcgtctggctcatcattaaatgtcaaggcaggctgtgtgagaaaggattggtgtgaaagccaaccttgtcaaagcagaggacgctgcatcaacttgtggctgagttaccagtgtgactgccacaggccctatgaaggccccaactgtctgagaggtgagagaaagctgagtgctatggctaggagtgccatgcctcagagcagagcagaaacagcaaaaacagccagactgcttctgcctgctatgaaacataatgaccccacaagacttctgctgctggttgcccactgatgagaaagaaaagaagagggcagtgatgtgcgttaattaattttgagtggattcataggacatcagtttcactcatacagagaagtaaaaaaaataagcagatagctcttttccaaagaggttttcatctttgtgtttgcaaaatgctactgcaattttaccattggtcacatatcagaaatttattgtaaatcttatttgaaagagaaataatcttttgaaaaaaaaaaaccttagacataaaatttgtcagtgccacatactagcatgatatcttgtgcatagtaaattctcggtaaatattcatttccttgctctcctttccatgcaattcacacttgctccacaatcataattaagcatagcgtttttataaaacgccaattttattcaaaggtatcttttccaaggttgccctggagaagacagataatatactaggtgtcttaagaaaaaaaaaaaagaaaaaaaaatgtggaaagtaacaatagtagaacttggtagatgccataaactaattgatctaatttctctagtaaaccacagtttgcaaagtatttcaaaatccttaacttccaacattgttctagagattgctgttgatagtgatcaatatatacctgtttctttttattattattatcatacattgaaaaagtctgagaggtaattgtaacggactgctttgaagttcagctgtaatttaccccaagattttagagtaacttgaagtaggacaacatctggtaagtagtcttctctgctttatatgaagtaaaattaaaaccagtcttagcctatactctattccatgttcaaatgtctaagaattattagaaactactcaagggtttcccccgaccacaatattcattacaaatcacggacctgtttgacaatgaagtatggtatctactagctctacgtaatattttaagtagaatggcaagttgttttgtgattttttttaaggagaaaaagggaaattatgctgaggcaatgttcactttttgaagaaaaatttaattgacctaaggcaatatttttactacatatacaaaataacaaacagatgctgactcattttgactggcttccagatgcagtgacccatgaggttaatactgaccatggtgatgttaactgtcctagtaaatagattcaagagatgccaatccactgggttctggttttctttattttatccaacttggaaaaccatgaacttttcaaaccaagttcctgaattggttacccttcccccacttctcccagtttccttatactccaacattatttgaaactgcttaaccctcaagaaaatatttgacttcaaaagatcactttacagacagagagagttctgtgaaatcttttctttctgaaaattcttggtataaatttaaggaaaattatatttttcatatcacctcttcattataaaattaaaatattctgtattttctgttatcttgaaggaatgtttcctggagagtttattcccactaaaaactgcttttaagtggtaatgagaacatggagtctttctgctactgtacatatacgtgcaagagggaggagacatactaaaaagcacaaaggcaaacttcagcccattcatgacttgcactcatatttggctcaatgttttccaaccatggtatacattttaatgaacaaggagactggatagaggattttggtggctgactaaacacaaaagacatagtgatttccaatgtatcaaggttgatcttttttaaataatctaatttctcaacagaaagagtgctgaaaaggatttaactaagcttaggtcacagaagtgtccataaggttctctcagcatatcttgtgttgactgtttgtaagaacatgcagcattcaagatactactactcagaataaatggcatcacctacctcttgctctctggtgaacatttgacttacaaaagcaatttacatatctcttcttttcagccatatacctagattttgagaattttattctcttagaattatagtttcctagatatagaaaaagattcattctatgactgaatttttaacacaattgtacctgccaaatgtagtggctcaaatctctgctcaaacaccttcacaaatagagagatcactcactccatcttgccaaaaattgcccaaaagttatttccttatattgaaatagaataggatttgcccgtagctttccttcattgaccttgttgcatttctggaacacatgcaaataaaaatctcaacttgcctgctgcttgagaatacttaatatctgaagaaaagtatctcgagccatctaaaccatcacttctattcaggctaaacatcctgtttcttctaatgtttgccatatgacatagttttccgacacttcatcagctgcttgcaggttttggaatatatttgcttctttgtattccttctaagatgtgatgtctgtatgtgctggatgatacagtgacacacagggccataacctcccttattctagataatgtgcttctgtttttcagcttaatacaacattgactttttggcagccacacttcgtgattgcgtcactttgtatcattgtcactcatgatgccacatagtcctgtttctcccactctaatcttataaacgcacatttagatcgaagtggctcttatttattcttgttaaatttcatcttgttgtattccatcaatcattaaagcttgccaaaattgttttttatctgtatgtgttgttcctcttcatgacatgtcaaccacttgtatgagtatcacccttccaaatccacagccaagtcatatgtcttcaggtgtttctaaagtcatgtagcaaatcacacatgctgattagttgcttgtgatttctgagaaataggattgctgaagaatcaggcttctgagaaaaaaaaatactctgcattttggcttttaatccagatccacaaagtgatgctgaaggcatcctgggatgaccagcaggcaccccgctacccctgaggttgagtgattctgggcatatcttcaaacctcaggggcttcaagggccaaattttcttattaagcattttatctcatatgaaagtgctgcagtgtattcagagatgttaacctcttcaaaggggttattttatctaacagtacacttttgaaagctaccggtagttgcctggagcaggtggtctccaaatgcagattcaaaatgcaatgttcctgtattaaatcaagtcagagttctgaaaatatagccttttatgcagaagatcttcaaacacagttgattgtctaagcaagttttactatagttaagctaaactaaaatgtgtcttacctttgcccaaacttcagctgggccatatgatgacatttagacatgctgaaatatgctctttttttctggttagtactgggatataaaatcttgaagacagcaatatcttgaagacagtgatcttgtcaagttatcaatgctttctagactgcaaaatcaatggtcaattctgtccccatcttacttgatttctcaataccagttaacacaattaaacactccctcctcctgaaaaactattttctcactaggcttatgggacaccacactcccttggttctcctcttatcttactggctactcttgcatcatttcctttacctctacttgtctaatgcccaaggacttacttcttggacctctcattttctctatatatactcattctcttggtgatctcatccagtcttgtggctctaaatatctaatatggtttggatgtatgccccctccaaatctcatgttgaaatgtgattcccaatgttgaaggtggggccgatggaaggtggtatatactaacaaatcccacattatcagaacatcctgcctgaacctctatatcaactgcccactagtcacttctgcttggatatccaaaaaggcatctcaaatttaatatggactcccacctcacccaaaaatcttttcctccagttttcttccgtatctctgcaaatagaaagtccatgcttccagttgcttaggcccaaagccttagagatgaacttgctccagaaaattctgttgtatctaccttcaaaatattttgaaaatctgaccacttttgaccactttcacattaccactgatccaagccattatcatttctctcttgagttgctacaataatgtagtataactttgggcttttgctcagatatcactttctcagagttcctccctgattgttctatttaaaattacaattccacccctccaaatcgccctattccctttctctacctgacattttatactaaaggatttctcaccatctgacatattatatagtttgcttccttgtctgtgtctggtgtctttcctccaactagaatgtaagcttgatgaggatgggaagttttcttcctactatgtcacccatattttacaatgtcagtttttatttttatacatctcaagagttttcttgaggtgatgcacatcaatagcattgccacagatgagcatcactaactcctctgaccacaggaaatgcagggtgggtttaatactcagctttgccccaagttctctgtttcctgtgcctttcctactcccaaccaggaccacagaaggaagggtccttctttttccttgttcaactgccttgcttcttatgtgagatgtcatcccaagagaagatttaatcatctaattcttgatttctgttgtcccaatttatgttatttacagactaaaaacctgaagtttagaaaggttatgtaactagcctaaatcacatgttaatagcagacctgggacaaatacattccaggctctaaaaaatttctttacaaagaataattaggtttaatgacatgtttgcttcagcatgcctctaagtagcaaagattatgactccctgcacagtccacttgcagagggttgcatgaagtgcccttgtccaaaaatttcttccaccaggttggagtatagtagtgtctgatataccaccattaaggcccatattttagggcagcaaaggggagattctttagtttatcagtgcagagatctttttggtctgttttgtgatcaatatgcctgaagtgtaaactacaaaccaaaatatagttattttagggttaaagtaaactcagaagtccagaaagaggccaaatcattattctatttaataaacctgtcctgaactttaaaagctatgtatgagtgtgtatgcttgtgtgcatgtgtgtgtgtgaaatgtataattttcgtcttccatcccttctgtcttttgagccttaagatgtttctttttttttctcctcctcctctattttgacattgaagagtatgtggcaggcagatttggccaggatgactccactggttatgtcatctttactcttgatgagagctatggagacaccatcagcctctccatgtttgtccgaacgcttcaaccatcaggcttacttctagctttggaaaacagcacttatcaatatatccgtgtctggctagagcgcggcagactagcaatgctgactccaaactctcccaaattagtagtaaaatttgttcttaatgatggaaatgtccacttgatatctttgaaaatcaagccatataaaattgaactgtatcagtcttcacaaaacctaggatttatttctgcttctacgtggaaaatcgaaaagggagatgtcatctacattggtggcctacctgacaagcaagagactgaacttaatggtggattcttcaaaggctgtatccaagatgtaagactaaacaaccaaaatctggaattctttccaaatccaacaaacaatgcatctctcaatccagttcttgtcaatgtaacccaaggctgtgctggagacaacagctgcaaggtaatgattactcatacaaactaggtatatactgtatgctaaacttttactttattaaaaagataacttattaaaaccattctttgtatataaagatgatgttactgacccaccagtatagaataatatttcatctatattgttccaacaagactgtgaaatttacattgagccatagaaatgaggccttgatcttactggtatcaggatctatttaactaaccaaagtaacttcggctataggcttctctcaccctcacagcaatcaaattacttaggtataataatatttcaattcctaaactcctaatggcacaccagaggtttaactgaattaactctttttggatgatattgttaactttattttaaatgcccaactactattgttttgaacttttattaagtcagaaacaacaagagaaatctgagaggtaatttccttctggtagttgaaatcttccgaaatataatttctcaaagcccaagctttactttaaatattctatgtgctcttctaagagctgcttaaatacaagaacttgtcagctctgcatgacctttcaaaggaaaaaaaggaaacgcatttctgtgtgttgagcgtttgttgagctccaactatggccctacactaagcttggttctaaatatacacaaatgaattattgtaacatagttatggaacattttcaatgtactaggcactattttacatggattaatccacttagttctattgaaggactactgtggaaagcaagcattattgttgtcccaatttacattatttacagatgaagtaactgaagtttagaaaggttatgtaactagcctaaatcatatgttaatagtagacccaggacaaacacagttcatgctctaataaatttctttttaaatactttcattttgaatactttttgtgagcaaccttgtgagaactcaaataataatactatgtctctgattcagaggcagaccaatgtgggaagggcactcactgagttgggatccagaggacctaagtaccaagtttcactgtttcgcttctgtgtaggatcttgggcaactggaaacaccttctttttatcatctataaaaccaggagtaagaatcccttcctcaaatgataattagtgcatgtgaaaaagtgcctggtaatttgtaaattacagaggacactgctatacttgaaaaaccctccttgtgctatggatcaattttatatcttttctctctctctgccaccactctgcccttttagaaaggagttggtaatggcagtagtcatttttattctatttagttaacaatggatcttaaaagtttaaaatgtaaagatgcagggaaattagcattttaaaaaaacagatatgtggtttcaccgtcaacatttttctatttagttgccagtgctttttatacctttgatttcttttctgctcagtccaacccctgtcacaatggaggtgtttgccattcccggtgggatgacttctcctgttcctgtcctgccctcacaagtgggaaagcctgtgaggaggttcagtggtgtggattcagcccgtgtcctcacggagcccagtgccagccggtgcttcaaggatttgaatgtaggtagagttcaaacctaccatctcaccagttaagttgcgacatttgagttgttccaagagcaaacacagaaaaagagtatagacaaagccagtttattaaattaatctatggttgtttcccctatgcgagtaggctaatactgactggcctcttgcctcatcctgcccttggtggctgtctggataggaaatggaggtcacagcaacactaaacctagatgcttaatcatttaaaactgatttcctgaaaaagaattaacaaggcaatatttgaatttccttccctcattactgggaacacagaataaatatgtgcatgttacgcattgccatttattaactatgaggcctcaggcaattcatgtgatctccatcatctaaagcttcctcacctgtaaaatagggagaacactttctacttcttcggtttctttgtgatgattctatgaccttatctgtaaataatcaaacatgttaggcactcaattaatgatatctatgagaatttccctcactgtgaaaagttttcctgtccatcttctgtactacaaaaaacaattttccaaatgttagcaatttgaatactatacagtattcacaattttgacatatccacccactaactatactgttatttatattctgtcttctcacctacttcaaataattcacagtccagttaatagccaaccctctaagtttgcactgaattctaatttcttccccttattcaaagattgtgctcctaaaacttttctctcacacaccagtatcaatttttccatcattacaaaaaatttcttttgacacttcctcactcctattcctaccagttaccatcccatttctctgccttaaagaatagggagtaaaaaaccctttaatgtgttgtccgcaatatgcttctgatattctcactccattctctcttttgctccatacagtcaggcccacacaccaccacctccctcctgaactctcttaacccagagattcacaggtcacctttgtcacttcattcaggtttctacacaaacatcctccaacttggctttatttttatttttatctcttattgttccttgatattttgttacatatgcattgatatatttgtctatcatctctttcatcatgagaatataagcttcacaaggcaagaaacttttctatgtggtttcttgctcataaatatttgtaaaataaataaattgatattattttcttcaaatttacttaatattttcacttaactgctgtggacattaagtacattatcagcttactataaaaaaaatacatgctggatgcagtgactgacacctataatcccagcactttaggaggcagaagtgggaggactgcttgagcccaagaatttgagtctgcagtaagctaggatcacaccactgcactatagcctgtgcaacaaaacaagaccctgtctcaaaaaaaaataaaaataaaaataaaaataaaaatactgcactaaaataatggaatggaactagaggatagtttggcttaaggtcagtagcaatgacatactatctagactgggccccgaagtaactgagaaaaagagaaaaatgaatttacttttatgtttctgtacttcaaaatcatattatttaaaagacctgtatgaaatacattacactgtatatacacttggggaagttctctagaaaaacgtatatacttttatgtttcatacttaagaaataggtaccacacatgtatagaaaacatgatgcgttggcataaataaggtaaattggtttttaatggggcactaaattttaaatgatactttttcattctacttctttaattattctaaaataatttcttaattattaattttactgttgatcttttgatagaaatactaaagttgttagtctcagctatgttctacctggtgtccgaattgttttgaatattttcacaggaaaaatgaataggatttctaaaaacagtggcagccccaaaacagtatgcacactgctctgcaatctacacatcaaacagtttaggagctggacaaacatgtgtcagaaggaagtgaagtgaacttttactgctacaacattgccaatagcaaaagactagtaagtccagctctgacacccccagaaagtcccagtagcattttttaagtatagcttatcttagtgtagagagaaaacgtaaataaataggtgtacaataggaattataaatcaattttctaattgacaggtatgaacccagaattcacttttactactctcataattttaattttatgtaatcttatgactctattatattttctttccaactaaaatatattgaaaagattaagtctaatggaacaagatactcttgagagtacagctgataaattgctctgagtttgcctttaggactttaatcatctctgtatcgtaccaagatttaaacatttacaactcaccttaaatacaggtgtgcttattatggtaaagttccccaaagaaaaggtgaagtacaaaagtgattaggtatatcgtggtttttacccagatcagaagacatgatttcagtgtgctcagcagagttagtaaatatatttatatagcattatagaccatagtcttcatttcagagttggagaattttggagattttttattttaacatttacttaaaaacatgtaatgaaacacttgttgctctttttttccctaaattcccaactccaaacctggttgaaacacacacacacacacacacacacacacacacacacacacacacacatagtaaaaaacaataagatcaaaggaattgatttatttaattaagtcaaataatacacttgaatgatacactgaaattttctcctgctgtggtttctaatcattatctcacttttcaggatacaggatggagttattttcatagagtattcatttaattatgtttactgagcacctactatacatcagggacacacaggcttaggcataaggatttagtgataacctagacacagaggatccttggtttcataaagcttatgtcctagtgcagaaagacagtgaaggaacaagtaaacaaataaacgtaattttaagtggtaatgggagctatgaagaaaattaagcatagacagtgaatgcagggaggcggtttttttaacttggatagtcagggaaaagcttctcagaggaggtgacatttgagcgatattaacactaagaaaagccaagtataagaagatctggggaaataatattcttggtataagtaacagcaagtataaaaggcctgcgctgggaacaagcttggtgtatcttcaatgaatggcaagaaattgtggctgtggcctgtgaatgaattggaattggagagttaatcaggggccagatcatgtagatgcttttttttttaacatggcaaaattttgtcatgaattttttttttttttgaagagagacggggtcttattatgttgcccaggatagtctcaaactgctgacttcaagctatccaccctcctcagcctcccagatagctgagattatacccacaactggctcagatcatgtacactcttgtggttatgtttagaatttaggatttcttttaaagatgataactaatggagcttgactaaggagtggttgttatattgatctgcagagcagtagaagcagggacactaagaagtaattagtcttaatgaaagatgatggtggttgggtgtagtgcctgataatgtattaatagtgttttcaggtcatttgctactgaaaagtgtgatacaataaaagtagataattggccactgcattgagtaacatggaggtcattcattgtaaccatgaaagtggttttagtgaagtgactgggacaaaagcttgagtggcatatataaaagagaaaaatgaggaataatagagtgagaccatggggatataaaattagtaagttttgctggtaaagaaaatagacaaaaaagcagcaggattgggggatgtcaggatactgtttcgtgtgtatttttattttttaagattaaagcaattacacatatttgtatattgatgggaaacaacaaaatggaaggggaaatgatgatgcaagaaagaaaaagaatgcatagaggaataatatgtttaaaaggtgaaaagcagtaggacccagtttataactggtagagttgaccttggtgggaatacagacaatacgtctattatagcaggatagaatgcagtgtggatccaaataatattaggtttacagatttgatggatatctgaggtagctctgttttttcaagaaaatattaggtgagatcataagctgagacagaattagatattttaagagacagaacaagttgtttgttaatcatcttatagaatggggaaaaaagtttttaatagagaaatgcaataggattgcccaaagtgctctgctcacatatagcatgagagcaattgatatggttgtatatgaaagtacttgggtgtagatacagaatttgcagcttgtcacataattggagttttaccaggtaagtaaatcagtcatttggaatgctacttttaactgcctactcatcagcttaatcagaagccagactccactgttaattttctgggtcaccatagctagatttgtgatttctttttgctcaatttatttatgtgtaaaatgaattatcaatgctttatttgtgggagcaaatgcaaaataaaaattggcatgcattaggatttcactggaaaagaaatgtatagttttggttttgctatcagaccatcccagtttgatattctggctttgttatttattaattacatgaccatgaacaaaattacttaaattctgtgagtctcaacttcttcttccataaaatggggataataataatacctgtattcaaaagtttgatattagaaataatataaaagcaactagcacagtatgtaacatgtatcaaatagtcaatatgcaatgttattaacacaatgatcattactattaataacggtaattaagcaaactatagatttaataaagttattgattattatcaccttctctcattaggtattgcaaatgctgtttttaatggacaaagcggtcaaatattattcagaagcaatgggaatattaccagagaactcaccaatatcacatttggtttcagaacaagggatgcaaatgtaataatattgcatgcagaaaaagagcctgaatttcttaatattagcattcaagattccagattattctttcaattgcaaagtggcaacagcttttatatgctaagtctgacaagtttgcagtcagtgaatgatggcacatggcacgaagtgaccctttccatgacagacccactgtcccagacctccaggtggcaaatggaagtggacaacgaaacaccttttgtgaccagcacaattgctactggaagcctcaactttttgaaggataatacagatatttatgtgggagacagagctattgacaatataaagggcctgcaagggtgtctaagtacaatagaaatcggaggcatttatctctcttactttgaaaatgttcatggtttcattaataaacctcaggaagagcaatttctcaaaatctctaccaattcagtggtcactggctgtttgcagttaaatgtctgcaactccaacccctgtttgcatggaggaaactgtgaagacatctatagctcttatcattgctcctgtcccttgggatggtcagggaaacactgtgaactcaacatcgatgaatgcttttcaaacccctgtatccatggcaactgctctgacagagttgcagcctaccactgcacatgtgagcctggatacactggtgtgaactgtgaagtggatatagacaactgccagagtcaccagtgtgcaaatggagccacctgcattagtcatactaatggctattcttgcctctgttttggaaattttacaggaaaattttgcaggtgagcataaagtccatatgaagcttggtctttgaagctatactctgcatcactgttcttgtcaaattggaaagctctctcctcaaggtatacatatatactgtgctgaacagggtgacactggtagcttctgtcacaatttggtcatgttcagatgggatctcacttaccaggatattctacaggtcagaaaggtagtgtttaaatcagattttcagcaaaatattttctcagtcatctgtgtgaaaatatgtctcatgaactgtagccccagggtctaacagtttcaaggcctcgggaaacaaatgcatttacaataaatgcaaaagctgaaatgtagtattgttagggaaggcatgacttctattgctaaaataatgccttgagctatttcaggcaggtaaatactctaaaatcccgaaaacagtacattaaagtatacagctgactcttgaacaacgcaggggttagaggtgctgatgtgcagttgaaaatccacatttaacttttaactctcccaaaacataacaactatcagcctggttgaccacaaaccttaacaataacatagtcaattaacacatattttgtatgtcatattctgtcttcttactataaagcaagctagagaaaataaaatgttattaagaaaatcataggaaagaaaaaataaatttactattcattagtggaaattgatcatcaaagatctttatcttgattgtcttcatgttgattaggatgaagaggaagagaaggggttggttttgctgtctcagtggtggcagaggtgaaagaacatccacatataagtgaatccacaccattcaaacatgtgttgttcaagggtcaactgtaatttcaaaacagtggaattataattctcagacaaatataaaataaacatgttttaattattctgtcattaatgaggaaactagtaagatataaaaactaattcaaaggacaatctaaagaatatgtatacgtatatatacaaacaagaatgagtgaatgaatttattaataaatacaaaactgtttaatatcccatagggcaagaaaactagtatttgaagtcatcttcaatactgtgataatcatttgtatggctcactacagataaactaatttgcattttgacgaacaagattttcatattaatattgttttctacaacttacagaattgtaataaggcacagaccactgcaaaagtggataatcctggatagtcctttatgtaaacccagcagtgcattgaaagaatatgcagtgattttttttgcccatttcaaagtatttcacatttttctacaactacaaaagcagtattttagttcttgtaactacctccatttcaagctatataaacagagataagaaagactatttttcttctaagtcacattgcttcagtatttccatgtaagaagttattattgtttttacaacttacaccgctttaaatttactaaataattgagtcattatggggaggtgagagggttattattaacaagtaatacattccagaacttcggcaagaacacctggaatgggttggcagcctgtagacattacactaattcagaggtggtaccttaattgcatgaatctcctagcaaacataacatgtaggcatacctataagaagttgtacatctctccttaacagttactgttctgagcctgtgaaagcaaggcactgttgtaggtgctaagtgttcccaacaggtaacctgcctgtttaaaagcaagaagaattcaggatcaaatttagtatatttcactgtgaattttgataagtaaaataaacacataggccctagtaactacttctccagaatttttttctgcctaattcattaaagtcaagttctgaaagatgaaagccctcaaaaataccttctaatgagattcaggaattgtttattaaaaccaagatgtatacaaagcttcatatttgcattgctaattgacctctttcaaagctggttgacatttttggctcttttgaaaagtctttatgatatccttctttttaaagtagaattgattagctcttgcgggaagagacacacttagcatcatataagctagtctatccacattagctgcagcacacacaacagaacaaaattcaattcattttacacttcctgaatatttattagttatctgataccatgcacatacacagtgggtcaaagggcctaagcaacactattaaactctttaaatatcagtcccttcacattactagattttgtcttacagtgaagttccgcttagcttctaatacttgttccgccttttatgaggattctttaacatgtaaagctttgttgccatatcagagagccacactctgaattcacatgcagttaccatcgtgtgctatatacaaagctcctggacagcatttggcttgcattcttcgaagctatgaattattacatagggagcagcaagtcttggcagggcaactggagttcagctctgaaagccaatagagaaatcacatgagtgcttgggtagtagagtgctgtccttgcttcctggcctttatagagatgcaattttcctatggcctttattgatttattagcaaagcagcagcaaatctagttatagcaagttcttttccaacccaaaatttattgccaccccatggcatagatcttatctcacaaacgaaaactgtgtagaaatggaagatgtatagccatgcttgtcacagaaccctccagcaggagctttttactggagaaagtgattcttgcataatgcagcacaattaagcatttgtagctcctccagcctgagtacttaattagcttggcattgactacatacatgaatttatcagaaaacttttcttgaatgagatgaacaagatgaacagctgtggctcttgcttttatctctctagacagagcagattaccctcaacagtctgtgggaatgagaagacaaatctcacttgctacaatggaggcaactgcacagagttccagactgaattaaaatgtatgtgccggccaggttttactggagaatggtgagtcacattagagccttctggaagagaattctgagctaaagaatgatgggattactcaaagttcattttctcctctaattttttatctcagttcccataggaaaatctatgctgaaatagaggttcagacagaatgaaacaataaaaaagaagaaaaactacagtttaggtcaaaggggagaacattttattagacaaaacttcaaatagggaaaaatgatttttaaaaaatgtataatgtgctatttttctttcttataagtacttctgaattcatgtctcttttttgttgctaactctaatacatgatgcaaatatggttgctgtcgaggtaaaataaattacaactaaaagattgcctcatagaattgcctacaacccaaaagtatatataccttatccatatgagtctacttttcccagagaaactcttcaactgttcttcacctcatacaggaattcttaaaatggagttggtcaatggcttcaggcaatctgtgacctgctgaaaatacaggaaaattagaatatgtatttgagtggctaggggtaagttcaggggtagaaataatgcatactgaatagcttttatcagctgcttaaagggatttatgtccccaaaacagttatgaactggggctctatagaatacagatactatataagcagataattgttaaccttttgttttagcactgtgccatgcaccttacaaataccatctctaattcttatagctctgtaaagaaggtttcatgatttttattttgcatatgtgtaaactgaggctgagaggttgagtgacgtataaagggcctatccacacgtttgctgcagtaaggttgagctgccttcaaagcctctgctcttctatttgatgtgccagcataactgtatgaataaatctttgctcaacacaatttctttttttttaatgagaaaggtgttcttccatctcatgtatcatcgagggtaagataagtgatctctgatcaaacttcctacattgaaaaaattaaataaactgagctcagacatatttgacaaagatattttgactgactcaatatttcccataagcatagttaataaaataatggatatgtgagtgctccctggcaagtgccctttggattaattggaattttctgttttctagctggcctcttttgcatcacaaagacacaggtcttttgccatttttacaaaacagcggggagtctagggtatacctgaatttgacccttttaacgttcattttcatttgcagcctgccttctgtggttggttctttgtggtacaggcattccaagtctatatgtgcatgaaaggagatagccttgagtcacattctgctttctgttgcaccaattttggttctgcaacttattaactgagatcgtttagttgtattccaattccatgtatctttcaaaatattgcaaatattttcttgtcattaattttgagtaatccaactattgtcaagggtgggttgcttcctggttgaacgtcacactttctgcctaatggcacaatgcatggaactcatccaaaaccctggattatttttctctgccactcacacattgtttctatttacaacaaatatctccctgtcttctgatatttattagtttacaaaatttatatttgacatttaaattcagatatatttgaaatatagaaagaaaagaaagcttagagttttccttcttttcccaggagacttttcaactggaaaaacttacatgatgctagatatttctaaaacattgaacctgtgttcagtagattctatgctttcaaagtccttaaccatcattacttaattgactagatgttaatggatttatttttacttttcatgcattaattaacctctaataaaaatgccaatgatgctgataatacatgtgtatctattgttgactgtttagttcaacagagaaataggtgagaaagtgatggagtagttagaggaagacagaaaatagtgggctatctcccatggcctagggaaatgtgacttccatcacatccaaggatattgaaaagctatcctcaaataaattggcttctctcctgccttggttaaaccttcagcttaatagtgtcatcctggcaggttttgaatgatggatggtgtgaacactctggcccacccaagaccgagaatgcttggcaggctcctgagggttgtcaagttttgctcagatctaatcagagaagtctccctccagtccagaagcataagccaaaaaaggaaaacaaaatgtctcagctatgcttggtatccaaagggataaggagctgtttttcttggaagaaatctttgttttcctttataccttgggctggccttgccccactacctcaccccctttcattttgagcctagtgattagtctctgacccatacgtgcaagttttacattttggaaggtgagggaaagaataagggaaaattaaaaattgtttacatacaatttcaacattataagctgcactatagagatcttggagctaagattttatataaattttcaaaagtaaaatagccgccttagttgctgttctatcccaaggtcttagcagagtgtttgtcacatagtatgtgttaaataaatatccactgtgtgactgaatacatgattggtgacttaatccatgaatatacagaaaaacaaattcttgctggaaaattagtttaaaaaaatgacaatatcccaggaagaagaaaacttcaatttacctgagacttgatgtcacttgtcttggaaaatttggcttttgaaagtcattctacctcaacatttcagaaattatgcttggctattggaacacagatttattagcaagtacaatcttctaattattgatttttgcttttgttataaaaaaaggatttccacagaaaataattcaaaatctctcagaataaacctctcctcttcctcctcctcctccttccctccttcttttttttttttttttttttttttggtttctctttggtgggctttttccttagcctgagggctctgatgcatgaggatcctgatagcctgaatgtaggtctgccctgcagactccagatggcaaaatacagcctctctccttgtgcccctaataaactgaacatttatataaggtggcaaccacactaatgctcttgagcattgacactggtgtaggcatggcccacttttctcttggtttctaaatatttgcatctattttctcattctaattaattccgtgtgtatatgtatatatatgtgtacagattatttccattaaaccccaaatgtgttaaagaaattttaagaaacatctccgacattatcaagtatgtataaagtatgtgtggatgggtagataagactgtgctgttccagagagataaggcaaactttttcttcccatttcacaaccaatgtattcaacagggacctgggtttctgctgttctgtttattttgaaggtgtgaaaaggacattgatgagtgtgcctctgatccgtgtgtcaatggaggtctgtgccaggacttactcaacaaattccagtgcctctgtgatgttgcctttgctggcgagcgctgcgaggtggacgtaagcagcctctccttttatgtctctctcttattctggcagaatctttttcagcttctttcttacctcattttgcgtatgaatgacgagccagttgttgagtggggtgaacaggaagattattaacatacatttgaacattcccaaatgaaaaaaaaagccattgaatttcaagaaatgccttgattcattttagatctctggggaagaaaaaggaaataaaaaccatctcaataattaaggtaaattcaaggcttattttaaacatatcagaagcactttgtctgtgtataaaatattttcctattctaactttaaatatgaaaaaagtgttcttaatataactagaaatatctccttattgtgtgtatttagtacaaacatattatcattctcaacacttctatatgtgaatgaccactgcaatttcttcccactccatttctgggtattttcacattttaagttgccctccatcactatgattctattttcatttctgttctttcattcttatctattatttatgacacaaaaattgagaattacaggccaggtgtggtggttcactcctataatcccagcactatgggaggctgaagtgggcggaacacctgaggccaggagtttgagaccagcctagccaacgtggtgaaaacctgtctctactaaaaatacaaaagtaactgggagtggtggcacatgcctgtaatcccagctactcaggagggtgaagcaggagacttgcttgaacccaggaggcggccgttgcaatgagccaagattgtgccactgcactccagcctgggcgacaggtgagattctgtctaaaaaaaaaaaaaaaaaaagagagaattaccgattaaaattactgattatattcatctatgtttttacatgaagctattcaaatgaattgttacgttttctctgatatatgattaaatatataaagagaaatcaggaatttacatcgagtccctaaattgtagaaaaacaattatctagtatcagtactcaaattatacctccctggtataatttctgattccataaaactgtctctctaacaaagttacaaataatcctttctctatttcctttcctgcaatactttcccttttcctaacaaatagaacaatttttctgttgtttctaaatttatgagctccttgacttttctatcaaatggactaatttcagttgcttttcaatgaatatttaataaaaataagcactgtagtttatacataaatttaaaagtatatattgtaaaacttgaattttcttagaagcatggttttctaagatttgcaagtaaatttattttcttaagtatctttcagaaaaaaatatgaaagcatagtatacatcataaccaaaatatatttgacattatgattttttaaaataaatgtatacctgaaataatggatctataaagtatactaagatatgcaaaaattaatatattctttattataaatatttcagagattataaaataataatttaaaaaaactttcttaatgtttttattgtttccaccagtacgttatcatttatgctaaatatctttgtgtagatatacccttccaaagaagacgttatttgtgttcatttaaaggaaaaatagtttgatcctatgaattaattcagaaagcaactaaaataacaatggcctgccaaatgtcattttgtaaatatacgtctatgactttaggagctgtcctggtttgaaaacatgaggacagtttatccattggatgccatctatttagtcccaattaagaaagttgtttttttgtgagaatgaccaaggtaaatttaaatataccattcaaacaaacaaggacaaaataatatccttgttatagagtacatgtagcatatagtatgaagtaatatactacaaaagcaaagaaagtgtattctatcttgcaatagtaatagacaatttttatatagcaaattcatatcctttggagtagtgacaatcatttcaaactgggagcaactaattgtgaagattttccttcttactcatccattttcttcacatccaaggctgaacgtgtgatgctgctgcttcagatgatttgttccaaagttaaattttgtgacaaaagacatggggaaaaccttcccatcaatatttacattcacaagtatttgcaataagcataaaatagattatagccagaccatatgtatagttttcacatttactcccttctagacatacctgtacttatgtacttacaggctgttccaaatgtaatatgttctctaccaaatgtggttaagaaatattcactcacaatttctttctgtgtacaattctgatgcctctgttgtcactgtaattgtcagttgcttttctgttttccaaatgtcttcttgtcataaggtatctgactttaaaaaatgttttcccttttctttttattcttctgtattttccagctgcatgtgtgtgactatggcttttacatatttgcacagaaaaataaaacctttgtttctg

SEQ ID NO: 162 - DNA, 291893 bp, Homo sapiens
agagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtgcgcgccagccccgggcagcctccctgcgtagcgcgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtgaagctttatccagagacgcttccccaccattctcctcccggagagtcgaagaataaaaggtggtgtgtttgcgtgtgcacctattcacagcttcaggcaattgtgagagagcccgaggcacagacttggcagggggtggacgtggacttatgttgtccaggtgccatgtcattcctgcatcatctcggaactgaccagcatctttctcgcactctctctgcgccccctcccccagcatcatcttccgttctctaagctcctatttgtcttgctagccttcaagacaacattctgaatctaaattgtagctgtggttttcctcatgactcttaatacagaaacagctaaggaattaattttcgaattaggaatcagcatttcttccactgagcaattcatgagggattaagttaccttaatggccttgcctgaagagtgcagacatttgctaagaaaagcccatttaaaagcattatgaaaactgaaatctgtttcctagtaatagaaaaccaggtagaaatgtacagtatccaagaaaaaatgctggcgagattgtactttattctttttatttggctcattcgtgacttgggatgcagaaggttcctgtttctgttccttttttctttttttgttagtgcttggtgatgtgtagaatttagagctgaatattcccacatttcctttggaaatgttagtgttcataaagtacatattcctttctctcaaatgatattccatctctcagatgatattttttttcctgtatgaactagaaagataagaagcctaacaaagtaaaattgctgacaattggcttgtatccttgagtaattcacttaatcactacacctcatttttatattttttttgattaatgaacaaagtgaaggtaaagcattttgcctacgtcatcttagacttttggtgaagtgatggatttcaaacatataacagttactttctttgatttgttgccaatgaaatttacgagatataaagtggcatccaaagagtgagttttggtaacatatttttggctttccaaagccagggcatttttgtcatgacaccttaagagttatttaactatttttgttttttaaacaaatacttaaagattaaaactgtaagtatttcaaatgaaattaccatatttttatgcatctcccatatatttacttggatgagcctatattgtatgcaagtgcattgtttgtggtcagagcttttgaacttaatgtcagttgtatgcacataccacaattctacattctaggttttgaaattctaacattcttcctaatgttataataaaattgtacacatctccccacactagctatgttcttttggaataatttgaaaaaagaaatgtagaagagtaaaatatttaagtttgaatatttttcaagatggaataaaaaatagggacaagtataaaaatcagagcacgtaccagaatgcattagtaatttgttgtactttaaaaagttttaccactaattgactgttagaacgccaaatcaaagaaaaggatgaccatagaggaaaaaggtcatttaattcatatgtaaagtcttaattatatgtagagataacacctgcctagcagagcttacatattaaggagaaaatttaattaggaaggtcatttgactttaataaagatttcggtcattgaattattgaggaatctaatttctaattataaaccaaccttagggaaaatggagttttctattttgataagttattcagcctaggtggaaaaaattgtatccattttctactgtaacatcttagcattttcttgtcattatccaggaattttgcaataaaaacagtttctttcctaaggatgcaactttcctcttttacacgaaacagttttcattttaagactcgatctaatgtgcagttattgaatgcagccataaaaaccaagggtcatcacttgtgtaaattcattgtgtttgctcttgactcaagcttcttctctacaaaataatgatgcattttctcaacaatcctcatttagtggactaactgtatcttctctcagtttgtttatattgagtttttttggacaccaatgaatgaattcggatgtgaatatgtttacttcatttagcggttgctgtaaaagctgatttttgggtgacaggtttgagattgttatgaataaaatgagtcatgaatgaaccacttgtttgtgattttcttgctgaagtgatgaacttgcatattaatgtgatatagcatgagtaaccagattgttcttttggtggtgcaggatgagatatatgctggcaatgagaggcagcttaagatctaatgaatagaatttgagacctataatctgaacataggggtttactagctggcttgggtctgcctactggtctgatttgtatacagaagaattgaatttattcaactattttcattatacgtatacatatatttatagtgcagtggtgatgataataatggttaacatttatagagtgcctgttatgtgtaggtactattctgggtgcttttatatgaataatctcatttagtcctcatacaaccccaaagaggtaggtactcttatgatttccattttacagaagaggaaatcaagatttagagagtttgagtaactcactcaaggataatttaatttaatataaaaacagtggagctaagattcaactagaggtgttgatgaccataacccatgctctagaacctctgtgccatattgcatcctccatgttgaggtttaccatttcctctgataaatacttttaacttctgtcttgctccctatataaatgttacctatattaataagaagctggccaggcacagtactcatgcttataaccccagtatttggggaggccaaggcgggaggattgcttgagcccaggagtttgagaccagtctgggcaacgtagtgagatcttgtctctacagaaaaaccaaaaaataattagccaggtatggtggagcatgcctgtagtgccaactacttgggaggctgaggtaggaggatcacttgagtccaggaggtcaaagctgtaagtgagccatgattgtgccactgcactccggcatggctgatagagcaagactctgtctcaaataataataataaacaagaagctactatgttaatgattttattaatatttatttacatatgtttaccttgcctcatttcacagaagatttgaggtgaccccttaggcagaagcaacatttattaaaagataagtatttttctttgctatattagacattcttgaagagagttttaaaatgtaattggattgtttatttaagtatgtttttagagtgcatataactcatttatagaggtgttaagtgaaaactgtactagttgctaatacgcagatgttttaaaatgacacgcttgttagaaatattagtttttcaatgctaattatataggcagaagagtccacattattttattctagtctgagtggtaaatagactctcaattctgcacaaatagaaaaagttttttgattaatggggacgaaataaaatatttttaaaaagtgattatgctgatatttttcaagaaattgcttctaagtattatagttattagataaatggtgcttacaattaaaatgtcataattattgagaaccatacttcatagttcccaaggtctataaataaagtgtcaaaacatgaacttttcttcatgcaacaatgaattggtagaacttgaaatcacaaaaatatttttgctgaattaacattatataatatacttttaggttatcacaaattcacagttggtggtacttaattactaccatcaaatgaattccttttttattagtaatgtctgagagcaatataactaagataactagactggataggatatctctgttttggaatttacttatgattaacagttatccaaaaatgcacttgatttaacttctttaagaatgaagttgggcagtcacccagaaccttggaggaatggaaacttaatgtttagctggattagagggtaggctattgggttctctatcaatggagtatacatttagagtgttaggtattcttcttaggtagtaccttttgctatggctagtaagttaaattatgaagttttatttattattgtcatttattttagagggacttcaagtatctagaaagaaatagattatttttttcctctgctaccagagccaagtcaagagagtcccaagctcatatgctatatagaatgatccaatttaattttctgcatggccaaagttttgcaatttatcctagtccaagtttgcattgcagtttctcacactctctgcattgatttaaaaattcttatggattatgtcatactaaatacattttataaagtagacggaaaaaaggggccaacatttgcttagccattatggggtagcagacatggattctgctagatacttttcataccttctattccttacctgtttccatatccccatgtcaataggggagaaaattcagggttggagagacaagtcattcacccaggatcgtatagctagcaagcagccaagctgggattcagtatgactcctcctggaactcttgagaaatatggacacataaaaccaatgaacatgtatttattgagttctaagtttactgggtaagaatatacaagaaaatatgaatacatagaagcttatgtatgtataaaaagagaactgacaggataaagtatgagacaactttcaaatgcacatgtaaaatgaaggtagtcagatataatgcaaactaatcaggataaaaaattatagtatgtcaatttatttttacaaaaatccctgaaaaactacagttctgaaattgaactgaatataagtggaaagtagacaatatatgcatttccagtgtcatctggcagcccatatcattttagctcaagcctgcatgtactgaagtatctatgtcaaagcaggaaggtggtgatctgtgtctcagtttctgagttgacaacaaggcattgaatttagactgtgactttatcacaaagagatactgtatattggagagggccctagagaagagcagcaaggaaaaaaaaagagattggagagattaaaaatataactggatgcagtgaaggttaattgagagtgggatggatcagatcaagtattttataaggacttccaaggcactaatacttaagggaggtgaattctattttccttttaaagaataagtcatttagttaaaggagtagaataagtcaaagacacaaatgtcagggaaaatgtcctaaaggcaaacctgaaaatggaatgaattgtttagaatgggaggagggtaaaggagttgacactaaatgatttgcatttcatgaattaaaaatcatttccaacaaattagagggttcattaataccatattaattactctctctctctctctctgtgtgtgtgtgtgtgtgtgtgtgtgtgtgtgtgtgatcataggtagcttagcttttcttcctttaatagtagcaagactggcatttgatgacattattataagaagcttttctctggcttgattttctctaacttcctggagcacagtaggatacagagaaaccagagatttgcccaaggtcagaagaaatcagagctaggtttggaacttaatgttaggaactgggaggcctgtgccagttcatcatcttctcttcctcctgttattgttttagagcacctccctccaaccctcaccctgcctcctccttttcccatccctttgcattgggccagcctttttctcttccgtgatactctctttcattactcttcttgatagttgaccagcagtgacattgcattttattaccttttttttcccatacagaatagtggagacagggagcagaatttttctcagacttaggcaagttaatttgactgaaatagtatactcgtgagtaaagcgtgacttttagggaacagatgggcccaggaaaagactaaataagatattggatgtttttacacattattaatatttatccaccaggtgggcattagctagaaagatatgcctgagatggtcatcaataggccttgcttaaaccaacacgagcttctgaaaagttgtatgtaaataaataatctaaatggaaatgttattatttaaacaagtgggtgaacttttaggtaaaataaagatgtatttgtgtagcaaatctgcatccttcagtttgcctgttttctattctttttgtgtgtgtgtttgcattcttagagtgcattgagtgacattgaggtccattaatgttatagagattattttaacaatttttcaacaagcattaatattgcattgtctttagtgttaattgataacaaaaacagagcagttgttgaggaaaatgatgatacatttaattccggaattatatgaatgatacaggattgctttagatcttgtttttctctaatatccctgctgcaagtcctctatttccaagggtttaaaatgtacctcagtgcttctttgtgacagtgtgtcatttttatttcccactgcttcaaggtcatgatatacccatgaatagcatatatatacatgatagcagtagctaggtatcctgaaggacctcattgtttatccttccagtggcttggaattgaaagactaatctatttgataagtaatttgatgggtgactaaacttgtttatggtgcttatttttttagatttctcaaaagtgagtatttgaagaggagtcatcacagcatggtgatggagtgcaggctttgctggcagctcttgagtcctgcctctgactctcactggtagcatggctcctcattacggaatctagcctcacttggcctcagttccttcatctgcaaaatagggattgcagacttcaccttttaatctgtgtgtgagttctgagtaagatggtatcaagtgcctggtccatagtatgcattcaataactgattgctcttaatttaaatcttttatttagactggacattttttgagtgttttaaaaacaaaagtaagttgaggcagatggtaatgcgtatttgcaaattcttttcgtgaatgttggaaaattacagttgcatcaaaatacttacttgtagataaggctaatagaatatatttgagccttctttaaagaaagcattgcccacattcgttaaatgcattatcacaatgtgttcttttttttttaaaccaatatatacaaagtgaacccagtttgtatactcttcccttccaagagttccaaagcagtttttatcatttcattaatccttcgaatttctgtgagaagatagcaaaagcatgttttgtttactttaatttagaaataaaaaagattaagctggaaaaaagttgggtgacatactggggtcacatggtgagtactagaaattaatgaacaaaatagacttaataacagataatagaattaaaatgaatttttctgacattatttttagttttctcctagagaatatattttaaggaagatatttgatgctgtgatataaagtaaaccattcttagcatattccttttcttttggaaatgttagatgaaattgcaggcaaagatggtgtagaagggggaaaaacaattgaggaagtctagttggcgaagcaggactacttagcaagagtatggtctgagcccaaggaaaccatctacaaccaagtgttcaggaggtaaggtgtaattagatcttaaaagaagtaccaacatttttgtagtagatgttgaaataataccaaatcactcttttttccagtggaaagattcatattctgatttgattgacattcccataacttgttaaccatcagttttagctctgagctagtcagctggttctgtttggaattacattatttttaagttactagatatacctcagaagctttgaaaagaatagctttgggtttcttatctagtggaggtttagaaccctgtatatgtgtgtctgtttatgttttctggttaataaaactaagacccattctcttcatattttgaaaagaggggcaaaggcttgcaattatttttatagatcctagcattcatggttctgagtcctactaccaggacagcaacaattgtgtggtgagatttctgcattctcatctaaataccgatagaacgacctgcatactgaagtccttgtaaattcaacttaagaaactttagcctgtttatttaatcctaaaaacatatcatgtaaaatgtgtatgtgtgggtacttgatttgaattatgtactttgaaagttacatattctcttagggctttgtttttttttttttttcctcagagtaagttaagaagggaagtggcagaaggatcatgagttccttgcttgcagagtaagtggggagatgagaaggaggaagcaatgcttttgtgagtgtccaccagattgtagggacatacgaagagaaaagactggtaaggttcaaccactgtgagaattaggagtatttgtgaatgagttagtctggggtggctttggttctctcctgctccctgtggcaggtggtccctgcatatttgttcaaagtgtgccacaggtaagcaaggtagcatgccaagaacagtgagagctgggtttagtctggcctctgctgtcatctgctggtcttctcagctctatctgtctgatttagaggcccctccttggtggcccttgttaatatttcactgcacaggaatctaccgaacagttggttgcctcctctgtctgctcaactatttgcagcttccacgaagccaggagctgtgtctcctttatcattttccgtagtgcagtgccggcatatggcaggagctaactgaatgaatcagctacttgactctgtacaagccatttatctaagctgaaacatacctttgtcatcaataaattggttgagaatagttgagtgggcttggattagaacggttgttgttttttgagacagagtctcgctctgtcgtcccggctgaagtgcagtgagtggcatgatctcagctcactgcaacctctgcctcccaggtgcaagcaattctcatgcctcagccacctgagtagctgggactacaggagtgcgccaccacacctggctaattttcatatttttagtagagacggggtttcgctatgttggccaggctggccttgaactcctgacctcaggtgatttgcccgcctctgcctcccaaaatgctgggattataggcgtgagccactgcacccgacctgaacagtgctttttaaactgtagattgtgacctaatagtgggccatgatatcagtttagtagatggtgtgtgacagtgttaagcgaagtatcagactacatccaaggtagttataagtaccactttgtgaaagttttgtattagttgcatatttgtatatgcatactaggctgcaatgtaaaatgtatttcttactatgggttatcctcaaaattgttgaatgcctctgatctagattaaatctaatattacttctagtcatttatttggttattttctatttaaatggcaggacatatctttttattagagaagacacaattcacactataccattactattccactaggatgaattaaaatggaaataactttattaatttaaaaaagctgtcttttaattgaaaaagtgatatgtacatgtaatacaaattcagacattccaaaatacattatatttataccacataaatccctttcccctattgaggtttcttagtaagatgtttcatttacctgcctatcttccagattacttctgaatttatattttctttatatgaaatttatttgagttttgaggacagagagaatttaataaacttgtttgtaagtagatgatacaaccagttaagaaaggacatgtttgaaaattcttttagcagatggatttgtccatttactgagtcatttacaaagaatcatatgttgagagtccacaatatgccaggaattgtgtgaggctctggtatgcaacagctccttcaaagagcttggtgatccagtgggtacaggattgctatgcactgcactgtcaggatacccaggctaacaattcttatgagagccatttgtcagagaatagttggtgagttcatgatactgtctctaaatatttgaggagctgttacttggaaaaggattagactgactcagttatctccccagaagacataattagaacaaatgggtgaatgttacaggcagatagacttaaacttaacgtagaggagactgttcaatagaacactttaaaaaatggaatggattgcctgtgaaacagtaagtattccatccccataagtgtagagactggcgattgatgacttgctggctgcttggcatggtgtagtcaggagaggggttgaacaaaaggactttgaaggttttttgtttgtttgtttgtttgtttgttttaaacagtctacgatttggcttgatggatgtcagagagaaacctggctttaaaaaaatgtgtgttttctataggttatctgtaggtagataagaaatgacagacttataaaagagttaagacctctctgggtctagaccttcaaaaaatcattatgcctgtcattgtatggatgtaaagaagctggactctctcctggaatggctaattccatgaagcagctgtggttaagggtgttttagaggtaaactgtatttattctttttttttttgagacaggctctagctctgtcacccaggctggagggcaatggcatgaaaactgctcactgcagccttgatatccctggctgatgagatcctcccacctcagccttccgagtagctgagaccacaagtccgcaccaccatgctcagctaatttttaaattattttttgtagacacagggtctccctatgttgtccaggctggtcttgaactcctgggctcaagtatttctcctgccttggcctcccaaagtggtggcattacaggcatgaaccactgtgcctggtctgtatttatttattttttaaaaaagcttaattttaaaatctgcttttctaattgacccaatttctttcagtggtatactagtctagaaacttaaaaaataaacatagtttagtttcctttttttatttttaaaatcttcctatatctaacacatcttgtaatttctttattcaaaacatctttttggtcagccttttcctctttattctcattctgaccatcagagtctcagctgtcctcctttcgcatgtgggataactctgacagcatcctgccctctcactctctccatttcttattcatctattccatgtaaatattgctgctctcaggttaatcttccaaaacacaagtttaatatctctgtcctcagtaacctgcagtcccctccctcccctttaaaaatctctacttggttttcaaaactttctgaccattcagctttgttttccactcctcccagaggtattcacctcatttttttcatcttttctgtgtatgcaatggcaatttctgatgacttaagaacatgaatagcttgagtagagcatattttatgaccaaaatgggttcaaacaatcaacctatacttgagttgctactttgtgaaagacactgttttgggatggaaaaaaaaatatttgcccttaacagaaactagtgtagactagcatagagtgtagtcagaacttacagagtgttgaggtaaagaacatgtattctgtggagcctgactccctgggttcacatcgtagttctgccacttaatagttctgtgatcgaaggcaatcacttaacctgcctgtgcctcagcttcctcattggtacaatgggacaatagtagtaccctcctcatgtggtggttgtaaaaattaaattaatacatgtaaaacacttaggagagtgtctgtcacatggtaacatagttacctgtttatgattattattactggggatggaagtttagacagaatttgggtgcctttagaggtgcagtgttctggatgatcaaaggaaaagagcaatttttcctttttttctgagacaaagtctcgctcttgtcgcccaggctggagtgcagtggcgggatctcagctcaatctatcaaattcttactatttaatgcccatttaaaatcctactggtttacatgaaatctttcttggactctcccaaagaaaaattgaaagacctctgcctcccagattcaagtgattctcctgcctcagcctcctgaagagctgggattacaggcccccaccagcatgccaggctaatttttttttttttgtggagacggggtttcaccaggctggtctcaaactcctgacctcaggtgattcgccagcctccacctcccaaagtgctgggattacaggtgtgagccactgtgcctggcccaatttttccttttttaaaaattattattttaggttcaggggcacatgtgcaggtttgttttataggtaaacttgtgtcatgggggcttgttgtacagattatttcttcacccaggtactaaatcgagtacctaatagttattttttctgatactctcccttctcccacccttcaccctcaaggaggccccagtgtctattgtttcctttgtgtttatgaattctcatcatttagctcccactaatgagtgagaacaggcaacatttggttgtctgttcctgtgttagtttgctaaacttaatggtctccagctccgtccgtgttcctgcaaagaacatgatctcattccttcaaggctgcatagtattccatggtatatatgtaccatattttctttatccaatctgtcactgatgggcatttaggttgattccatgtccttgctattgtgaatagtgctgcagtgaacattcacatgcatgtgtccttatggtagaatgagttatgtttctctgggtatatacccagtaatgggattgttggattgaatggtacttctgcttttagttctttgaggaatcaccatactcctttccgcaatggttgaactaatttacactctcaccaacagtgtataagtgttaccatttctccatatctttgtcagcatctgttgttttttgacttttatataatagccatgctgactggtgtgagatggtatcttcattgtggttttgatttgcatttttctgatgatcagtgatgttgagcttttttatttttttcttctcatatccctgttggccatctgtatgtcttcttttgaaaaatgtctgttcatgtcctttgcccacttttttcttgtaaatttgtttaagttacttacagatgctggatattagacctttgtcagatgcatagtttgcaaaaattttctcccattctgtaggtggtctgtttactctattgatagtttcttttgcagaagctcttaagtttaattagaatccctcttgtcaatttttgcttttgttgttattgcttttggtgtctttgttatgaagtctgcccattcctacgtctcagatggtattgcctaagttgtcttccagggtttttataattttgggttttacatttaagtccgtaatctatcttgagttgatttttatatatggtgtaaggaaggggtccagcttcaatcttctgcatatggctagccagttatcccagcactatttattgaataggtagtcctttccccattgcttgtttttgtcagctttgttgaagatcagatagtcgtaggtgtgtggccttatttctgggctctctattctgtattctgtcccatcagtctatgtgtttgtttttgtaccagtaccatgctgtttggttactgtagccctgtagtatagtttgaagtcaggtagtataattagtttagctgtgttctttttgcttagcattgccttggctacttggctgttttttggttccatttgaattttaaaatagtttttttctaggtctgtgaggaatgacattggtagtttgataggaataatattgaatctataaattgctttgggcaatatggccattttaatgatattgattcttcctatccataagcatgggatgtttttccatttgtttgtgtcatctctgatttctttgagcagtattttgtagttctcattgtagagatcttccacctccctggttagctgtgttcctaggtattttattctttttgtggcaattgtgaatgagattgtgttcctgatttggctctcagcttgggtgttgttggtatatagaaatgatagtgatttttgtacacggatttttctatcctgaaaccttgatgaagttgtttatcagctggatgacactatggggttttctagatatcaaatcatgtcatctctgcaaacagggatagtttgacttcatttctttctatttggatgccatttatttctttctcttgcctgaagaagcagtctttcaatttttctttggagagtccaagaaagatttcatgtaaactagtagaatttgaaatgggcattaaatagtaagaatttgatagatcgagatgaagccagacgcacagaaataaggatgtgtttagggaacagagaattttctatgtgacctatgtgtctagaagaggagtggtgggagatagagctggcagagtgaattggggccctatggaggattgctaagatgaggaattggtactgaatttaggaagcaatgaggagctgttaatgatttgtaagagacattgcagtgtgcctggagtcaggctttaggaagattaagttggccacatattaactggaggatacatagatggagggagacatctgaggtaccagtggggaattaatgattgaatggtaatagggcttgaaaaagtatgtttactggtggaaatggatacaggtcatttcagagacagaggctgtgattacaaatggtgagtgacagaaaggcagagagggaataaaaaataatttcaaactttgagtagatccctggaggaaggatagtaaaattcatagaagtaaataagtttagagagggaaggaatgcattctctctctacttgcaactggtcagatcttccattctaccatcaagctcagggttatccatggaacatcccgtttgaacactctgtctatgctgattttgaccttctcagatgtcctgatgacttatggttcaaaactgtttaaaacttgaatatttctgactgtttcattaacattagcttttgcttctgggacagactgcaaacccttaattagtattccccacagtatcttgaatgatagtgttttaggtaccattatggactgaacgtttgtatctcctccacaaattcatgttgaagcccaaaccccaaatataacgatatttggagatagggccaattaggaggtaattaagattaaagaggtcataagggtgaggccctgatcaaataggattagtgtccttataaaaagaggcactggagagctctctctctctcttcctctgcacaaaaagaagaggccatgtggatacagagagaaggcaaccatcatcaagtcaggaagacagcccacaccagaacctgaaccagctgaatcttaattttgggcttctagcttccagaactttaataaataaatctcttttatttaagtgacccagcatgtggtattttgttatggtagcctgagcagactaataaaagtacttaacttgtattgagtttttgctaattaaattgttgatctgacttagatgggttggtactgagagtgaggatcatgtgtttaagtaagagatttatttttacatttatgagaaaaaattcactgatgcactaatattcttagcttgataagctagtgtccttagcccatgtgcctcagtttttgaggtatccattctttcacctgtacttctctcttcattttcttaatgatgtaaactacttgtgagtctcccatctcaacctttgccctcttcagctgctgacttagctttcctacccgataaccatcacacaactctcactgtctaaatgcaggaaccaaatggatttgaaaaaaaggattatgatactgaaaagattggtccatcccagcatctcccaaagcaagtatatggatatctgtgtaagatttacctgaggaacttatgaaataaaggttcctaagctccactaatggaggcccactcagtgggtctggaggtaagccatggtaatcggtatttttcagaagctctcctcatgctcctgataagcagccagatatgggagctattaatcaccacttccacaattcccattatttctgcagctgaggataacgaatgcagtgtgtcttccttccccatcagtacactgaaaccgcccttcccaaggtcaccaacgatctccagacagcttaatttactttccaaatatgtctgaaactgatcatctgtgcttaattcctacaaccactgactgagtacaagttgtcatcattcatcttctggactataacaatagactcataatactttccccatttgtaaccttccaatctgactttcacacagccatagcataattgatatggaattcaaattaaatcacatcactgtcatagttaaaatttttcagttcctaatgccaacagcataaaatcatcaaagcttcttgggatgtcatacaaggccctgtgtagcccagcttctccaggttatgtgttgttattcttttacctggctgtgtagcataccccctagacacccaccacgctgtttcattgcctttgttcacgttgttattgttcttcaccccactattattatcttgaatttgggtctcctttcctctgggataccccaactgcctcccacttcctcatgtctcctaggtttcttgtccctcttctgggtatacataattctctgagcatttctctcatgttatacttaccacattgtgttaaattatcttatttgcttctatcactaaattgtgagcctctcgagggcagggtctcttttatttgtttatcttcacttctagcatatggtaatttctgaataattattcaatgcattaatctacaaatataatggagagctttcagcctttttcatacctgatttatctgcaacatgtgatgccttttattgaacatccactgtgtgccaggcactgtcttaagcaccagaaagacagtaataagtgaaaaagcacattccttgtcattttggagcttgcagtctaatgaagaggcatataataaacaaataaaaatgtataattataaatcagtatggatgccatgacaggaatgatcaggatagtgatagaacatgacagagagtgacatatttatcagttggtcagggaagccagtctgatcagatgacatttcagctgaaggacaaggaatcagtcataagaagagccaggaaaaagcattccttgcagaaggaacagtatgtgctaagacttcgaggggtcacagaagtctgtgtgttggaggaacttaaggtaagtcagtgtctccagagctcagtcgagagggagaaatatagcaaggaaagatagcagagggaagttcaggtaggctctgttgttgccaaaaatagattttatccagagtgctatggtaagtgactgaaggaaggattttaatcaggttagttatgtaatctgatttacattagagaaagattactctaggtcagtgcttttcaagacaatagtcactaccccatgtagctattataactaatgctactgagaaattgaatttccagtttaattttagttactttaaatctacttttaaaaatataacgaattcagttaagtatgttttggtacatgaagctactttttcaactataaattttgtgaactttaaatatagatcaggtatttctgataaaaatttagcatccaagttgagatgtgctctaagtgtaaaatacacatgaaatttcaaagatttgctatggaaaagaatacaaactgccttattaatgattttatattgattattaatacatattgaaaggattataagttggagaaattgggctaaataaaatgtattgtttaattttacttgcttctttttactttttgtaatgtggctattagaacatttaaagttatttacatggctcatattatatttccattagacttgcattgcactagatgctgtgatgataatggattggaggcaggcaaagtagcagcagagagatgggttaggaatcttttgcagttgtctaggtgggtgataatggtatctttgattagggagtggcagtggaaatggaaagaagtataaagagtctacaaatattttggaagtagagtcataatgacttgctgatggactagatggggaagggaagaatgaaaaaacgactctcaagtttttgacttgtgactggattgcagtgttgccatttcctgtagtgggaagactgagaaaaaagttgggagttgaacatctaaggtatggatttgggcatgttagagcctgtaaggtatgcaggtggttggatataagagcctggggcacagaggagagtttaactgaagatattaatcagtacttgtcaatatatcattgatatttaaaaccttaagactgcacaccaaaaactatacaacatcattgaaagaaattaaagaagaccaactaaaatggaaagatatcctatgttcatgaacttgaagacttaagtgttaaaatggcaacacacctcaaatcaatctgcagacttaatgaaattcctatcaaaattccagatgccatttttgtgcagaaattgacaaactgatcttaaaatttttatggagttgcataggattcagaatggccaaaacaatgttgaaagcaaaacaaaacaagttgaaggactcacacttcccagttctaaaacttactacaaatcagtgtaatactggtgtaaatatacacatactaaatgaatggaatagacttgagagtccagaaataaactgttacattcgtggtcaattgatttttaacaaaagtaccaagataattcaatggaggaaagagtagccttttcaacaaatggtactgggacagcagtatatccatgtgcaaaagaatacattggggcccctacctcacatcatatatacagattaactcaaaatggatcaaagacctaaatgtaagagctaaagctacaaaatttttagaagaaaacacaagtataaatcttggtgattttagattagacagtagtttcttagctacgatacccaaagcataagtgacaaaataaaaaatagttaaagtgaacaacatcaaaattaaaaacttttgtgcttcaagggacactattaagggtatgaaaagataacccagagaatggggggaaatttttgcaaattatatatgtgatagggaactagcatcctgaatacaaaaggaactcttataacacaacaataaaaagacaaataacccaattaaaaattaggcagaagacttgattttctaaagaatgtataaatagctaatatgcacatagaaagatgctcaacatcagtagtcagtagagaagcaaattaaaatacaatgatatgccaccaggtatctcactaggacagctatgataaaaaggagggatactaacaactgctggtgaggatgtggagaaattggaacactcatccattactggtgggagtgtcagattgtacagacactttggaaaacagtttggcaaattcctcaaaagttaaacatagttatcataatgttatacgaaacaattcaactcctagattcatgctgaagacaaattaaaacacaaatatgtacatgcaaaaacttgtgcataaatgtttatagtagcattgttcataatagccaaaaggtggaaacacccaaatgcccaccaattgatcaatgaataaacaaaatgtgacatacattgaatacaatggagtattattgagccataaaaaggaattaagtactgatacaggcatgctacaacatggataaatcttaaaaacattacactaagtgaaagaagtcaacgcaaaaggccaatagtatatgattccatttatatgaaatgtatagagtagagacagaaagcagattggtgtttgccagggcctagggagaggaaggaatggagaatgactactaatgggtatggagtttttcttgggtgataaaaatattctggaattaaatagagatggtgttttataatatcatgaatatactaaaaaatcaccaaattatacttccaaagggtgacttttatgatctttaaattatatctcaattaaaagaaaaccttaggacagagataaatcactttgagggagagtatatgaaagaaggaaaagagaagcagcaacagaagggccctgcaaggaagcccaagaaggagaggccaaagaactagaaagaaaatctagagactctttagaactgagagaaaagagtagttttgttggagtggtaggagttgggaagccttactggagtggttgagaaaatgagaggtgaataaatggggacacagtgtgtagataactcttctgagaagttggaagagagtctagggcaaaggagggtgtgcttttttttttttttaaagacaatacataacattcaaaggggatgctttttttgatgggagatattagagcatttttgtttgctagtaggaatgacccagaagtaagatccaagaagtaaggtaagacccagaagaagatatagatgacaaagtacagaaaagcagaagagagaggcaggacatgcttgagaaagtatggtgagatgggcatcccacagaggagtagggatatcttatccactgtaactgaaaggtaaagaagctggtgcagacaagaagggtgtatagatttggtggggaatgtagggaagctccagtttaatgaagtgatagcatcagctgatggtagggtaggaagcagagggaggggcagaaagacaggaaaaaagtatacaaagactatttgaggaaatgggaatgtgagcttagtagagaaatatattcaaaatatttatgaaatttcccttttcataagccaataacagttacatgaattttctaaaatgcatgttttatcaaaccactctactgctaaaatccctgttacccagcttctaagcatgctgtagagtttccttcatggtctgccatctgtctttatgtccgttctctccttctccttctatgcactggggtgtgcagtcctgctgaacgactaaggttcctagaatgcagcaagccctttcatgtctccatagcgttacacatgttcccctctacctggaaggctcttcggtttccatattgccaggataactctacttacaagaactagttatcacctcttcttgaaagccttcactaagcccacaggtagaaggtatttactaagtgtgtgttgaaagactggagatacttagtatgagccttattgaatgaatgagctctttgaacacagaagaattatccagagtctgggctgtatgtgcaaaacgccaaggactttaaaacttatgtggctttcttggtttatttactcatctgcagaatggagataataaacattatctcaattccctttgcagagtctaaaaagtgggttttaaatgtctaatatactcgtcaataaatgatagtttaaaaaatagtacttaagcaaagatttgcatgtagcaaaacgtgactgagagattgctttcattgcagggattgcaaggacacctgctgtatttaaaatgctgcattttcttggcataccatttaagacaaattacaaaaacctataactgaagcctgtttttccaaaaggtacgtttcctggtttggacctgtgggtagtgagtggaagaacacatttggtgtagaaggaaaatatgtatatattctgatctaccctgcatattttccattaaggtctccagctgcctgaacattaaggagctgtgccagtaaggaggacaagacctggtaactggttaaaagaagctaacagagctcatgataaggcttgccagcctagaggacaaactgccagttgtctatagaacagacaggacttgtgggagcatagtgtgttaagtggaggcccctgagcttagaaaaaggggctttcctattaggcaggaaccaagagaagcacaaagagatcatagtttataaatatgcaacagacacctctgtttggaaggaggcacaacacttattgtgggattgtcattgtgtggcttgcttttttcaataaattccctccttaaaaatttttatatagattgaatatttgtaaatagtgttttattattgatttacattattatgttagtaatgctttaattttcagttttgcttgccaaaaattttctaattcttgcttaaataaaaaaaaaaactaattgtatagcttggagttccaaatttagaatgagaatctttttgtgaggctaaattgttttgtaatgaaattaatcactcattaatttgcctcttaaaatacagacttatttaaaatctagtgggttttcttaattggacggagagacattcttgtaattcataagaagttatttatcttctctccaaatgaaattattttaaaatttaaatttatttatgtcttgcttttctgcaaaggaattgaggtggcttcctacaaactatattcatttatttattcattcttttctataactatttatggaattattagacatttaaaataaaacattaaagtcaaatagaagtgaagaggcagggctgggcgtggtagcttatgcctgtaaccccagcactctgggaggctgaggcaggcaaatcgcttgagcccgggagttctagacaagcctgggcaacgtggtgaaacctcatctctacaaaaaaatacaagaattagccaggtatagtggtgcatgcctgtagtcccagtgcttgagaggctgagactggaggatctcttgagactgggaggtcgaggctgcggtgagccatgatcctgccactgcactccagcctgggtgacagagcaagatcctgtctcaaaaaaaaaaaaaaaaaaaaaaaaagaatgaaaaaagaactgaagaggcaggaccaaggtaagataaaaccaagaaatggagaatgaaaaattcccaaacctaaatattgacctaataatgggattaaacacatgtaaacaccccattaggggaaaaagtgaaatatgatcacttagacagttttgttatcttcgaggattaagaaacatttttattcatacatattcctctagaggtgagtaaaaaacaatttctcatattttataacagcaaatacagtagcttcctttctctgtgatctcacttctcatcagggtttagctgggtgggcaactttggatcttgagtctgtatccctttcctacattttcagatccatgttgagatttcaatgtaaatactcatacttttactaatagattcagcatcttccccagagaggtcatgtcctctgtgtattctcttaatcaacaaaccttgaagctttcatattgccttcatctttcctttccccacatatactaaattttgtacattctacttgagtagtgcctttgttctcgttggtgccctttcatttctgttgctgttgtcccagctcagagcttactttcctcttgcctgatttatcctaataacttatttaatagcatcagttcttccagtgtcaacccccaccttagtcattctaaatactcttgacagaattctcttaaagcactactctaatcgctccctttccctacacaatagaatcctaacttcttggcataactttaaaagcttttaatgatctggctaccaactacttcccagcataattttccatttcttttgtacatcataggtagccattctctgaaaccgtccttgtactttctctcctttgtgtcatcactcataccattccctccatctagaatgcttttgctccttctattcctcccatttcagttgaatccagcaaatctgtactgagtgtttgctacatgcctaaggattgtaccaactactttggttccaaagatgaggataattatcctttccctcaaagatctcacagacttatgtagaagaattggtaaattgaagttgacatattgcttcctctataaagctttcctaattttcaagtttaaattaatttttctttttttcatatgcttttcttttttttaaataacactgacttgtacttttcaaatagaatgtgtgtatgttttaaatataaattatttcatatgccccattttattataagcttctatggcatcatgttatctgggtccttaggtctttaggcatgccacattataattctcacatagtaggtgttcagtaattttttgcaaggttgtgtacctggtgaatgtgctgagatgacatagatcatgtaggtatcactgtcaaagcagtcacactcagttgtacttttagggtcttgctttaaaagctgcttttaggtcgtattttaaaagtttaggtgcacctaaggttccaacaaaggctaaatgtttttaaacttttaagtgacgtgtgtaaccacacatggagttcagcctttgaagtcagcaggaactccacacagcatgtagagaagatcctggaacacttaggaagggggtaggagtgtggcctttagggcagggctccctaaaggataaaggagctgaaggtcaggctttgaactgatttgaagaaaactagtgtctatgttagaggtgattgcttttgaaatttgatataattctggctaatccattgtgaaaatggctactggttaagtagttgaggaatactgtgcttcctgtgcctctgtgattgctttatttcactaaaaatttgtattttaatatggctgttcgtgcttcaaacctcacatatttggaatatgaagtcacatctgcgctaggctccagtaggctgcatccctggtttatccagtccatgattcttctgctaatagccaagtggcattccatggggagatgcaggacacattgtttttctttcagatattaactctatgctaaggttagaggcacccaaactggtttttgtatatttatggtattgtcactcataaatttttccatacttcctttggatctacttttatttaaatatctctttgtggaataatgttttcatcatatttattatccactttggacatttttaatgggttccaaactcacatgactgagtgtcaaagaacatccccatcatcctagtatttggtatttgtgggttttacttcagtggtaccgttggtcatatatcacatatataggttctgtatttaccataacccaccatattttattcatcaaagatgtcacacacttaagatgtagcattattttatatacagctaagaaagaaaaagaaaatcattgttaattaaactaagatactttcttatcacttaacatttttgttttatagttaatggaaaatatcttgggttgtagaaagatttttatcatatgccactcttataggtatataaactataagatataaatgaaatacattggtaaattactctaaaaatttcttcacattgagtccaactctttatggatcttccttcagctcaaaattgttatctgtgtttttctacccagtgtcatcccccatgctactaagagtattggtggtgaagcatttcttaaaaggctgcttcttgcttgagtgagtgttattttctaagagacaggatctcttaggggtaatcagtttgggaattccttggtcaagccctgggtcctaccctccctgatgagggtgacaagaggtgtcctgcacacagctcctggcatgccaggcattcatcttctctgtggtctgctcaggccaagaggcagaaactgaactgccctcaaatacttggtacccagccaagtgatttttcctgttttcaaccttgacactgcaatctgcgcattgcgtgaataagtggaaattttcgagcaagaaatagcttcatgccagttctatttgaaatgttcaaaccacctatttaatggcatcttcacagccatgcataattgagttagagatgtcacaacttagacaatttttcaggcaggaagaaagaattggctctcttctaagttagtaccttctggcaactctggcttgttttatcaagcaaggatgagcctctctctatttaaaaacttaatttttgtgtaccctcttacattgattgagcagttgtggtgtgagaaggaacaaagatgcttctggtgtcctttgtacaatttcttttttttttttgagacggagtctcgctttgtcacccaggctggagtgcagtggcgcaatcttggctcactgcaacatctgcctcccgggttcaagcgattctcctgcctcagcctcccaagtagctgggattacaggcatgcgccaccacacccggctaattttgtacttttagtagagacagggtttctccatgttggtcaggctggtctcgacctcctgacctcaggtgatccgcctgcctcagcctcccaaagtgctgggattacaggcgttagccactgtgcctggcttgtacaatttcttaaactacaattgcagagctaattattcttgcatgtgcttttttaaggctgtgtacctaaacatcatgtggttggtttttttttggagaaaaccattttgtgaatgcttttggatacaaataattgctttccactctgaattaaggtatgtgaaaacacctggcacagagcccaggcactgtttcctttgccctccccatctggtgctgccctccccatgcctgaggagctgtgggctgcttgcttacagctcagccacataggatcttggaagagttcaaatttctccaagatctccagtgtgtgattttcactcttgctaagtgtgtctctccagcagcatttcctcataaggaaagaaggtagttatatctgtcagttacaattagctgtagaattgtgctgttttacccgagaaatcctcttctccagttatactaaccaagtttttcctgtactaatatccatatagaaacttaagctcttgacctgaatttttctggctgttcatttctcctttttccacttacttaattacaaatggattcgtgtcatgaagggtaatcattagttctcactgacatatgatgctgagttattgctggtaaaatatttcactgccctgccttattgttattgtttgaaaatgtaaagtaatgcttataggcaatcaatatctcatgctacctcaggacagaaattgaatcctgaccaatgactttcagtttaatttaaccttcatctagttaaaagtggagactgaaaacttttacatgaactcaagataatttttagattagggaagttctgatgattcctgtaattttaattacagtagctcatatctgaccctcagttttcttcactaatcatttgggttgtaaagctatagttaggctcattagacagagtgcagaagtgcagatatagtgtctaggaagatataaatgtccattgaagaactagccatggaagaactatccttgctcagggaagaactagccttaactaggtctggtggcttgcttcaggacctatttaaatactagcacgtttgctattacattttccattattctgaaaaaattattaaataacaatatccgtttgacatgaattgccttttatattccttactgatttaaagtaaaattggggtaacatatgatttttatagactctcactctgttctcattaagaaggcattactgaagataaattttaggtgggaccaattacagactaatgcagttatatagtcattgtgatctagctgaagaccaggagtcttttaatcagttaaaaacctctgcagcctgggcgacagagtaagactccctccatctcaaaaacaaaaaaacaaacaaaacaaaacaaaacaaaaacaaacaaacaaacaaaaaaaaaccctctgaagtctctcatgcactattctgtgttctgcaaaacgttggccctaattccctgaaataaaaagtgaggaattgatcttcagtaagagtcttttgaatgcttattatgtgcctatcactttgcaaattagattatgtatcaaaaggaggtttagagtagttcttgagctcaaaattatattcttctgaggaaagatatgacacaaaacaataaaaaaacagcataaggctagaaaaataaaataaaatgcgaaactgaacacaatcaggtacccaaactgcctgtatttgtaatgtgaagtccaaaggggaataatctgtgttgaaaggtagtacccaggaagagtttatgaaagaagtatcatttgagatgggccccagagtacgacagaatttgagaagacagagaaaaaggtggaagatgtgtctggagaaagaatggcatgaataaacacttgaagacatgagagattctgaaattttcagggaatagcttgggcagagggttgactaaagaggctaaagaggcaagatgtgctaaagaggcaagattccaaaagatctcaaatggtaaaaatcaaaagtttgcaatggacatcgtcagaaatattgggctggagagggagatcaggaagggatcagtacatgttgtcgagaaataagtgacatgatgtgcaattatgtatgtgctcaccactctatactcaacgcccagagccccaggatacagagggtgttattttggcaactcaaattgacaggaagcattgctgtcagggacctgatttttcaaaacactaaacaattctttataaagttcccaacaaaacaaagtatagtcttctctcaatttacatgatagttgcatttccggaaaattcaatgcattgcctaaatctttggtgtttctggataaaacaggattaggatccagcccagataatttcacctacctgaatgtgcagcaaaagactgaaaaatcatgtaggatgtgggatcattgttcagtgcataggattctcgcaagaactgtaggatgtttaacattgctggtcctatgaacaccgtgaaacatcctcacaaattttttaattggtcaccttccccctagtaactattgctttatttctatattagtgaccatataagttacataccctaatttgccttttttggttaaaattttaattgttgctttatttgtttttacttgctaaatagaatatttaaaatgtattttctctggaatgttagattctgtgggtttaagaggtagtaaattatttctttattggttactatataagttacatatcctaatttctctttttctgttaaaattttagttgttgtcttgtttttttttttttgctaaatagaatattcaaagtgtattttctctagaaagatagattcagtgggttaagaggtagtaatttttttttttttcaatttagccaacaattgctaagcctctaccgactgccagcctccatgcagacgagctatggccattgagctcacagagctagctgataacccatcaggaaaggaatgtgataaggtgtgtagggagaatttgagagatgacaaagcattgtagagggttgagggaagatcagggaaaatgacagagatcatcacatttgagttagtgcttaaagaataattttaacaggatttaagagtgtacttctttataacagaaagttgaatttgaaatgactctcaaatcctattcattatataggctttgcagtgaattaccaaatggtatattttgagatgaaaaagcttctttgttatctcccaccccaaaatagtttttcctttttttttcctttttgcagttctccatcatttgttttttcatatttagatctggtcttcctaaagagtttatgaggatagaaactgtgccatatactttactggatctcctgtagtgctaggcatattggaccttagatattttcaaaataatgtacgtaggaatgaataagctattcttaggcgcaaattgtttgtttattctttttgtattagcatttcctaggaaagtgaagtcaggatgttagtaatgaggacaccaagaggatgtccccgctagtctctcggcatgctggccagaccctggttgtgctctgtctgagtccacagaatcacattgcttttctcctagtccctatctgtaggtaagagaaaatgtggaaagtcgatgtttgctctggaagttatagaaatttccactcagaaggtccttctttctgaagaaatgtttgtttttttttaattcaggtccaatttggacaagatactcttgctttttcgagtcagttgaagagcaagataacaggtgaaaagtatttcaagagtttagatcaaacttgataatatttgtaaaaacatgaactgtaaagtattacagaaattgttattcttttgttgttattaagattgaaggaggagcagaatcatcccataattactcctgggggtctgagtcttgtgtttgattagctttaactcacattttgttattgtagttatcagatggatttggatatttgtaagatataaaggtgtctattctttaagaagtcaagttgaatcatataagataaagagatcttgaagggagcttcactagctgtgaagttgtccaatctctataagtgacacatttctcatcagaaaaatgatctgtatttcccagggtgttgaagagttcctttagtgggtttgaagggtacagcatggtgcctgacctgtagtaggtggtccataaatgttagctataaaatattactattatttaaaaggttatttaaaaccctgaattcagcagacatttattgaacacctactgtgtgtcaggcactgttttaagagctagaaaaaagccataaagcaaacaaagattcctgtgcttgaggaactcaggttttaactggggagatggataagcaatacccaaagtaaataagtaaattatgtggcagattacaagattattagggccatggaccaaaggaaaggcaaagcagggtaagggggatcaggcatgtccaagaagaagaggtgagatttaagcaaggacttgagggaggtgacagcattaattgtgtctcatctcctcagtcaagagttgatgtttcaaatggcaagataaatgactgtaaaaatgcctgatgttcttaactattagacttaaaccatacgaaaaactgtacgctttttcttttctcgttctccacgaagtaagaaaatactgtccctttctttttcccctcaatgacaataaaataagtatccctgatgatattatcaaatcctttttagaagctgtttcctttacttcctaatggatttagctctaatccaaaccagaagcacattttgagtcttttctgatatgacattattacagtgagtggtttctatttttcttctaagtgttgcttgaacacaggaaaggaatgtgagaagacctcttgccacagctgaagtatatattagagtacattatttagtaaacggtagacagttctttccttgaaactcatttgaacatttattgtaatgtgaactaagttttttcaattcctaattagagatggtagtttttctgtattttaaaattggatatcacatccatgtacatatatacaaacacacataaatttctcagatattaaaatgggatgtcactaatatgcatatatgtatatgcatctatatatacatatgtggatatgtgtagatatacacatatgcatagtttagttgattaggttaattatctcttaattaatttcttaattatttcaaagaattggggaaaccagcagtttttatagttaaatattccttgaaatgaaattaattgtggcattggtacaagtcaaaataattcagtgttttggtagtggtagtatctgtgatagtcttaggcttagatattgcagtgacaaagtatccagtggtagagttgatgaaattgtatttttatagacgtatttgaggctattatgcttttatcatcaaaatataatattcatatagttcattacatggcaaatgcacatgtatgattagtgagcctggattagtagccttgctactcttgtacttattcagccaccttaaaacataatgtcaacttttattttagatcagggggcatatatgcacgtttgttacatgggtagattgcatgatgctgaggtttggagtatgaattatcctgtcaccccggtagtgaacatagtacccatagtatccagtaggtagtttttcagcccttctcccttcctttacttccccatctagtagcccccagtggctattgtcatctttatgttcatgagtacccaatgtttagctcccacttataagtgggaacgtgcagtatttggtttgctgttcctgtgttaattcacttaggataatggcctccagctctgtccatgttgctgcaaaggacacgattttgttctttttatggctgcatagtattccatggtgtgtagctatcatgttttctttatccaatttactgttgatgggcacccaggttgattccatgtctttgttactgtgaacagtgctgcgatgaacatatgagtgcatgtgtctttttggtagagcaatttattttcctttgggtatatgcccagtaatgggattgctgggccgaatggtagttctgttttaagttctttgagaaatatccaaactgctttccacagtggctgaactaatttacattcccaccaacagtgtataagccttccctttcctctgcaggcttgccagcatcttattcagccacttctagagttcattattactttgtctgaattgtttgtaccaaagttacttaaaaagccagtattatttcattgaactcattgtgctgttgtacctttttttctttgtctttttaagatgagttggaatatagtatgtaaaaatgacacataagttagatttggcatctgaaggagtaaaccaaatatttactggcaatagagtgtgccatagcatttgagagcattggaatgagcctgaatacctgggttcaaatctcaccttgccacttactacctggacaaccttggggaagttaattagccttctaggctttactttcctcatctgcgaaattataaaaatagtagtacctaccttactgcattgttttaagaattaagtgagttgctatttgtaaagcacttagtacagtgtttattaaatagatataaataaataccccagcaagtctaaaaaaagagttgtctctcttttttttttttttttgagatggagtatcgttctgtcgccaggctggagtgcagtggtgcgatctgggctcactgcagcctccgcctcctgggttcaagtgattcttgtgcctcagcctcccaagtaactgggactacaggcgcgtgccaccatgcccagctaatttttgtatttttagtagagacggagttttaccatgttgtccaggatggtctcgatctcttgaccttgtgatccgcccccctcggcctcgcaaagtcctgggattacaggcgtgagccactgcgcctggccaaaaagagttatcttttaaagatacgtacttacatctttattgatgaaatgatgggatgtcttagatttgtttgaaagtaatctggtcagagagtgggacatgaagtggtgagacagtaggtggatcaagatggctcatgggctgataaccattgaagtggaatataggatttattatactactaggcctactttatgtaagcttgaaattttccaaataaaaagtcaaaacaaaaaaaggacagttcacttcttccaatgttctttccttttttttcttttctttttctcccctaaatctggcatatcattcctgtcttttggggtatagttcaaatgctacctgttgtgaagcctccttgataaccccagccacatctcatctcttctcttctgactcatgcagccccctggactcttcttgagcacctatacatgttgtggctttgtatttattcctgagtgtcttttccttcttccaggctaacctccaagtggattaggatcatgttagtgacttccagggcagatacctttctcacagtaggtgcccatcaaacctttgttgaaaaaatgacatttattgactataatctagaaagagcaaaagcaattattttgtgtgtcacaattactactaaagtactgtgtttggggatgaaaggttgttattcgaattttttagtggtagtttgaaataggaatacctgtggctttatattaaaatgtttttgctatttgggggcatttctttttattcttttcaaagacttcatttaggaagttaatgttgttccaggcgattagcaaagttacaaatatgtccttctaattctggcatgttgagaatctgaacatgtgaaatacttgtgttctattttatggttatggaaagtaagatttttttcatctgtgggcccacattattttttctatttactgacttaaatgatgcagagaagagtctagtatgaaactggaaaaagttaacaatgaaaacctaaatcacagaactttgttttgctttaggatacgtcctgaaaccatgggaataaattataattttagccatcctcccctccctcataacatagataagcttttctttaggcatgttcttaaaacaccatatgtaaaacacctgttggtaagttaaagaatattttaaacccaaggattttatatctattaaacatattcttaaatgaaatgattttataaagcaaagactattttagagcaaagaattctccttaacctctcatttaaatgttttgcaagtttgcttgtttatcagttgaacttatctaaggtgaatacttcattcattttagtctcttctccacaacaaatcatttttgttgaacttcgatggaagtcaagtagtgaaattgggctaccttgagtttcacttcggcctcctttctatttccatcctcaatggaggtgctaattataagtgaaatagtttaaaactgatactaagagcaaaaagtgccaaagaacataggtaatctataaactaaataatcaaattcaagaatggggttatattgcctgaaggcattattgccatgactttctcacttgcaatggagagttaaaaaaaaactctgcttttgatttttctccacttgctgctctgttaccaccccagtggcatgttctcattaacccaattccttgacctttggctattacactgaagaattcaaattcacaagatgtgaattgcctcattcatatctacaaggtttgaatcgtggttaagacttagaccgggtgtctgattatgaacaggctgtaagtgagagtgggtgttcctttgtgaagatctgtacttgctcagctgtattgcttcgttgactcatttagagtttctatagtacttaggacaatgattctcagcacagtcattgtggcctatcatgctatctttggctgacaaaagtgattctgagataatttaaaagtaaagtaaaatttttatttaaaaatataacacatgaaataatttaagaaaaatgaaagagtaggtattaaagataagacttccaactccccaaaagtaaaattactaacagcttgcagaagctttaatgaaattatttttaacacagattgaaaaaaaccatgtgagatcatttttctctatagatcataattccttggggatagggaccttgtttcctattctgttgtatctctccatggcagttaataaggtactttgtacaaattgaagagacagaaaatattaaaattcctttctttttttttttttagaaatttggaaaacctcaaatctgttgagaaattggatttttggaaatttattcataaaaaattattgtagctgaaacttacctctctcagataccaagcatgtttctgtagaaggatctgctggactacctctgtttccctcatgaattggagagatttgtgttaagtgacagagagaaagcaagccctaatctattcccttctttttctgcatgggcgtgaactcagattgtttgatttgctacccagtggagagccaggtggccataactttattttcttttatatcatatttttatgtgaaaagacataccattagtacccttaaggaataatcatatcgttttaatccctagtggtacttgggtactgttgggaccttcatcaagcagattccaactacttcaatgaatgtatttctgacttttcaggctcaagctttcttttttttttaatatatgaaacaaaagtatatgaacaaatggaaataaccagtgggaatgaatgatccatctgattagatcctttgtcattgtgggaaattattacattattccaacctgtagaaatttcctaaaatccccacatggagtcccctatgttttctgtcagagtgtatgtagttatgcaagtgcacttaattttatggaacatcctcatgattcaatctgctgctcccaaatcaaaactaatatgcttttggcttatgtactagtttgaatcatttatattattctgctcacactcagtaaaactaacatatcttcagggtctgccatatgaaaggtgctgttttagttgttcaaagaagcaagggctggaagaagttagactgttcttcctttgctattgctttcaaatatcaaatcatcacaagtttgagtgaaaaataatttaatgtattgagtagctatgttttaaaagtctagggttctttttgttgttgctcagagagaagaattaaagattatatgatgtactttgattagtgctgtctactgaaaatccacaccactttacattattttgaatgtttgaaagcatgaaagtgttcacagttgaatgtttccaagtagttgtcttaatattttatcacttagaagtcagttacagataatggaaataattctaactatttaagaaaaaaatagaataataaaaacaaaagcatttaccataaggaattaggtgcttactaatctaatcattggactctagactgggcctctaagaatggcttccagaaaggcacagtggactgcgtgccaggggcattgcttccattattactcctaggaagctaggaactaaaaaagcctgcatgtcaactgctggtttcaaatcacagcaccctagccacaaccaggagtcacgaagcaactgttgtcttctgggatattctactttagctgtgattcagggatcagactgctaccagcattgttagcttcagagctgtctgctgcctgttagatttgcacaagcaagacaaaaccttgggtgcttcttctcttccgcttaactctgaattcaagttttatggaagtggcgctcatggtgaaacccaaattggaattcaagtcttatggaagtgcatcttaatggtgaaacctaaattgtgttgagaatgctagttacaagggagtctgggaaatgaggtttttagttttctggcatctgcagtgtaagaaggcaaatatggagattggaacagaagttgagctggccaatgtgctgtatcagccacagatgcttttgtgttatttcctgtgatggctagaaaacaaacttagaatctggctgattgagtaaggaaacaattttcagatgtaaaccttgtatattacagtctccaagtagatttttaaaatatatttttttgtttgcattatctgagaatccagaagagcatccagtaatcagtaattacatagtcagatgtgccaggtggaatgattcaggtatctctatgtatttgtagcttgaatcctgtatgtcttctgtttagaacttagccatcttttgaaattaagcttttttccactggtgattatgctagtgcatttaattgggattattttttggcacagcgatcattaattagagcaaatggagcataagcaacgttagttgaataaataatgaatttaaagagtctatgaaggttaaatagcatactctggaatgttctatgaagtaatttttcctttccatgctacatactgtcaagataactagtctaacccaaggttagatagaaaacaatatgtagagtgtttcctgcaatattttcatgaaaaatatatgtgtaaaaatgtctaggatggtctaagagaaaatatttatattgattactgtgaattagaatagattttttggtttgtttatattaaaaacatttaatcccatgagcacatcatcttatcagaaaatgattccaaaaagttcttctgtgagttttatcaaccaggagttctattcaaaatacataggcagaataaatagtaaagtaaaaaaaaaacctatgtgtcttttatttctctgctaactttgaatgggtacatgtgatagactttaattattttgtggctaatttattggaaattgttttttggttgggaatacaatgtcttttgttgatatctccccaagtctcaggtcataatcataaattatttattttattgaaggcagttatgataccatcttgtcacttttcctaataattgtataataataagttgtattcacattatattgatctatttactttttcagttaattccgtatgaaacatttgtttactaagatatcaaatcaaccacaaattaccattcatagataaaatggaattaattcttaatgatgtggcctttttaggacatagttaaaattctttaattttgtgattatgttatttagtatacattaagtataatgtagaatatacttatgatattggcccttctttcaggaaattaaaatttaaggaaatgggcaatgtatgatgctatttaattatgaaaattctcctgtgacgttttgtcttttcatgttaggcctaagcagagggcctaaagggtgtggttgtcagttacacttgggaaaatttataggagtgggaaattctcaaatgagatcataggggtctccaggcagagggccaggctgagccacaagcagctccatagagccagggtcagggagctggagagtcaggatgaaggtcatgggtaaaatataattctgggcattctgctgaaatggcagacctctcggtacagtatagatatgcaaatgctaacacccagagtgtctgactttgatgtgctgccaagcacctttggcctccagtgggtgctgactgaattggagagattccagattcagcaaagatgtctgttagcagaggaacaggattaatgaagggatttgtccctctcttacctcagtttacttaaggagagggttttattaattggcgtgaaaacgttgcataacattttaggaactaaatcctagaatttcttttaaaatagtacatttacaataattatcaaagattttttctttaaaattattttttcagatctagagttattttaactttattttgaaataatttcaaacttgtagaagagttgcaagaagagtattaaaaccctcttgtggccgggcatggtggctcacacctgtaatcccagcactttaggaggccgaggtgggcggatcacctgaggtcaggagttcgagaccagcctcaacatggagaaaccccatctctactaaaaatacaaaattagctgggcgtggtggtgcatgcctgtaatcccagctactcaggaggctgaggcaggagaattgcttgaacctgggaggcggaggttgcggtgagccgagatcgcgccattgcactccagtctgggcaacaagagcgaaactccgtctcaaaaaaaaaaaaaaagcccttttgcataacaactatgaatgctttgccacatttgctttatctcgttttgtctctgtctctctctatacacacacacacacacacacacacacacacacacgcaccatttaagagttaatggtcaatatcacacccctttactcctaaacatttcagcatgtatttcttaagaacaaggacattctcttatataaccacatagatatacagcccatattcaaaatttgcctattatcccaataatattttttagagcatatttcctcttggccaaataagtcatgactacatattacctttagttgtcatgtcttttaaatttttaatctggaataatctcgtaactccattttctttcatgacattgatatttttgaagggtatatgccacttgttttatagaccaatcctttattttgatttgtctgattcaatattttttatcaatgactttatactttaatttgaaaaacatggaaatatataaggaagaaaacattcacccttgatcctgctgtccaaggatacttctgacatttagacatacttccatttttcctatgactcataaaatcagttacaaaattgaacatacagaataatcccatattttatacatattaatacgtataaaatatgtatagtgtatacatattaatatgtataaaaatatgggattattctgtatgttcaattttgtatctgattttatgagtatttttccatctcattaaatgctctttgaaagcatattttcctggctccctaatgttctttattacagttacactatcatttatgtaaatactctcttatcattggatatttaaattgtttctatttttcttattacaaaaacactgtgactgcatgcagtggctcacctgtataatccctgatagtcaggaggctgaggtggaaggatcatttaatgctagaggtttgagattagcctggacaacagagtgagactccatctctaaaaaaacaaaaaaggaccacacacacacacacacacacacacacacacacacacacacacacacacaccctgtcagaatgaataccatcaatctataaactgcatttgattcctctttttcttttttctttctttttttttttgagatggagtctcactctgttgctaaggctggagtgtaatagcgcgatctcggctcactgcaacttccgcctcccgggttcaagtgattctcctgccacagcctcctgagtagctgagattacaggcacacaccaccacacctggctaatttttgtatttttagtagagacagggttttaccatgttggtcaggctggtctcgaactcctcaccttgtgatctgccctcctcggcctcccaaagtgctgggattacaggcatgagccaccgcacccagcccctgattcctctttttcctaaaattacttaagcacatgtatattaaacaaatgacttttcatagtggacttactcataaaccagtaattaaagtcttgatgtgtgcagaaatgcaaaacatttcccagtctgatttttggggcctctctcttataagggtttgctttcccataatgtatcgtctgctcagtgtgcttgccacactatctgtggtgacaatgtattgtcattctcttggtctgactgctgggagatcacagggagctgagtgccgctgagttaaacagatgttcagcatggctgcatcttcaaagttttgtctggttccagccctgacgaaacttctagggccctgagagaaagagaaagtttctagttgaagtaatatcctatagtttgttagtggaaacagaagcacgtggtttctgatttggttctggtgttctctttggagatttgtatcagtgatgaaaaaaaggaaaggttggttaagtctgttgcctcctgaagtggttctttttatcagaataaagactaggcatcatctcctctatgaactttttcctgacactcctgttcatcttccatgctggacccattaggattaatcaccttctcctttgagttacccatatatgttatctttaggtctgctacagccttcgcactgtcttacaactaattgtatataagtctagcttccctatgaggcactgggttttatatgcattagatccatttgccctgcaataagccaccccaaaacttagtggcttagaacaatagccattaatttagctcatgattctgtggaatcagcaggttggtctgggctcagtagggctcagctgctttctgatgggactcactcatatggttggctgggggctggctgattgatgactgggatacctcacttattctcttgtggtttcccatccttcaacgggctagttcagacttgttcacatgatgtcaacagggttcccaaaagcatcaacagagcatatcctttaatgtacaagaactttcaaatttctgcttctgatacatttgcttctgtcccactgtccagaacaagtcacatggctaagcccagagttattgtgtgagagcactacaaaagggtgtgaatacagggatgtgtgagcaaatggggcattactgcaatcagtccactacatgttccttgatgtcagggttacatctcaaccatcttttcatctctagatcctatcatgttgcttggcacaaggtagttgcttggggaatggtgaattgatctatacagttatctagtccgtttagcatcccctcaaacttgggtaaactccagggcacaaggagggcattaggcaatgttcttagatgctgagctttaagggagtttttgcagctggcttttgatgaggaaagtctatggagagaaaatgggtatggcacttggtaaaaaaaaatcgggagattgttttacggaaaaataaaatttcttacctcctaagcaaaacatcaaaacatcaaaattttattttttacggaaaagtaaaattttttacctcctaagcaaaacatcaaaacatacatacttatgttgtacttttatttttctttcaaagaatgttcctcatgttaatttaatctggctttattttgtgaataactagggagagagtacatagccatgtttgacctgggccccatattctcagagtcaaggcctctgaaaaattttttgaaagtttgaataaccaggaatagaatcatccttaaacctatgtgatgcgggctgctttcttaggcctaaaattttagagggccttgctgttttttctggcgttgcctatccccatcttgctagtattggggtgtcaaagatgtgacaggggatatgcccacctagagcttgaacccttctaccttctaacccatgtagcaggaaactgggactctaaaattctctgcctaaatgggctcaagctgctttcaggacctgtgtgggctcctttgcttttctcctaaaggcagactctaccagtgtataccctttctaggcccaaggggtggccaagggtagctgtttgcacagtgagggttagggggtggatagatcttggactttggtttggggtgcttataaccttgctttggagacccctgagggtacaggatgaaactgagagtaggatgagatgttgacgggccttaggctagggaccactttgaccggactgtcaagattgggggtggcctgattagggatctcataaggctgttgacaggagtggaatcttccatgggagcaatagtcagatttgtctcaacttaaattctgggaattttgctaaaataagaatggcttctgagatataatgagctaaacctgaaatgttggttcttgtaaatacatggtaaaggcgtgagattagaatttctcttttaggaaacctgtcaaattgttaagctccttttcctcttttatttgtgatctaagtgatttgtctatacagcctcacagatagtagatccagtcagtaccaagtacatgtgactttagcgtttgtctataaatcagatggccacttaatgggtatataatagaagggatggtaatagaggttcatactgaggcatttaaaattgttttaagaagattcagagagggaaagtttgaggcaaagggaacacaaaaaacaaggggatactggtatcactgtggctggaacaaattttaatgatgcttttctggttcccacttccccaacccattttttttttaaagaatctatggccaatcactgcttgcttgaaaaattgcctttgttatttacattatgcttttaggaattttagaatgatatgagagtctgtaatagaagagtgagaatcaaagcttattgtttccaggctatggcttgaatttgaaataagaaaggcaaaaatacaagttttaatctttctaacctgaagattaggttaagaagtcattagtagtgaacaagtgtctagtaatttcatttataaggcatttgattaatgactacactataaacattatttccaatgcacacagctctcttaaagccaactttttttttgtgagttggcacagatttgtcatcgtttctggtttaatgttttgaaagagtcattatacaattccttagaagaaagttatttccctttggttatagtaaaattgtattttaatgtgatgtgatttgataataacgtaaaatcgtcaaatacaagggcaggagaaggtagatttattaggtaattgaattactagagatgctattgctgtgagagaaaactcaattacctgtgggctgtggacaaagagcttcctatttcctgatggggatctaaaattgattagcttcaggcttgtagaagtcttctgctattattaatagaatcaagaattatagaaatagaggaattttagaaatcatctaatctactatcctcactttaaaagtaaggatattgaggtgaaaggtcccatgtccaaggccacactgcagtcagtgactggggccagaacccaagactgttcccctgaactagggactgttacttcgaaatacagacaatatctgttcttggtccatagagtatatattttgagggcagggtctttcttaaaaaatgtcttctgtatactatttaaaagattttccatagttttcatggatgcataaactataaagccaaattcttggcctgtttataagttctttggtttgactttgttattgccagggtatctcagtgtagcaaaataactccattctttatagatctttttctgatgatttatgggaaacttaagataaacctttaattaatttatttttttttgtttactttgttgactggataaaattctttcacgtggttcaaaaaaatctctgctgtattttaacatttctttgataatctctaaacacttttgtgtaacttaaatatgtgtcaatgtatatgcatatctgtagatttgagaaaatctggggatttatttaattcattattaatttattgtaatcaagttggtaaattattttaaggcatcatctaatatgttttttttccactgtctttttttttctcaatagggatgaatgggaccttcaggatgtatgtaaaacaatccttataggtgaaaatctaattgatttttgaaagtcaaaaaggattttgattctattatgttctctgaaacctgtcttgtatttgaatacccatatggtcaaacagttcttggttatatcctactgaagctttcttcttttttttttttagtctttttttttcttctattctcttatagttagaaatcagcatgttttgacaattatatattaagaatctaggagttaagtaacagaaatttttctttatcattagaaaaatcatttgcttgtgaagtgtgaaaaaagggtaatgttatatttgtagtagagttttgaagccagatctcaaggctatacagttaaaggatagtggagctgggaataaaaccaaggtcaaatgaaattcattctcacttagagtagggggggaataatgtcatttccccagagaacatactctgtagctattagaaacatttaaaagaatttttaatatggattataaaactggcatagatttaaaaataatagcatcctaatgtcaactgggagtgtaattctgcagtatagaggaaaggatgcagaaataggtctcaatctccatttgcttggcctcctgacctcgagtaaataatttaactgttttcagtctcgggatgataatacctgtttttctaaacttctaaggttattatgagggtcaaatatgataatacaacagtgctgtgtggatgtgttagcatgaagccagagcatctgatgcattcttgttttatcttgccagcagtggtgtcatctctttgaaggtggacaaagcagtggggagaattgcaattctatatcttgaaataactaacaaagatatcttggtcataaggtcttaaagaaattctgggaaaaggtgaccatataagagtttataatatcaaagcaaggcagcattgggtatcatttttttaaaagtagattttaagaagcttagaaacaaagtagatattttagaagggattgtgactcatgaggatggtacgtaagaagaaaatgaaattctgattatttacttacgaatgattttttggtttctttttgagacagggcctctctctgtctctcactcaggctggattgcagtggtgcaatcacggcacactgtagcctcaacctgcctggctcaagtgatcctctcacctcagcctcctgagtagctggggccacaggcatggaccaccatgcccggctaatttttttgtttttgtagagacagggtcttgctatgttgcctgggttggtctgcaactcctaggctcaagcaatcctcccaccatggcctcccaaagttctgagattacacgtgtgagccactgtgcttggccgtgaatttaaataggagagagaggcgtatggacaaggtgatttattaaaaataaaacaaaacaaaacgacaacaacaaaaaaccatggactatatttatatattctctagccataaagtatgtgaataatattaaaaaaatcaaggtaggggcatatacgaaggaaaaatacataagtggcttttaattaaaatggagctggtgactttccagtagtagaattggctttaattaaactatgcatttaacagaacatacttcaaagttaaaagaatgtctactagctactccctcactcttgacagaaagaatttgcatgaaggtttaggtatgatagcgtcagagaggctaaaactgagaattggccaaagtttttgaaaaggttaaggcaaaaacaaaaacaaaaatgggttaaagacaggagaaagaattttttttgttgtttatctagaagtcggaagagagaaagccattgattagggaagatggaaaaggctctttaaagctattctttaccggaaatgtattagcagagaccgactgaacagtcatctgggataattgcagaaggtgaaagttgggctttaagtatctttatttcacccattaatatttaatacatatagtatagctgacatgcttacatggacatctaggtgtgttgtagctgtcctgatttgagtttaagcttcattttgtgttgctctcaccaagatttaccagccatattttacagatttgtagtgatatcaagtgctgagaactaggataagaggaaaattcgaagagaaaaactacaagtatatccgcctttattctccgaaccatttctcattatttagagtatgatgaatgaatcaaacaatgatcttgggtatagttcttcagatatctgttctcaaacagtgtgggatctaccaattagaatgctaattgggaactaaaaataatattcatagtaaatctgctttctggttttattttaagacttggctttttaaagttttctccatccttgtttggaagtactcattctgtgaatttatatagaagtagcatttctggccaagcagaaaaaccaactagttggttcattttcctagaaaactaccagatgccttcctagagataaagcataaccgagtttatttaaaattgagttggtgacttccttgtgtaaaactgactttaaaatatgcatttaacaaaccatatttcaaagttctaactagctacttactccctgactcactgaatgaaaaagtattcatataaagttttaggtgtcagttgaattaacttataaccaacttccactgggaaaagatatcattaagttgtttttttttgttgatactgttcctgaaaaatgtatttgagaattataaaggtggcatagtttatgttagaatactactaataataaccttcaattctgtgtgtatggggcatgggaaatatgtatacgtctatttaggaggattatttttgtgatgattattagagaccaatcacagcagcaaaaaacaaaacaaacaaacaaagaaccaaacaaaaacagttatgcatcctgaatgaaaggtaaaaataatactggacatggtttcttgaactcctggcctcaagtaatcctcccaccttggcctcccaaagcactgggattacagatgtgagccactggcacccaactgggacatagtttctaaaagtcactccacatggctattgaaaagtcttgtcttaaaaatagttggtttctgaaaatcttctcatataattgacttcatattgttttgcaactaaattgtgctggaaggacccatagtctacctgagagaggaagagcatcaaagtgaaaaggctgcaatgaccaatacagtctcctatataaggaaggtgaaggaggcaggtgatgcaaattacggcattagagatggggctgcaggtatagatttggcagtcgtcctatacagtaaacatcacagctttttccaaattatttttttcaaatgaacgttttctttaagaagagttttagattaatagaaaaaattacatgggcaagtgctaaaaaaaaaaaacagaaaaattacaaagagtacccatatatgccacacttgtttttgcatttattaatatcttacattagtatggtatgtttgttgcaattaatgaaccactacttttacaatattattaattaaaatccatattttattcagatttttgttgtttttagcctgcttgcctttttctatccaggatcatatccaggataccacattacatttcatcatcatgtctctaggctcttcttagatgtgacaatttctcagactttatttcttatgaccttgacagttttgaggagtactcattaggtattttataaaatacctcttaattgagatttctctgatgtttttctcacggagttatgtgtttttgggagaaagatcacagagggaaattaccatcttatcacatcatatcaaaggagcatactgttagtgacttagcactgttgatgttgtccatcatcacctggctctggttatggttgtcaggctttccctttctatcctgtattctttgtaaggaagtcactgtgcataacccacacttaaggagtggggagttatgctccatctccagagagtgtattgtattatctacataaattatttggaactcatctgcgtgggagttttgtctattattctccatttgtttatttattcaataatttatatcagtatggactcatgaatagtttatactttaggttataatccaatgctactttatttatttatttgctcaaactgttcccgtgggagctctttcagttggttctatgtccgtttgacatagtctcgtaattgtgtgtgtgtgcgtgtgtgtgtgtctatgtgttttgaatacttcctaattttctgtcactacaagatgctcctggatcatcatctatatatcctcccccagttctataattgactatttttccaaggagccctggttcttttgtttggaaatggtgttagaaaccaaaatctaggcactaggtgtactcattgttattggattgtagctgcttttaggctctctcagctgacagagcaagggaatgtatttgcatataccaacctgtgtatatacacatatctacaaatatttctgtatgtaatcatctgtatctatgttaagctaaatatgagtttagactgatgtctccaattctaattcatcaccacatggataattctagcctcctcctcttgcttacctataacttcccattctaacagtcagaaacttggttgccatccatccacttaattgttcatttatgtatacatgtataacagtatcagaattaactggtatccccagaggcaagaactttatcaactacagcagcagttcccagcctttttggcaccaggggctggttttgtggaagacaatttttctatggctggctctggcagggagtgttttgggatgaaactgcccatgtgtcacttagttgacctaaggcgcatgcaacctagatcccttgcataagcagttcatgatagggtttacactgttatgagaatctattgccaccactgatcagacaggaagcggagctcaggtggtaatgctgttgcccacgggtcacctcctgctgtgcggcccagttcctaacaggccatggataggtgttggtctgtggcgcaagagttggggacccctgaactagagtacagtggttatgtgtggttccttttccctttagtcttgcagactccactcatttccaaagttacttaggtcaactaccctctccccttaccccttcagtgaggttgtttcatacatttgcaatagagttagactgtctgttttgtcacattctgcattctattctgggatcctttgatgtccttaattatttttgtttaaattgcatggactaaggtttactttttgtgctgtaaagtttcataggttttgacaatgccttgtgccatgtatttgccaatacatactaagatagtttgagctatttaattttatattattatattgtattattttatgttatttactagtacaatgcattgtcaaaacctataaagtaaggttttgaaatagtccaaactattttcaattatttaatatttgactttttttttttgtcttttgagacagggtctcactctttcacccaggctggagtgcagtggcttgatcacagttcactgcagccttgatttcctgagctcaagcaatccttccacctcagcctcccaaataactaggaccacagatgcacaccaacacaccgaactaattaaacaatttttttgtagagatgaggtctcattatatcacccaggttggtctcaaactcctgggctcaagtgatcctcctgccttggcttcccaaagtgctgggattacaggcatgagccactgtgcccagccttgaccactttttttggaccggcaattttgagtggttcaatccaatataagttgaaatttaagccaatctattatttacatgcagttacatgaaatagctaaaacttttgagtaagtattgttatcataaagatatctcataatcttaactacatagttatatatatatattttttctcctgcctcagcctcctgagtagttgggattataggcacgcactgccacaccaagctaatttttgtatttttagtagagatgggatttcaccatgtcggccaggatggtctccatctcctgacctcatgatctgcccacctcggcctcccaaagtgctgggattacaggcgtgagccacagcgcctggcccaatttttgtatttttaatagagccggggttttaccatgttggccaggctggtctggagctcctgatctcaagtgacccgcccaccttggcctcccaaagtgctgggattacaggcacgagccaccacacctggcccccacctttcctgtctgtgattcctcccactgtccttgagcagggaaagttgtgaaaagacagtcaggatcttctttgccactggaaaaccggaaagctctggtctttcctcaaaagctatttgctttatttttacttattttattttattttatttatttttttgatacagaatctctctgtgtctcccaggctggagtgcagtggcatgatctcggctcactgcaacctccacttcccaggttgatgcaattctcctgcctcagcctcctgagtagctgggattacaggtgcccaccaccatgcctggctaatttgtttgtattgattgattaatttttattatgcttaaagttctagggtacatgtgcacaatgtgcaggtttgttacataggtatgcatgtgccatgttggtttgttgcacccatcaactcgtcatttacattaggtatttctcctaatgctatccctctcccagcccccgactcccccagcaggccctggtgtatgatgttccctgccctgtgtccaagtgttctcgttgttcaatttcccacctatgagtgagaacatgcagtgtttggttttctgtccttgtgatagttttctgagaatgatggtttccagcttcatccattctgcccttgtgatagttttctgagaatgatggtttccagctttatctatgtgcctgcaaaggacatgaactcatcgttttatatggctgcatagtattccatcgtgtatatgtgccacattttcttaatccagtctatcattgatggacatttgggttggttccaagtctttgctattgtgaatagtgctgcaataaatatacgtgtgcatgtgtctttatagtagtatgatttataatcctttgggtatatacccagtaatgggatcactgggtgaaatggcatttctagttctagatccttgaggaattgcccactgtcttccacagtggttgaactaatgtacactcccaccaacagtgtaaaagtgttcctctttctccacattctctccagcatctgttgtttcctgactttttaatgattgccattctaactggtgtgagatggtatctcattgtggttttgatttgcatttctctgatgactagtgatgatgagcatttattcatgtgtctgttggctgcataaatgtcttcttttgagaagtgtctgttcatatcctttgcccactttttgatgggattttttgatttttttcttgtaaatttgtttaagttctttgtagattctggatattagccctttgtcagatgggtagattgcaaaatttttctcccattttgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttgtataagatgtaaggaagggatccagtttcagctttctacatatggctagccagttttcccagcaccatttattaaatagggaatcctttccccatttcttgtttttgtcaggtttgtcaaagatcagatggttgtagatgggtggtgttatttctgaggcctctgttctgttccattgatctatatctctgttttggtaccagtaccatgctgttttggttaccgtagccttgtagtatagtttgaagtcaggtagcgtgatgcctccaactttgttctttttgcttaggattgtcttggcaatgcgggctcctttttggttccatatgaactttaaagtagttttttccaattctgtgaaggaagtcattggtagcttgatggggatggcattgaatctataaattaccttgggcagtatggccattttcacaatattgattcttcctatccatgagcatggaatgttcttccatttgtttgtgtcctcttttatttcattgagcagtggtttgtagttctccttgaagaggtccttcacattccttgtaagttggattcctgggtattttattctctttgaagcaattgtgaatgggagttcactcatgatttggctctctgtttgtctattattggtgtataggaatgcttgtgatttttgcacatcgattttgtatattttgtatcctgagactttgctgaagttgcttatcagcttaaggagattttgggctgacacgatggggttttctaaatatacaatcatgtcatctgtaagcagggacaatttgacttcctcttttcctaattgaataccctttatttctttctcttgcctgatagccctggccagaacttccaacacttacatagttatatttttatttagttagtaaataaactatgacaaaacacttgcaatttttttctgataaaatagtcatgttaaatggttatattccttcatcctctccaaatatgtacgctttcaaagaagagtagatactaattcgaatatatcctacccagtgtgaggattttaggcagagttaacaatgaattaaaaacttttaggcagtgtggggaaattttgctttctaaagggaaaaatttgctcccttaattgttctttacatactactgcttctctcatttcattttctgaaagatttaagtcttttggaccatcttaaagtgatcccaagccacatcttctacatgaaacagggttatatttcttcattcaacacatatatatatatattttttagcatcttcttcatgtgtaacattgcgttaggggcagaattccaaattgtagatcagccaccttctgggtagctaaaatgcacttggaagcagtggcttccagactgctgaatttcacgaatcagttttaaaaaatggcaattagtgtagagttgccacctttttatttttgtcaaatcaggtcatagcaaatgaacaccaaacaaagttttcactaggttggatttgttttgctccttccaaatgtctaatttaaaatttatactatgtacttttttctaattagaatattttacatatttttccctattccatttttatttgaagtggattattcttaaactcttcagctattatcctctactccacaaatgtcaaggatagacctttaatgagtagaacagatgtcagggatttgacagtagtgaataatcatgtctatctcttgtcaatcttttgattttaagtgagggaaatgctgtggagaattgtttcttttgttgaaaacctagattagtacatgctatgccatagtgaatgcttaatgaatacatgccaaataaataaaaaaaagaatcttcccaaattcttattcattgacatgaagatataaaatctagcatgttgataacattgaactttcttaaataattctataacaaattctcttctttttgtatggatttttcatacaatctgtgttaacatttgcttgtgaaatcaattagaccaactagaaaaatacagttaaatgtttaaattacttttgatcaaatggcttttgtttgataaatgctatcaaaaaggactaatcaagtttctaggtctgcggttcatttttttttttgactaatacttgtatttgtacagaaccttttctttggagtttattactcttgtctataacattttcaggatttaattaggagagggattttcctattcaggatatgtataggtcagattatgatgctgtggcatgtagaccataccttagaattgtgttgtatttggcaagaacttcatttacttttaacaatctggcattttctacattttatggatggaaataataaaaatgggatctttgccctaattggccagtggtaaaatttaaccttggttttcatggtcttagactttttcttaataagaaatttgtttaaaattagtacatttcttattaccattttcattttgaacctaatttcacaagtaagcatttttactgagcatccagtatgtccctttgctgacctagtgattctacaagtcctataccatttgtaagaatcaacaagactgatacaataaaatttattttaaatcttcaggatacagatacaagtgattatatttatgaagatttagagatttataaaatttaatcgagagattatttcatttttaaaacctattttttcttcttattaaagaaaatacatgttcattaaaggatattttaaaaacagataaaactaaaagaaaataaaaatcacctataatccagttacttggaaattagccacttttaacattcggtacagatttatcttatgctatattgtattatactgttatatgatttaaaagtgtgtgtgtatatacatatatatatatagagagagagagagaaatcatattgtacatttgggcttgttagctttctttttcacttaatagtagagagtgaattttttttttcatatttactattctgttacctcattcttaatgattacttagtctacagtgggtgataaatcctctctttttggatgtttatattatttctgataacaatttcattttaactgttgttagttctacaggaggttatgcatttgactttttacaagaaaggggtgatgagtagtatttgaaactaacgtgagtttgtagggccgtagtgtcctccggatgttgggagctattgctctggggcattgttcctcttagcccctccggacgcttgcctagctgggctgaggcaggctgaggcctgtttgttgttagcccagctgcaagagcagtggccttagtaacgtcagcaggaacagagcaggcttcatctctaccctttgtctggatttggtgctggtgtgttttccccgctgctgccatgtgatggctcgtaagcagcactacacactggatctgtaactccttttgaaagctctattgtgagatgctgctgcgtttcagtggaggggagatttttgctagtgtgccacttttggtttctttcaaatgtggatgtgccttcctctaaagaatcctaggtaaggaaagcactagttttgaagtgactaaaaatgaattaaattatcctttcctccatgcttcctatggtggaacggtagtaaaataggaaagtaagtactcagatttccttgcctactttgcattatagttaatcaccacgggagaggtgggaaatgagagagtgagagtgggaatcagggaagatttcctaaatgaaataatatttgaatgaggtgataaagaataataatgggtggcaggaaacacagaaatgtggataatggtagttactaagggtttgtttatgtactcatccataaaacattagttgagggcctatgctataccaggagttatactagactttggatacccaagaattaattagacatggttcctgctttttacgggttgacagtctggttgggaagatggaaaatagacaaaacatatatagtgggttctatagtaaaggtttctacaaataacatggaagtatcatagtccagactaggcaggttaagaaaagtcttttcctaggggttgacacctgagatgagacttgaaggacaaatgggcaagggagaaggtacaccagatagaagaaactgcatgtgcaaaggcaaggatgcaagaaggaagctggaatatccaggcactgcaaggagttcagtgtacagcaaaagagagactgcacagtgggggaggattggcaagaagtaatttacgagggcttaagacagtaagggacgtggagaaaatcaaggacaacccccagatttttacttggttggtagtgctattcgcactgtatgttttcattgcagaaaataaacaaggagggacagattcaaagaggacaatagcgtattcaaattaggacacgatgcgtttggggtacttgtgatatatcgatataacaagtagaaatctggggctcagaagagagattggggctgcagattcacgggtggtagccattagcagggggtggatgaaaccaccgagggggagaacatgcagagtgaaaagatggctggaaaaaaccccaagaaggagcggacaaccaaagatactgagaaggaggcaaggagttggaggaaaagcacagaagacaggcgaggagacagaggtcagcagtatcaagtttttctgaaagaagaaatcagataaattttcaccacttttaggaatgaggccattggtgatcttggtgagggcggcttccagggtgaagtaggaaactgacctgaatttcagcagggcagcagtcagggtggcgtgatttaagaattttcctttaagaagcttgtctgtggaggaaggagtgaggaatgatagcagatctaggactgtatgaaacaggatggagagagatgatggtttacttgtctttttccccaaggttaaaaagctggaacatttttatactaatgccgataaaatatgcatattattgatactttgaaatgtatgaggccgggcgcggtggctccgcctataatcctagcatttagggaggccgaggcgggcggatcacgaggtcaggagatcgagaccatcctggccaacacggtgaaacccagtctctactaaaaaaaaaatagaaaaaattagccgggcgtggtggcgggcgcctgtagtcccagctgctcgggaggctgaggcaggagaatggcgtgaacccgggaggtggagcttgcagtgagccgagagcgcgccactgcactccagcatgggcgacagagcgagactctgtctcaaaaaaaaaaaaaaaaaaagaaagaaatctatgaagttcagcacctaggaaagatgacagtcttgtagtcataccccacctgccggaattgagaaatccaaaaatttattgttttgtaattgtgacagaaaaaaaaatcatctatgatgtcttatacagcattttcgcactcttgatttttccatataatcccgaaagaagacagcacggagagacaagaggtgaatgaaataggccctgagcagctgaggtggtggagcaaagttcctctagattactcaccagtgaacaattcaggcccttgcacagagcccactcagctccacacaactctcaccagtcagcttgtctgacatctacacccattacagaggaggagcaaggaggagccgcgtgggtgagggcaggcacactgatgcccgggagaagtggtagtcaatatgctgataacgaaggagggacagacatgtcagaaaatgcctccaaaaggaataataatgccaataaaagctcacaacttgtgcagggttaccagacccctctgtaatagcaactgaaggcatcactatgttttaacatagtagcaataattggtatttcaaatgaatgctccatcaagaaatgtttaaatactcggtatactatgttttaagaacgtgaacaagaaaatgccaactgcattttatagtttgacattaaaataaaattttggcaattaaagtgctagctgggacctttcctaaagggtctcactctgttactatttgtagggcatccaaggcttagtgcttcttacataaattgatgagagatagagctgtgatgtgtagaaggtacagaaaacctggttatagatgaaaagaatgcccaggaagctatattagttcaagtttacatttccatagcacatttaaaaaaataataattttcaatctgtattgccctgtgaaatcataaaaaggttaataaatagaatttttcaagaattaataaccccattctattctgaaacctggaaaacacattaactttattagcttttaagtaacaaatattcctcttttaattctaaactatagtttgcccttttaatccatttaattgaaatagtaacctatagtagaaactattaaaaatcaattatgaaaggtccattaaatttctttaaccagttacaagaaataagtattttaattgttctttgagaactgccaatgaacaaaatcagacttttgtaaaatgaaagtaaaaatgctcatgattgaattgtggtagccctgttgatattcaggaaggataagccttgaaacctcctgagatccaaagtttctgatgtgagaaatgtttttgtcttttataatcaagagtctgaaatctagacaatggcttaaaatcaaagtagtgacctggaatgtttgttgttgactctacagaaatgtgttgaggagtgataatctttgccaaaaggagggagtattttttttaattgatcaaaggcttaaatctttttttttttaaactaacatttggttcagtcagtgttacctaccgtcttttatgttgaaattcagaagcaacatactttagtgattgacttatctgttggtgatgacatgttatgacatgttgttaggtgtttatcaaggattggaaattccaatttgccacgtaaaagaatggttactggttaaaaactacttgtattcttctgtgctatgagtgaaaaatttctatagcatctatgttaaaaaatgcttgttaaagggttgaactctcatgtctgtaatcccagcactttgggaggctcaggcgggaagatcgctttagtccatgagttcaagaccagcctgggcagcatagtgggacctcgtctctacagaaaataaacaaagtatccaggcatggtggtggactgccaaatagtcccagctatttgggaggatggggtgggaggattgcttgagcccaggaggtcaacgctgaggtaagctgagatcgtgccactatacttaagcctgggtgacagagcgagaccctgtctcaaaaaatatatataaataaataaataaaaataaagggtttaattaggggtgaaaatgaggtagaagcataaggaaaaattctaattgagagaaataagataaaagtgtcattcttaaaaaatgttgtatgtatatagtttgctgtcatagactagacagtggcaaatactgtaactttatcatagatctttcctttgtacttggataccattttgaattttatttttctgtatgtatttttttccatttaaatttatgctccaagatggaagttaacagtaataccaccttactttctttttccacgttacaatttttagagacatttcccaagggctatcttatttattaatatgtgattcaagtacactggggaaggtaagtatactattgttattttacaaaggaaagtacaggtaaaagagagttcagtaacttgtttaaggtcctgtagctagtgtcaagactaaactctttcttacttgtacttcattgtcttttaatcatagcacattattaatgtggaaattgataaagacatttttgttggaagtttaattgaactttgaacttgaaaatttaacttgtagacattttactcctgaaaaagggggcttaagtaacctaaactggaaagacattaagggctggaaattttacatagaccttgaacattttaaaattttgcttaaaaactgcttaaaatgttctattatagccaagataatcacagagctagaattcattctctactatacatgggcactacattcattgtaaccaactagtgttcagtagaagtataattgggaaagaaggaagacttaagttacttatatatgtaacaaggcagcttattaagaatttactaggctgggcgcagtggctcacagctgtaatctcagcactttgggaggctgtggtgggtggatctcttgagcccaggagtttaagaccatcctgggcaacatggtgaaaccccgtctcctcaaaaaatagaaaaaaaaaaaaagccagcgtggtgtcacgcacctgtagtcccagctactcgggaggctgaggtggatcacctgagcccaggagatagaggttgcagtgagctgagattgtgccactgcattccagcctgtgcggcagagtaagaccctgtctcaaaagaaaaaataaaaattaccataacttgatgggaaaatgcaactttattgtttgttctacagcattaagagaagcatacaatccatccttggggatgggagactgtccactgcattcctaaataataaatcctccttattcccaaggaaggtaaataggctcttggatggtcctagaattcatggcccaggcttttaggatcatcctgcacctaaagcccttgggagaacaaccaaaccctaatgctgttgaaagatattaggaaagacatgagggttttctttagaagactggccagtttctctcaggaaagaaggacatttcccagagacaggaagtcaaagatggcctgttttttttgcgggtagttgaagctggtgctttactgaagcagtgtcttggaggtccttatggtaggtatggctatgtgggtgttggggatgactgagcactgagaccatgactttgatatccatggtgaaggtccttatagataacttggtacggaggctgagggagggtggcatggagggtaagcagtgaatgctgccagtggaaagaagttaccttcaacagaaccacggggtttagacaatgaatttctccagggggattgcgctggacaagtgactacaggccttgcctaattttccttcattgcatcatctttgaggtccttacaccactcaaggggtgagagaagagctcttaggcatatctgatatttagatttcttactgatgtggctgactcttagctttgaagtctgaactgatttgaatttgaaaaatgaaaagatgtgacattttttgtttcttgagtcttgtggagcagttcatagctttatgtgcgtacattcattcatatacacatgcatatgttactgtatactgcatacttctctttaatacccctgtggtctttacatatccatcctgaaatgtcgtcatcctcatctgacaacctagaaaatgctaactcatcattcaaaattcatgtcaaatatcagtcttcctttctgagtatgcagggagtaaggagtctaaaaataattcttggcttcttaatttgtgatatagagatattgcctgccttgcttaaatcacagctggttatgagaattgaatgaaatgacttaccttaaagagacagaaagtagctaagggtgggagagtccaagtagcaaaagcatggtgtggagaaatttgatatgcatggggagagggcctgagggagacctgtctcaaggtagctgaggatttttctttttcggtatatgtggtggggaggaaaatagctaaaaaatatttacttcatgtaagactagatttaggggagaatattaaaactcaggaagaggacttttaacataatgaggtggttaaaaggagacaacttctcaatagacaagggaggtattttgaatagatttttggaaatggtacacaaaattagttttattgaagagtgaaagagctggacagatgggaaaatcatcatggagactagtagattgtgagggtgaaaaccatgagtaggcttaaaagtattgtctcaagacaaaaaaaaaatgggctattttggaagtaaagagtttttaattccaggaggtggccctctactgatgtaagcagactgtgatttagtatgtgaaggatggatgtaccagactcatttcccagagggaagaggcagttactagattgtttagcctcttcacatgcttgtaatattgttgctttcaaaggtttgctgaagaaatgaatgaaatggcttgtcaagtattagtaagatatttctagctgtagttcaattgcattttttttttttttttttgagatagggtctccttctgtcacccaggctggagtgcagtggtgtgaacatggctcattgcggcctcgacttcctgggctcaagcgattctcccatctcagcctcccgtatagttgggaccaaaggcacgtgccaccacacctggctaagttttaaattttttgtatagatggagtcttaccatctttcccaggctagtcttgaactcctggacccaagggatcctcctgtctcagcctctcaaactcctgagattataggtgtgagccaccacgccctaccaacaaaacttttttttttttgcccgacccccagcaacaaaacttttgattccttccttataatagtttctttttaaataacttggacaagaaatgtttgcacagaatctcactgataatgtactttaacttgaagagtatgaaataatcttgagtctactatttttgttttttaatgaaaatgcattaatcatttacattttttaagatacccaatttattttggaagctatatgttattttcataaaaaattcttaacttacagaatgtccactgcttaggatttcctgttttttttgtattttaaatatatctctaacaaataatcatcacgaaggaaaagaggttacatttattgcagtcctgctatgtgctttatgcatgttatatagtcctttcaaaaacttttcaagtaagtgatactatttttattttatagatgtggatcatgagatttagagagacgatgtaaaatatagccaagataatacagtctcagtcagaggtggagctgagatttgaacccaagtctttttggaaacaaaatttgattctcaccacatttcattccagggaaaaaataattccatcctggctctgtttttatttatagccagaaatggaccacctctaactgtctccactgctgccattctggtctaggcttccctgatgttttgcctctattactgtaacatctcctaattgttttccctgcttctctctttgatccccacagttgatttttaatggctaatgcaatcctttaaaaacgtaagtcaggccgggcgcagtggctcatgcttgtaatcccagcactctgggaggctgaggcgggcagatcacctgaggttgggagttcaagatcagcctgaccaacatggagaaaccccgtctctactaaaaatacaaaattagccgggcaaggtggtgcatgcctgtaatcccagctactggggaggctgaggcaggagaatcacttgaacctgggaggcggaggttgcggtgagccaagattgcgccattgcaccccagcctgggcagcaagagtgagactccgtcacagaaaaaaaaaaaaaagaagtaagtcaggtcatgttactcctctgctcaaaattcttccatcactccccatttcacatggagaaaatacagagttcctacaatggctgaggtgatctggcgcccctttctttctctctgacctaatatctgacttcttccccttgctcattcctctctagcatgccaggcacatgtctgcatggctaattcacttaccccttcaagtcgttactaaactctcactttcacaatgaggcttactttgatccactatttaaaactgtaactccagtgggacttaagatgcaaaaatttgtgattttcaggattttgattatatgctttaaatatataaaattctctgctatgttcaatgataactactttttcatgttgacatacagaattggaatatatctaaaacaccaaaaacatatacttataagtagaatagtaaagatacacataatgttttctaatcgttgactgtatctcattgtaagaaatacattttattgtgacctcgtgtatctatataaaatggaaataaaagttttataaaatacttagcatttctgtgtgttacactcatatagtttctgttgaattccattcctttcttttccattatgaaaatatgttggtcaagttctacaaaatttatttcacaactcatttattggttacaacctatagcttaaaaatattgggctattcttcaaatcccattaatgcaggagataagatatgaattttttgcattaacttcttgaaaacatacactgcagagggtgatgattgaaaagtcacttatacttttgagttattggcatgtagctattactgcattttgcatattcatgctcagattaacaaaagtaatatagattaggttgcataaatatgtaattaaataattataagtgcttatattttgtcaatattatttgctaatggtagaactcttatattagaagtggttttttccatccagtggatcaggagatttctatcttttttcccccctaatttccaaatttcagtattttaatttttgatggattggtgcttattttcctatctttattgatattagatactgacagtgaagaataatattcaataataaaaatttgtgcttcattttaaagtattttaaatgaataataataataattaacatataaccctacatagcttattgtacatttgtttattagtatcttaatttcttcgcactgaaaacattaacagatacctctataatattctctaatatggtgtattctctaaatttgaaatttcctaatgtaatctttcttaaaagtaggagatatatattccaagcttatcttttaccattgtcctcttacatgtaatgctatagccatattaaatgtggcctgtccctccctccttccctacttcccttccttccatctttccttcctcctgcctttctgcctccttccttttcttcctccctcccttttttccttccttttaactaatatttttgaacacctgctatgtgccatgtgtagtagtgggaagaaaataaatgacatagtctttgctgtctctgaacttaaactggatactaacagtcccagttatgaaagtgaaaacagaaagctttaagattatttagaaagtcagaggtggtggctgggcattgtggctcacgcctgtaatgtcagcactttgggaggccgagctgggtggatcacttgaggtcaggagttcaaggccagcctggccaacatagcgtctctactaaaaatacaaaaattagccaggtgtggtgctgcatgcctgtaatcccagctacttgggaggctgaggtgggagaattgcttgagtctgggaggcagaggtttcagtgagccgcgccgagattgtgccactgcactccagcctgggcaacagagtgagactctgtcttaaaaaaaaaaaaaaaaaagtcagaggtggaatcagattctgtgaagaattagaagaggcatcagaagacactctttagtcttcgtattttaaagatgtagaaactgagtctcttatagattaaatgatgtggtgaggttacagctgaaacccaagctggtttcttgactagtgctctttccataccacctcttctctcttgactatcacattgcctgcccagatcccatgttgtcatatatttttgtatgtagtttgtgctgtcaaagacctcttttcaaaatgcacacactcaaccatagactgttaccgttattggttttgttacttgaaattataattggaacaattagagatgcgtcagtggaaaggcaatgaaagaaggccattaagtgctaataaatgcctctcctcatgggaacggagatcttttcttctctatgtatttgagctcttttcactggtgcttttaagtggctagaaataacacttgccacacgcttgtggaatactctggatgccagggggttcattttattctgtatttgaattgagcacactgcggttggaatgtgtgttgattcttttgttgatttaagcattcattccatgttttgcattaaccttttctcatggaagacagaatagtgagagctcttagagaatgaagtctttaggtagctgatgactttccaagaaacagatgaaaaggttaaagttgtaagtgtttatgttgatatattttccttttcataacaccctaaaatctagatacaatagtcttcccttatctgaagttttgcactctgctgtttcagttacccatggtcaattgcggtctgaaaagactcaatggaaaattccagaaatacacaatttatgttttaaattgcatgtcattctgagtagttagttaaatctcttaccattctgctttgtcccacatggaatgtaaattatctctttgtctagcatatccacatggtatacactatctgcctgttagtattatagagtcaggtactatctgtggtttcaggcatccactgggggtcttgggacatatcccctgcaggtaagggggagctactgaacagtgtgacaaattggatgtagccctccctaaagctacatgcttacctgtggctagcaagagataatcactacttgttgatatggtgatatattagcttcagaaacgaatttaggtaaataatgaatgaattccagaataacttaccaatactaaaaatgatgacaatgatagtaatgatgatgataaggataatagcagctaatatatttgactacttactatgagcctgtaagtctgtgccttatagaaatgagcaaggttgtcctgtcctaagagaggctacataggagaggatttgacttgggctcctggtacttttggaaaaaacaggaggggcatctaaatatgccggcatatcaggaaatgcttcccacaggaggctgcatcaacatgtctttaagagtgagttcattcctcaataaagaaagaggcattagacaaaggcttctgtggttaaggagtcaacactgaagtgtgaaattagtgtagaatcccttgggagccagctgttctgggaataaaaagtttgcgtgggggaatcatggatgtggcttctagagagtgagagagaagctggatccaggaatccacttaaatccttcctggttaattggaaaatcagattccattctttttaaataaacaggatgtgaccatggtagtgctccattctgttttagtggagaaagcaacctacacttttttggcttccaattaaatacctcactttaccccaacatcttttttttttttttttttttttttgataaagagtttcactcttgtcacccaggctggagtgcagtggtgcaatctcggctcactgcaacctccacctcccgggttcaagtgattctcctgcctcagcctcctgaatagctgggatattacaagtgcgtgacaccacgcccggctaatttttgtatttttagtatagacggggtttcgccattttggccaagctggtctcgaactcccaacctcaggtgatccgcccgcctcggcctcccgaagtgctgggattacaggtgtgagccactgtgcctggcctctagcatcttaaaatagtgaaaacaaaagagtacactattggctggagaagctcacttctaccctatccacgctcttcttttccagcctcctgccaaggagctggtaatgtatattcaggaccaaggacagtaattgggccccatttcttcatctgaagccttagcaggggaggggttgacgtgagctgtctagaccagaactgccctggtcagcgggtaagtgttctcttgctgttgcttcttctcactggctggtttgtcttccacaggtggaagacaaacttttctagtcactgtcgtgtcaaagaaaagtctgagattcatgtatgggcttcgtggagaggggcaagggaggcctttgagcctctttggtaccaggccttagggctacctcttacctaggccaaatgaggatttcatgtggtccagcccatgtttccaggattggaaagggaatacattgaagtttgcagcaaaacccagctcagtttgtcctttccacatgcatttcttttagaaactctgcaggaaggggtggctaacagaactgaatgtttagcatcctgagttttattttttgttgatgtataatacatattctcagttggggtgatattgcccccaacagggcaaaaactggttcttgggggacaaaaagagtcttactctttttatgtttaaagcgcaggtgtatgtagagcacatatactggtatatagtatatctatgatattaaacttaataggggaacatttaatggggaaaaatatcaaataagtttcattaggggaaccataatgaaaagaagggtgagaaacactggcttaaatcattgtctgtctgtctgtctctctctttttctttgtctccttcctaggtagtacaaggctggttccagtgacctataatgtcatcactatcctactctttgttcttttctgatcttccatctgcacaattaccttgtagtattaaggtggttgttgcagctccactatcatatatagctgacagggagacaaaagaagaggaagggtaaaagttacacattaacgaaatcagaaccttttaaaggaactcttctgatgtcactcaaaacctctaattacatcttactgggtagaagttagtcatgtggacaccccatttgcaagggaggctgggaaatgcagattgatttgtctattaaagttgggcacattgccattcccagcaaaattgggattctgttaataagaaagggaaaatagatattaggtaggcaaccagtgatctttttactagtgctttttgccattcgttttcctggcagccaacttgggtaaaatataatctgtgatttggaaaaagtgaaagctaagtgcctttattttatgccaggactcattcatctggtgctttaaattcttgaacagactgacttagtgcataagcaaataaaatggattaaatattaaggcattaagttcttcagcatgtttcctggtggggagaacacttagtatttgtaaagtgagaactgacttctttgttcagtttatagatccctgactcagaaacttttgcattctaaatgtttcagtgggaaccattaattattgattatttagatttcatgaaaatatgttgtttagaaattttgaattttgtgaataaaagcaaaatattgggattcttaaagatgtcaacaaaaaataagtaaaagcattgtatttcctgcaattgaatttgtagatatgtttttcagataaaattatgatggtattgagtacttcatattatagagtagctgacagcatcaaaatatgattctttgtaaatctgtaagtactaatattcttaatatatgccaataatttagagaaaaaaagtaaacttcagtagaaaatttccaattaaatctgtagattttggtaaaattacttcctctagcgattaaaattgcattgtaatggttggcaaagttcccggatttgggcatgaaagtacagagctattttaatagcaccattgtgttcagggtgtggaactggattcttgacctcagtgcttcttggagcagggggtgggcagtatttgtgtgatttgtctgtctttctcttcctatctcctttcttttgcctgtttccctttccttgtttctttttttgttggatcagtatattgaaatattgtgagatagtactcctataggaattattttggtgcacagattttttttttagacagagtttcactctgtcacccaggctgaagtgcagtggcatgaacatggctcactgcagcctcgacctcctgggttcaagcaatcctcctgcctcaggctcccgagtagctgggactacaggctcaagccaccatgcccagctaatttttacattttttgtagagaagggagtcttgtcatgttgctcaggctggtctggaactcctaggctcaagtgatcctcctgccttggcctcccaaagtattaaaattacagatgtaagccactgtgcatggccagaaaattgtattaaatactttgaaaattaagttttaaaagagatttctctgttttttggtttttgtttttgttttgttttttttgagatggagttttgctcttgtcgcccaggctggagtgcaatgatgcgatcgcggctcaccgcaacctccgcctcctgggttcaagggattctcctatctcagcctcccgagtagctgggattacaggcatgcaccaccacgcctggctaattttgtatttttggtagagatggggtttctccatgttgatcaggcttgtcttgaactcccaacctcaggtgatctgccggcctcggcctcccaaagtgctgggattacaggcgtgagccaccacagctggctgagatttctctgtttttaaggaaaaaaattttaaaaatatattggttctggatttttttttaaattttattttcttccaattctattccatgtcattagacagagtcaataatattggcccacctagtattccgtattttgtaatttggtgaatatatttgggtcttaaatgttcataatatcaatttaaatgaccccagcaaattactggtgagttgagagtcatcttgcctattcttttggtccatataatgccttgtagctgtctgccagttgtgaattagatgtaggattgttttctctctatgttatgactatatggaacaatgacgaatcttcttgaaagggtatgtagaaagtgtaaaaaatatttagtgcctaggcactgaaggaggctctgagggaacacacaagggtgagggagcagacaagtgtgtgttgagagcttaggtagagacatgtgggggtggggggacctcgagaagactcccagagaagatgacatgcagctgagtgttgaagatttagggggatagggatgtgcctagacacgaagtctaagagcacagatgcgcacagagacttacactagaggacaaggctttatttctgctttgtttactgttatatctccagtgtctaaggcttcatttagcttgtagtagacacataatgcacatttgttgaattaataggttaaattaattgtaagaagttctatgcctctgatgtagggtttcacttggagaatgttcagaaataaaatattttgtaagtgatactaagatttggatttcatgctaaagatcctggggagtcattcagtgatttaaagtctggtaatgatgtgatagaacttacatcactgttaaagttggataggagggtgctcaaattagatgcagggaaattagttgtgagattagtgtagcagtttatatgatagttggtggaagctggagtggtgatccaaatagacaagagagggtgaatttaagagatattaagatagaatcaacaggacatggtgaccaacttggagcatgaggatagaggtagaaggaggatggatgattcccaggtgctaggcttggcggacatttatggatgctgatgatgtggattatgattgggaatgaaggaggagaaacatttggatagattgtaatgaactgtagagatgtttggttccagacacctagtggagatgtttaagaggttaatatgattgtaatgagttgtagggatgtttaagaggttaatgtgattgtaatgagttgtagagatgtttggttccagacacctagtggagatgttaagagttgtagagatgtttaagaggttaatgtgattttgagttctagtgtttggctacctctctggtagctcgtttctattctctcagttccacttctttcaggtacccattaaatgttggtatttctgagagtccatattaatcacttgtttccactccattcctactcatctgttcctttggcttcaacttcctgctctgttgctcactgtcaaattattgtctccagacaagacttttgtcctgagtgccaactgttcagtctaactgcctacatgttgtttcaatcagatattccccaggcatgtaaagataaatgtgtacaaataaggaccactcattttcttcccccatttcttttacaatgtagagaaaaatggtcaagagcacagatgctagagttagactccctagatttgagtcccatatgtcacttactagctttgtgaccctgtgcaaattatctgacttttttgtgcctctgttttctcatctgtaaagtaagaataacaatagtaccttcctcataggatgttatgagatcaaacaagttaatgcatataaagcaatcagattggtgctggcacatggtaagcactatattaatcagatcttcctttatttcctgtcctggttagtgataccattgttcaaccagctacccaaaccagaaatgtgacatttatcctaactcttccatatcactacatcagaaggagattcatcagaaggaggggcatcagaaggagattccacatcaaagcaatcattaaatcctgccatttgtcttctttccatctctaccattactgccttggacttgacatttattgtcttctttctgaatgacatacaccggctactgactagtgactcatcaccctgtctttgatctttctcttcttcaacgttttctatataatccccagtgattattctgaaatgcaaatctgatcacttaaaactctatagcgccttcctgttcccacagaaaatagacaaacacaaactaccagtaaagacctctgaggtctgttctggcttccttctgtagactcttctctgtctcattctgatctctctttaatgtttacagttctgtgatgttttgtgctactctggtcttccatgtcttcgtatatctgattttctgtggaatgcctcctacctcatatttcttctcagatattgtttctggcagctcctccaagcaggatagatattctttgctgtatgttgatactctaccttgggtggagcttaagcatagtacctgttatgcttattatagttatttatttgcatgttgtcctcctccaaggctgagcttgtttatttttgaataaattggctccatgaatcaacttctaggaaactatgagttatgcctcccatcttcagttaagggcagatgttaaacatttatttactgtacagattatctggttaacaatcatttacatctatattgaagaaaccatctctgtagttactttatttgctgccggggggaattttttttagttttcttgatacagctagtgtgttctttttcaggcttccaaagatcattcttttcctagtggagcaataactatatttcctggtaactcagttactggaagagccaataagaaatgtcatcaaggtggttcttaaactatagtgtgggaattgtactctatttttttgtctaggagtcaggaagccatgaaagagcattaacttactgcctgaagaccagctgttaacactgaagattaacgctttattgagatgggttgagagagaagaaaggcatttgatttgtagctgtcatgtggcatccagagggaagcactctctctgactgaaaatctgtacagttcaaccacaaataaggcatttgggcaatataacagaatcaatttaataacactgagtcttcaggttactttttgaaggtacattttgcaggaaaaatggcatacatattttctttttatatagatatattagaaaataaatttaaaaatatgtagtctaaatccaaagtaatgctaaaggaatagtcattatttttccagcatttatttaaaaaatgttttcccataaaacatgcttacaggttttcccataaaatatgcttacgggagaaaacctattgcacagaaaatgatacaattcaattggatggtggtgctcagtggctaatgaactattcaatattgttcgtgtcagtgctttggctccctgttgctgaaggcaggcataagtgctttccaaacccttgcaggtgatcaacaccaagaggatagttcaaatggggtctgtggctcctatctccaaattccattagcaaaatgttaaaatattgtatgtaggcacttagttttttaaggtaagcgaatactacaatatcagggaaaacacactgtggctgtgttatatcaaaaataatagtaacatttttccgtggtgcttgggttttaaaacggttggcgtttgttgcatttcttttgatccatacaacttgggccatagttagcattatctcagtttagaagtaaaagaaataggttcggagagaattttgcccattcagtggtagagctaatattcaaaggaaggttctgtgtttctcattcgaggactcatctcctgagctcacacagcaagagtgtgctgggcatatggttttcattttgctggaccatcagaaggagacatatctttaggatgttcagattaggtgctcattcttcagaagagagaaacttttctttagcactttgttgtacttcagagatgcctgtgaaacaggatagacttcgaaatagtaaaatttgattatcaaaatttttggcttttggtgagaatatatctgtcagtggtaggactggtgagagccatgaagggaactagtaactgtgagttaataagaagggggttggatactggaatctatttattactcttaatgcaaagttctgtttgcttaataaaaaaaatgtagagaaaaatgttagatgtatctgtgtatttttagtcaacacataattatttgctatttataatgtttgatacattctattttgctttaacaacattcacagggattgttactaaatctacatataaatatatggtcacaagcatgaattgaaacaggtctcagcatgaagatataaagtgactaaacctttttttcttctttcttctctctgtcctttcttctctgccttttttcttgaagaaaatattttattgacttgttaaatggcattattcaggccattcatcatttttccttggcattttatacatcctaaaatttcactcatggtcctcacggctcaaacagatgccctccagctctttttatttttatatcctgacttaaattttttttattattatactttaaagttctgggatacatatgcagaacatgcaggtttgttacataggtatacacatgccatggtggtttgctgcacccatcaacccgtcatctacattaggtatttctcctaatgctgtccctctcctggccccccaccctctgacaggccctggtgtgtgatgttcccctccctgtgttcatgtgttctcattgttcaactcccacttatgagtgagaacatgcggtgtttggttttctgttcttgtgttagtttcctgagaatgatggtttccagctttatccatgtccctgcaaaggacataaactcatccttttttatggctgaacagtattccatggtgccctccagctctttactctggagttttgcttttttccctccctgcattcattttgattctcaaattaacctgttcctttttggttaaaaataaaacaaacaaaacaaagtagatgctttgtttattttgattaaattttaaatgattgttgaagccatctaaactagcagttattctaatatagcgcatgaagaatattaaaagtgtatttagttatatgtatttaaatatattcaaaacatcattataaagagagtattgttctttctcttttctgaactccaatgtagtttatcttcccttctttaatggttttcatgactatgttttgttcccattaggttccgaactcctggtgtctacccagcatgagtccatgcccacagcatctccctagcacttcttaatttctcagtgaattttttttgatgaataaataatggtatttcagtcgcattttcaaaagcacatacaaatttgtaatttcactattttctattgtagtcatatacgttgacattctaaatgaactttggtccttgaagtcaatgagaaaagtcattaacttaaggttgttcagtactatttcctctgtcagaacacacagtagcacttgccaaataaattagttgtagtaggagaaatttggcttgattttatctttttgactctccattccaaactatcagtgcagctaaacacttgggttttggagcattctcactgtcctttgcctattttataagctgctgttcattgaaatcccatctgtgttgaagctctgttctgccaaatttcctacaaaactcatagcacgccacatgccattattgcccactgaattgttgagtaacatatcctgacttgaggccagtggttttcaaaccttggtgagcatcagaaacatctgggagcttgttaagagtacaaatgctgcatgccttcccctgaatatgatgaatctgtagcttcaggatgagtcctgggtgtctgtggttataatactttctgatgggcctggaaccacattttgagaaaaactgccactgagtgaaaagtttattttgaatggaattctgtgatgattcctctaaaagttgtgagacattctaaatgtgtttaaaaactgtgctataggtatgtttttgaattcttcgacattgcagaatcagcaataatttatgtggcattgcagatgtaatattatgtagtactatctttgctgcagttttattagcttagtgtttattaatatgtcatttaaaatatgatctttatcaaaacgtccatttatcaggaataagaacaaatggaatgagaacaaacaaaactcaatttgcaatgtttgttttctgctgttaatttctatagacaaaatacttatttctacttgatcccacattttatgtgtccttttttttagacaagagtctcactctgttgcacaggctggagtgcagtggtgcgacattggctcactgcaactctgcctcccaggctcaagcgatcctcccacctcagccttctgggtagctgggactagaggcccacgccaccacgtctggctggctagtttttgtagggtttttttttttctttttttttttgtagcgctgggtttttgctatgttgtccaggctggtcttgaactcctggactcaagcaattcaccagcctcagcctcccatagtgctgggattacaggtgtggaacactgtgcccggccttgtttccttttattggagaaaagtgtcagtatatttagaggatacaatctaatgtgcctttagtagtggtatatgatggtgctaatattgatcttgaggccaaagagcgtactgggttttttaattatcaaaaagagtttaagaattaatttcagtatcacatattttctttaatgctgattctctgaaaatcaaaattcattgataatacacagaaactaagggcaaacttttatcagtttcagctagatgaatgaatgacatattccagtgaagtcattatgataatgtacatggatttctgtgcaatataaggccctcctcctccttttttttaaatttgaaaatgcttcttttattaagatgggcctatcattgtttggataagcgatacattgaaaggttgggaattaggagaattgctgtggaacttggtttatgaatgtacaggtgataagaattccttcatgccttaatctgtatttcttactttttttagggactttctccctcgagggtcgggcattgtaacaagacgacctcttgtgctgcagcttgttacttctaaagcaggtaatgaatgaagatgtttaccgcatggatgggcacatcctgtggccccttttgccttcataggtgtgggattgtacaaatagaaacgtttttgtgatcgccccactgtgggcagctgcccacatttctctccagaatgctgccttcttcattgctcttttcattcctttgattacattaaaggggatattttcatagatttttttaaaatacctacttaaaaaaatgttttattgctcattgtaatccatctatataattttacagtacagcacaaccactaatactcctttggtatgctttgtgtgtgtgtgtgtgtgtgtgtgtgtgtgtgcgtatgtgtgcatgcacatgcacttggggattaactcataaaattcaacaaccatataatatctgtatggatgtgtatgtgcgtatctatatttacactgtgctatgcttccttctctctcttacatcatgataatttgataggtaaatgatgctttgtttttattttcattttatttcagcaactgatgatgttgaatttttttttcatgtttatttgccatttgtatttcttctctcgtgaattggccatttttctttttccccatttctttttggggattttactagttttcctatcaatttctttgaatgcttaagactgaagcacctcataaaaatcatctatcataaattgcaaatatttttaatagcttgttaaagatacagtttacataccatacaacttgaccaatagaagttaacagttgaatagattttagtcttttcacagatatgtgcaaccatctccacaatcagctttagaactgtttgatcactcccaaaagaaagcctgtatgtttctgctgtcacctcttttcataacacctttccccaccactccagcctaggcactactaacctatgttctgtctctatggatttccctattctggacatgtcatatgaatagaatcatttaatatgtggtcttttgtaataggcttttcttgcttggcataatcttttcaaggttcatccatgtcgtagcatgtattagaacttcatttctttttatggcctaataatattccattgtctggatagatcacattttgtttgtccattcgttaactgaggagcatttgagttgtttccaccctttggttattatgaatgatgttgctataaacattcatgtacatgtttctgtgtggacatgtgttttcatttctcttagaaatatacctgagtataattgctgggccatgtagtaactctctgtttaattgtttaaggaactgacagactgttttcaaagcagctgccccattttacattcctaccggcagtgtatgagggttacagtttttctatatccttgctaacccttgtgggtaagaagtgatatctcactgtggttttgacttgcgttttcctaatgactaaagatactgagcatcttttcatgtgcttaatgatcatttgtatatattatttagataaatgtgtattcatttcctttgcctagttttaaatttggttatttgcctttgtattactgaattgtaacagatatatattaaatacaagtcccatatcagatatttgatttgcattttttttttctattttataggcccttttcattttcttggcagtgtcctttgaagcacaagattttttattttggtgaagtccaatttatctacttttttctttcatttctcgttatttttgtatatatctaagaatcctttgccaaaaccaaggttataaaactttattctatgttttcttctaggagatttatagctttgatcttccacttaggtctttgatccattttttaaaattactaatttttaaattttaaatttcattttagatttggggataggtacaggtttgttatattgcataatgtgtaatgctgaggtttgggtttctagtgaaactatcacccaaatagtaaacgcagtccccaataggtagaatttcaaccttcacccctcttccactcttcccccttttggagttctttgcatctgtttttcccatctttatgtccatgtttacccactgtttagttcacacttgtaagtgtgaatgtgtggtattttatttcctatttctgttatttctcttagaataatggcctccagctcagtccatgttgctgtgaaggacatgatttcattcttttttatggctgcatagtattctatggtgtatgtgtcccctgttttctttatccagtcaactgttggtgggcttaggttgattccatgattttgctgttgtgaatagtgctgcagtaaacatacaagtataggtatctttttgaaataataatttcttttcctttgggtagctacccagtagtgggattgctgggtcaaatggtagttctatttttagtcctttgagaattctctatactgttttccataggggttaaactaatttacattcccaccaatagtttataagtgttcccttttctctgcagccctgccatcatgggttatttttgactttttaacaatagctgtatcagtctattttcacactgctatgaagaactgcccaagactgggtattttataaaagaaagaggtttcattgactcacagttcagcatggctggggaggtctcaggaaacttacaatcatggtggaaggcaaaggggaagcaaggcaccttcttcacaaggtggcaggaaggagaagagccaagcaaaggggaggagccccttaaaactatcagatctcatgagaactcactatcatgagaacagcatgggggaaactgccccccattaattacctccacctggtctctcccttgacatgtggggattgtgaagattatggggattacaattcaagatgagatttgggtggggacacaaagcctaaacatatcaatagccattctgactggtatgagatgatatcttattgtagttttgatccgtatttctctgatgattaatgatgttgagcattgttttcttatgtttgttggctgcttttatgtattcttttgagaattgtctgttcctgtcctttgcccacttttttttttccccctttttgagatggagtctcgctcttcttgcctaggctggagtgcagtggcgggatctcggctcgctgcaacctctgcctcctgggttcaagtgattctcttgcctcagcctcctgagtagctgggattacaggtgcccaccaccacgcccggctaattttttgtatttttagtagagacggggtttcaccatgttggccaggctggtcttgaactcctgacctcaggtgattcacccacctcggtctcccaaagtgttgggattacaggcatgagccaccatgcccggccctttgcccactttttttaaattctttttattttatttttatttttgagacagagtcttgctctgtcacccaggctggagtgcagtggtgcgatctcagctcactgcaagctccgcctcttgggttcatgccattctcctgcctcagcctcccgagtagctgggattgcaggtacccaccaccacacctggctaatttttttttgtatttttagtagagatggggtttcatcatgttagccaggatggtctcaatctcctgacctcgtgatctgcctgccttggcctcccaaagtgctgggattacaggtgtgagccaccgtgcctggcctttgcccactttttaatggggttatttgtttttttcttgttgatttgtttaaagttcttatagattctggatattagtcctttattggatgcatagtttgcaaaaattttctctcatcctgtagatcgtctgtttactctgttggtagtttcttttgcagtgcataatgtctttagtttagttaagtcccgtttgtctatttctgtttttgttgcattgcttttggggtcttagtgagaagtccttttcctaggctgatgtctggagaagtttttcctaggttttcttctagaatttttatagtttgaggacttacatttaagtctttaatccatcatgagttaatttttgtatatggtgagagataggggtccagttatattcttctgcatatggttaggcagttttcccaacaccatttattgagtaggatgttctttcctcattgtttttgttgactttgtggaagacgtgttggttgaaaatatgtggctttacttctgagttctctgttcttttacattgatctatgtgtctattttcatacaagtaccatgctgttttggttactatagccttgtatagtttagtatagagtagtttgaagttgggtaatgtgatgcctctggctttgttctttttgcttaggattgctttggctatttgggctctcttctggttccctattaattttagtattgttttttctaattctgtgaaagatgatgttggtaatttgataggaattgcatagaatctgtagattgctttgggcagtatagtcattttaaccatattgattcttccaatccatgagcatgggatgtttttccatttgtttgtgctttgatccattttgagttaataattttatgcactaagtgtcaaactttattttctgcatgtggatatccactagtcccagcacaatttgttgaaaagactattctttcctcactgtaggatcttggcccctttgtcaaaaatctgttgaccagagaaatacaggtttattttgggactctcagttcttttcgactgatatttatgtctatccttgggccaatagcatactctcttaattacccttgctttgtggtaagtttcaaattgagaattgcaagtccttctactttattttttttcaggattgttttggctatcctgggtctcttgaagttcaatatgaatttcagaatgagcttgttttatcccgggaatgtaagattggtttaacatctgaaaatcatatcagtggaatgaaaaaaaatcacagaattacctcaatagattcagaaaaagtatttgacaaaatctaacatgcattcatgataaaactcttagtaaataaaggggaaggaacttcctcaacctggtaaagggcttatatgaaaaccacatagctaccatcatacttaatggtgacagactggatgctttctgtctaaaatcagtaataatacaaggatgtctgctcttgtcactcttattcaacattgtacggtaggttctaaccaggacagctggggaaagaaagaaataaaaggcatctaccctggaaaggaagatgtaaaattatctctatttgaagatgatgtgatcacatgtatagaaaaacttaaagagtccactaaaaaactgttagaactactaaactatgttagcaagatttcaggatacactatcaatacacaacaatcagttgtattttttaaacttttattttaggtttgggggtgcatgtgaaggtttgtcgcataaataaacccatgtcatgggggtttgtggtacagattatttcatcatccaggttttaagtccagtaagcccagtgctcaagttatcttttctgctcctctccctcttcccactctccaccctcaagtagaccccagtgtctactttttccttctttgtgttcaaaaattatcatcatttagctcccacttataagtgagaaaatgcaatatttggttttctgttcctgcgttagtttgccaagggcaatatagcctccataaagacacacatatgtgaatgttcattgtagcactattcacaatagcagacatgaaatctacctaaatgcccacgaatgacagattagatttaaaaaaatatagtacatatacaccatggaatactatatggccttaaaaaagaacaagataatgtcttttgcaggaatatggagggagctggctatattgtccgttattgtaattcttagtttccttggattgggttttgccatcctcctgaatctcaatgatctttgtttgtgtccatattctgaattctatttctgtcatttcaaccagcctagcctggttaagaactcatgttggagaactggtgtgattgtttagaggacatataatactctggccatttgagttactggagttcttgctttggttctttctcatctctgcatgtgggtgttcctttaactacagtgtagattgaatacagttgatagacttcttttctggatgttttcagcaagccaaggctttgtgcagggttgttctttgaagctgacttcttatctctggcttcagggtggggtatgttagtgaggtatttttggtgttgaagctttggggtgtgatccagtaggtggcacttaggctaattaatcaattggtagacttttcctcagttatgtggctcccctatttttcctcacagttgcagctctgttccctctcaacactctgaaagggtgggttcttctccctcttgagtgctggctatagactgtggcttggcattcctgggcttctcactgccactctggtgtgatctcagtacttgtgttccctcctccacttggaggcagtggaggaagggaccttagtagtgattgtggccaagggtcttttgcttggttcctgggggctccaccccagagagatgcaggtcagcaattgcttagtgcaatcagcccagggtggagggtctgtgctatgggaccaagccaggggttccctgtctggtgatgagcactggagggtgtgtgggacccatgtgagacagtctggccttcctccttaggtcaactgcagcttgctggaggtgtgaataaggcacttaggatctttgcttcttcattagtctgagggtagcaagggtagttccactgcagaggcagtggcagagaggcttttagttgctcccggaggctttgtccagggaattgccaagctgctactggcttgattgctctggcgcagggtggctggaggaccttcccggtgaggagatatgggaatgggcacccatctaacagtctggctgctttttcatagagctcttgtggtatgcttggtgcctgctctggtccctagtcactttgaattttctagtacctggaggtatcaccagtgaaggctgcaaaacagccatgatggcggcctgcccctccctctgggagctccgtcccagggagttacagacctgttgccagcccaaacactgtaggaggtggctggagaccctggttgggacgtcccttccaggaaggaagaatgggattggagacctgcttagaaaagcggtctggctatgttttcatagagcagctgtgctctgttggggcatctgctttagcccctggttgcctcagacactccaaagcctgaaggctagaatggttatgttgcccaaacagcaaagatggcagcctgactttccctctgggagctctgtcccagggtggtttgaaacctgtgtcagccagagaacaccagtggggatagctagagaccctggttaggaagttgcacctggtggtgaggaacaggattgcggacacattttaaaaagcggtctggccatgtttttgtaggacagctgtgctgtgctgggggtcccttcagtccctggttgtcttggactttccaaagtttgaaggctggaacagcaaagtcacccaaacagagcattggtgaggatggctggagaccctggttgggaggtcctgcccagtaaggaggaaggggactggggacctgcttaaaaaagcagtctggccacatttttggagagtagctatgctgtgctgggggaccgcttccacccctagtcagcttggattctccaaagcccaaaggctggatggctaagttgcccaaacagcaaagatggcagcctggccctccctctaggagctccatcccagggaagtttcaagtctctgttggccagaaaacaccagctgaggtggcagaagaccccagttgggaggtcccgcctagtgaggaggagaaacagcattggggatcctcttaaaagagtggtctggccacattttcgtagagcagctgtgatgtgctgaaggacggcttttccccccagttggcttggactctccaaagctgaagtctggaatggctaagtcatccaaatagcaaagatggtggcccacccctccctctgggagctctgtcccagtgaggtttcaaatctctgtgggctggagaatacaggtgtgggtgtctgcaggctctggttgaaaggttccacctggtaaataggaacaggatcagggaccaggttgcttagaaaagcaacctggccacgtttttgtagaatagccatgctgtgctgggagatcccttctgcccctggtcagtttgaactctccaaagtctgaaggctggaatggcgaagtcaccccaacagcaaagatggtggcctgcccctccccgcagagctctatccagggaggtgcaatgctgctaccagtggctggctggatttccaagccagtgggtcatatcctgtgaggtgccgtggaattggggcctgcagacagtcacttctcagccccctggattcagcctctttcctagggttatgtatgggggtctatcctcctgctttgccatagttgcagctgcttttgttggaaagcctgggtatctaaggctcctggtctctgcatgtgcctgagtggctgctctgctgagattccacaaagctctgtgtgtcagactgaatgccgtggtggagtgggttcatgagggaatctcctgaactgagggttgcaaagatccgtgggagaagcatggatccctggggtccctcatttactcaccgcttccctgggtgggggatgttcctctggctctgtgttgatcccaggtgggccattgtcctgtcttagttttctccgttctccacgggtcaagttgtttccttgattagtcccagtgcaagtacttggatgtttcagttgagcgtgctgtatttacttgccccttctgtgcctctccatgagagccacacatgctagctgattctagtcggccatcttggccacctctcatcaattgtatttctatacatttgtgatgaacaatccaaaaacgaagttaagaaaataattcagtttataatagcatcaaaaagagtatatcgcttagggggaggtgtggtggctcacacctgttgtcctggcgcataagaaggtaaggccaggcattagagaccagcctgggcaacataggaagccctcatctgtataacaaaaagagtataccacttaggaatcaatttaacaaaagaaatgaaaaacttatgctatgaaaactataaattattgttgaaagaaattagagaagatctaaatatttggaaaaatattccatgctcaatgactggaagacgtaacagtgttaagatggcaatgccttaaaaactgatctacaaattcaatgcaatccctgtcataatcccagctgatatctggagaaatcatagatattttaaccatttttataatgttataaaatctgtattaagtttgattcaaaggacaggctcaagtcctgtcatttgaaaaaagtaaattatttgtaacactgtttgtggccctgaggatataaaagtgattaggacaaagtttctgtacttctggttatttatattctggatttattattttaaatatatagaagttttactctatggttatgaaatctgtacatttagatttttaaaaagtaaatatttagcacagtgctcttcactttcataggtaaaaaattttaaacatttctttactttatctgaaatttgttttcatgtatgcagaaacaattttttccccaattccctttatcttatattacagtgtggtaactactaccatctatttctgaatatctttctgttttattgtaccaattccacagtgttttacttttgtgggtttataatttgctttaaatatctcacctggcagggctgtagtcctctcccattactttttttaaatttaggggttctattataattgtgtggaaaagtctagaaaaattttgtaaagatgaaactattgccactagaattattttaaaccagtagatttactagggaataactgataccttaaaaatatttattatttttttaatccaaggaccataatgtatcttttccttccctccctccctcccttccttccttcctccctcccttcctccctccctccctctccctctccccatcccccaccctccctccattcctccctccctccctccctcccttcctcccttcttcccttcctcccttccttcctctctctttctctctttctttccttctttcctcatttttgagatagggtctcactctgttacccaggctggagtgcggtggcatgatcattgctcagtgtaacctccaactcctcagctaaagtgatcctgctgcctccacctcccaaatagctaggactacgggcatgcaccaccaggcaaggctaatttttaattttttttttgtagagatggggtcttgctatgttgctcaggctggtcttgaactcctaggctcaagtgatcttccgaaaacaatttacctgccttggcttctcaaagtgctgggattacaggcatgagccactgcactccccacccacctcctacctttttctttgtatttcttagtaaaaaaatttttcccttccctcacttcaggcatcctattaaaatttttgatggttttatatagtgttcatgcttttctagatagggtattcatctttattttttattgttcttttagtttaggttattttacagttatattttcaaactccttattgctgatcttaaaagccgttgcattttaaactttttaattaaccatcttattctacatttggtagattaaagcattttaaatttattctcttgggtattttagttatacagccatttcatttgcacttcttaatttattcagtaaatactcatcatgcaaatactggaatggctgagaaaagagacattgactagaatattaataagtttctttgcagtggggaccttttggtgagtatagacatgggaaaatattcttacatattgagctccttcaagaaggcctaacgtgcttctttcccataactttttgcctcgtgtcttctaagtccttgaccattccttctttttttttcctgttaatcagtgaggatcatagcacacatagcacctcacttttcaggcaaaatagactagaaattgtttcttcagggaagactttctgtctacagtctttcaggtacctcaaaatggggtttttgcattacagcactccactctggctggtgtcagctgaaaactgggctaatttattttcatcctaagtgaacttgttcatagagaaatctcatgtgaccgtagacttgggttgacggtgggctaataaaatgggggaaagaagcgatctggggtgtgtgttcactgctcatgcagtttgcttgtgccttcagatcttaattgggacataatataagtatgacttccttttgattcattcatttattcaacaaatatttattgaatgattactaggtgccaggcaaatattactgtcatcatggggcttacattctaggtggagagaaaccaacaatgaacaaaacaaatacacagaatgttaggtgataaagaaagtgagtgttcaagccacgctgatatttatgtaggcagaggtaagttagaaggttgtagatgggagcggcttatgtgtttgaagtttagaaaggaggcaagtggggctggaggtggatgagtgagacggggtggtaggaaatggggtaaagagagctactgttgctgcaacagcaagaaagctgattggggagggtcttgtgagccagggatgatgaaagggaacatgatagaaggattagcatctgaaagtgggggccactgactgtaagtaaaataaaggatagtgtgattgagatattggagagtgagctagggtaattcctttacacacaaggaggatgggaggacgcctcctctattgcaaccaaatggaaaaaggaaaatgtgggcagctgtggttatgtctgtacttttagcggtagagagttaagggattcttcatttactgactttattctctccaggaagtagaagataaagtatttgctgatagtaatcattttctcttctcatttccattagttctgtctctcattcctcttcaaagttttattactgttggctaggacttcagaacaatgcctttctcctagttgtgatgaaaatgccttttgtgttatactatgcatatattacttactgttcatttgtcctggtgaggaattattttattttagattttaaaaagattttaaagcataacaaataggtgtgtaattttcttgagtgccattttggcatctattgagatgatcacttaaaaaactcttggacatgtttacccttacatttatagatttcttatttaagcatccttgcattcctaagatatacttgattatagcaattaatacttttattgtactgttgaagtaattccactaatttatgttatttgcatttcattgtctctgtatacatttattattgtcaagttattgaatcaaagctatactagtcagcatagaataagttagtaactctccctctgcttctcttttactttcttctattagcttttgcaattcttaaaagcccagggatgcattttagtctctctttccaattaaggagcgctactagccttgttttttacaaagtgtatgtctttgactcagggcttcagaactagcagctgtggtaagagcttaggcaaggttagacctggggatgtggtggcacctgggtccggaggtgtgggatgtcaggacactcagggactattcaaaaccatgtggatactgagtgtccaatgcagtgactttgtcataaccctagaaagtcttataaagagattggcaggctcaggacagatactatgtgggaaactaaaatgatgagtagctaccattttttgagcataatcagcattatcagcactgcacattttgatgctattttcatttagtccttacaaaatcttctgggatagatattatgatttccttttagaataagagacccattttagaaaaagagacttaagcaatttatccaaagccgcactgttggtaggagtggggaattttactcgtatctgtatgatactgctaatattgcatttttaaaagagaaaactcctacggcttgcttttatatttgcagaatatattgtatattttatagtatatttttaatgtaaaggagaataaatatataaatattaaatattatttggttaattcagaattactatctaatttccaacacaatgcctatttagtaatatttaactgcttgtctccatctgctgttgtattagttgccaaaccgagccaaaaaattagaggccctaagccttattcggtgtaatttgttataggacatttagtacttagtacaggaaagcattccaggaaatcacgtagtattgtgagaaaggtgaggaaaatcatggcttcttttttattaataaaggtaaaaattttaagtgctaggtcaaggtaatttggtttcagagagggacatttctgaaggtgtggcttgggaggacaagagatgtacaaaacattgatgaggtcttgggtgatgactgcagtgtcatgagcaagggagcaggagagggtctttgtaagacaatgggacagtttcagtgcgttgtggcttcctccagcgccatgttgaaactggcttatgccagctcctaagatctgattgtgtgcctctctttccatgtccatattcagtgacatcatgatggtagctagaaattagtcatggttggagtatttacacttcagaaattggcaaatactacaaatcaaaactttttttttttttttttttttttttttgcctctagggagccagttgttaagcatttaccaggacaccactaattcctcctttctcaatacctgatcttactgtttactggttaagccatgtgtcaaactgagaaagcaaatgtgcctgagggtaatttgatgaactcctgagcacatttaacgtattacagtgttgctaatttaagaaacaatccatttggaatttgatatgccccctgaagaaggtgttttttttttttaagacaccagaatacaagtcactctttgcattaaaagttactgtaggctgggagcgatgggtcatacctataatcccagcactttgggaggccaaggtgggcaaattacttgaggtcagaagtttgagaccagcctggccaacatggtgaaaccccatctccactaaaaacacgaaacagccgggcatagtggcacatacagctacttgggaggctgaggcaggagactcacttgaacccgggaggcagaggttgcagtgagccaagcccaagatcacaccactacactccagcctaggtgacagagtgagactctgtctcaaaaaaagaaaagaaagaaagaaagttactgttggcgggttataacagtaaagtctctgggtcaaggttaaggacaaatggttttgtctcctggataatttttctgttaaaatatctctctaaatgctactatattgtttactctgctttatttcaatgacattagtataagaaaggaagatactaaaataagaaatcacaaagtaaataagttaagggtaactttaaattaccaaagtattctttcttttgtagaaggttttcttgctatttcttcctttcatggatgttaaatgtattattcatttaatttaccacctttatattgtatctattacataatgtaaagggtgtccatgttttaaaatttttacatgacttggaatttattagataattatcagtattgagtatttgggatccttggctggaattgctataaataattattttaataaagaaagatacccagtaacagaaatcagaaaacttgtttggaggcaccaagtaagcaatgatgaatcatcacattctgggagaggggctccacaatgggggtcatgtttagagcagccttagagcactgtgagtctaggcagactgagcaaaagggaagagatggattcctacaacaatactcaggagtcactaatatgagaacaatgtcaacttttcaccgatgagatattttaaggatgtttatagattagttagactttgtcttgatttctgtacaatgtcaaggacttgttctctagtttcataaattagactgatacatagcaaaaacattcaaatcttgttttgaataacaacattgaaaacactttaaaactacatttctcgctttgttttacatttaagtgtctgaatttaattaaaattgatattttagaataagataatctgcttttgcaaaggatttatgtttttttttttccattgtaacaaattaacctcatggtaataaatgtacttctgaaaacatttcttcttaaactacagctttgaccttgttctgcttcactgctggttccctattgctgctaaagtgcaggttacagaattcatagtttaaatctctttaatattgttattcttaaattttaatgtgcacaagatacactgggtgggcttcttatagatgcagactcctggacatcacccctgggaggtttgattcatgaagtctgaggtagggcccagagacctgctttatttacttatttatttatttgagacacggtctcactctgtcactcaggctggagtggagtggtgccatcatggctcactgcaaccttgatctcccaggctcaacctattatcctacctcagactccagagtagctgggaccacaggggtgtgccaccacatttagctaatttttctattttttgtacagagatgggtttcagcatgttgcccaggctgctctcaaactcctgggtttaagcaatcctcctgcttcaatcccagcaagcctcctaaagtgcttttggattacaggtatgagccacaatgcctggccagatctgcattttcaaggactagtatcagttgcttctaaagctgttggtctttgaatcacattttgagaaacactctcaacagtttcatcaaattctctcactattgttttctttctctagacacctttccttcttccttttaatagagtttttttttttttcttgaaatgagcaatcgttctttttatgattttctaaatgttcagtcatggcatctgtatagaagtctaagcacagtgctttgaacataaccaggcactcattcaatgttgaactgtgttctcttgccacctgggcatctagctcagacaccagcacccctggctgtggtgtttcaagacctttcactatcagaggttgaaattctaatagcatcaaggttttttttttgtttgttacataaccaacccaccttccaggcataaacagagataaaaactatcctactgaaatccctgtacaaacaagtggtgcatatacacttgtccctcggagcttggcatctcctccttgatttctgataagccaaggaatttccatggtccccatggagtgtcagacagttctcaagcacataattttaaatctggaaaatgtaactatcaaaataaattaaaatatattttgtggaggagttggataatgagaatgatgaattttctaaaaagtttgaggatcactggaatagaagtgttcaaaggcatttaccttttgggcagatgctttgtaatatttttccttgaatattggacacaatgtaataaataaatgaatctccaaagttcccagttggaaaaacatgcttattagatggagagagatgcagatacatcatacatatattaaggtcggacttggtccaaatattcccacatttgtaacctatttcattgagaggtcaaaatggttcactttctgaaatcttataagccttgtttttgaggggaaaaaaaggtagttggtgctatctgggactgtcattcagacctactttaaatcttatttgattgtgttttttcaggtcactgttcttttaatatttgcatagcttaatagattcaacttacctttattttatgcctggttattgggataccactgtgaattgctggttatgttaattttttcttccttttttttccttactgacaacaccccaaaacttatttttaacccactttcttttgttactttttttccttggcttaagcattgattacacatttattaatagacaaaatttctagtagtcaattatgtaccttccaatattgagatcaatttttgctcaattctcaaaattttgagaaaagcaactgatccaaattttatttcttcacagttaaatcactgccttttaacaccacatacatttccatttattagggaaattactaaatcaaaggtattatatttctctttgaagtaaatgaagaaataatatatttcagtagaattaccactcatgattgtgaggttaaagtgatttttgaattggtgtttatttgttctattttaggtttatttgtctcttgtctatttttggaggagatatggaggtttgtagctgccttgagtttccaaaccaacgattatacttctctgaacttagttccatttggtccatgtaatgtctactccagaattaatgtctgctaaaagagatcggatggaagaaagacaagttccttagttttaggacttttcttttttctattcccttcctcattcccatttagaaaaaataggttgtcttgaaatagttgatattgaagagaactaaaagacaaactgtagagttgttaatatctgtttaaatctgagaggaagaagtataatttttttaaagtaagaaaatgaatagacttgttttatatcacgcctgggtctatagttgataataattgttacttacctacgccttcttactcttattgcttccccttgggcctctaacaacagaaatcatagatcacagatgcccctgtatttgcatttgttagatgagttggagtagtctggaaggcattgtctctgtcttcccttcctcagggggcatgctttatccttcctgctgctacagcctgtcttcctccccatgatactcttattgatcagtagtcactgaccacgcagagaaggacaggttatttcatttattgctgaatgatatgatcagtgagtttaagaagttggttgttagggtgtctgaacagctaagaacagacgataattgggttattctgctgatttataagatggttttgtactcactctaggtgtttatttttcaaagtgaactaacttctcattaagtacttttcaaataattgtgttagtttaatattaacagtctcctgcaagcctggtggaatttttttctcattattttcccaaagtgtatttgtttcataaatttttatctttaagtttttgcattcatttattcattcatctcttcattaatggattttgaatgcctgcagtgtgctgcacaacagagaggttgccagtttgtgtcttgcagaccatgtttcagttgttttcctgttactctcatcttggctaatatttaaagagacctgagtttttctttttaacctctgcataattaaaacactggatgggattgtttccctcagttagcttcagtttttactgttacattacattgcaatttggggtgatgcaattctttacaagcactataaaaagttggacttagaaagaatgtatctctgtaaggcatgttgaaagcaacttgagagtctgttcttggaagagtctttaatctaaggcatatcaactacaatttccattttaaatgtctatttgcccttgtttctctcattccctatcaaaaccctttttcttgacatgtatatgatatacctgacttttcatcattgtactattttaacatttttatttttctgtgtacatgtctaccaatatttatattagataccatgtaggcatttcattgatcatgtactagtgcagaattcagaataaacataaatatatttaaatatgatactggcttattttgatttagaatgtaggtgtaatctttaaaaatggtctcaattgtttattattgtctaaattgttgtttgctttaaaataaaattttaaattattttgtatctgtgctattgagatcattaaacttgagtattcattaaaaaaactcatgaagaacacatacttaacaaatgtttattgattacctttcctcatgtgaaagctgcatttttttaggtttctgaaggataaacaaagctacacatatgacaaagtgcttacactaagcgggttatactatagtgtccaacaggtatggtgagcatatgttcaaattgaggatggctaggaaaaaaatttacaagacaaatacatggtggatttagcaaaggtggcttgggtatttattctcacctgttgggcactacagtataacccttttaatgcttagccaaatccttaaatacttcctggatactataatagcagagttacccacaggagtgatatgaagaaataatatgactgaggaaggtatacatactgcaactgtagagtgaggaagaatagtggaggtgaatgtttagaagtcaggcctggagaatactccccctcaggaaaagtcagccctcttcctctttgtgccgccccacttctggactgagatgtctaccatagagtccatcttggtgtgctattgactggtatatttgtgttcatcctaacaggatgtttgcttctcaagggcagagaccagtgtgtaaagcttaatatccttgttcatagtatccctactttatgggttcattgttttccccacatattaattaggaaagaaagtgaatttattgaatgaacccctaaccaaaccacacatatttcccatttctgtgtcagtgctatcattttctaattatgcccaacagcagtaacttgtaatatgtatataataaaactgagtttctgtggttaaaggaaaacactcagatatcaatacatataaacccatatgccttttttgcacaagggggtttgtgattaaggatgacatactaagatttatattttgctattttttatattggagggtgacttctttgcattttcggttataaaaatctgtttgtattttttgttcatatgtttgaattgaggatggctaggtaaatgattcacaagactagtacagagtggacttagcaaaggtggcttgggtatttattgagcaagctgttggggaaagatatttgatgtcttagatccagaatgtttttaaatgctgctcacttgatttttttttttttttttttttttatggaataagggatctgatactctttttctgcttggagtctggacctcagttactgctctctgagatactggcacagagttaagcctattccaaggaaccatatgttaagtcctagttataagttgctgaaatgaaagttgtagagatatacagcaaacttttatgtaaggaaataagcatatgcaaaactaatacatgtatttaaactaacacaacctcaaaggaataaaagaacgtaagtggtacaccagtgcaaagggaaataataggtgaatattagatgttaattgaaaatttcattcattcattcatttcacaaatatttattgggagcttctatgtaccagacacatattgaacgaagtgggcaattttgaatttatggggcaagacacgcaataaacaaaactaagtaaattatgtagtattttagataatgttaaatgctatggaaggcaaaaagtttagggtaagggaactgggagtactggattgcagttttatggagtttttgtatgtcactaagtcttcctggagctgaaagggtgatccaagtggctatcttgaggaagagtattccaggcagaagcaggagccagtgcaaggctgggtgcagtggctcatgcctccaatcccagcactttgggaagctgaggcaggaggactgcttgtgttcaggaggtttgagactagcctgggcaacatagtaagacttcatctctacaaacagtcaaaaattagccaggtgaggtggcatgcatctgtagtcccagctgctcaggaggctgaggtcaggggaccacttgagcctgggtggttgaggctgcagtgagctgtgatcctgccactgtactcagcctgagcaacagagtgaaacactgtctcaaaaaaaaataaaaataaaaaataaaaaaagaaaaagaaaaagcctgtgcaaagccctaaggtggacacatgcctggcttactgaggaaaagcagtgagactagtgtggcctgtagcataggaaattcttgtttttgtcaaccaaaaataaaattctaagcccaccaaccatttgaatagacccctcttcttggccaagggcattccaaagttaacctgagaaactagttcaggacatgatggggaggggtagggtagtcatgcctcattatacccacctccgttttggaattaccaatagaacagactctttaactctgataagaaatatttacaatctattatctctaaaacctgctacctggaggcttcatctacatgataaaaccttggtctccacaactcttaccttaacccagacattcctttctattaattctaagtttttagacaataacttaactctttcaatcaattgccaatggggaaatctttgaatctacctatgacctggaagccccctgcttccaattgtctcatttttctggaccaaaccaatctatatctgatatgtattaactgatgtcttatgtcctgaaattgtataaatcatgtgtagcctgaccaccttgggcacatgttttcaggatctcctgagggctgtgtcatggccattggtcactcatatttagctcagaataaatatcttcaaactttttatagtttgactctttttatcaactttttttatgtaatgggtgaggattagaatgtcttggctgattactagtctggctaagagggagtaatcatttcccctatgaatgtattattgatttttgatagaataaattcaataaagtatattttaagaaaaaaaaagttgtttgaaacaggggtcagcaatctatttctgtaaagggccagatattttaggctttgcaggacatagtgtctctgttgcagctactcaactctgctgttgtactgtgaaagcagccacagacaatatataaatgaatgggtctggctttgttccaataaacttaatggtctctgatatttgaatttcatacagtcttcacatgccaggaaacactattcttaaattttttttcagccatttaaaacaataaaaaccattcttagtttagagactgtacaaaaacagatatcagattgggttggatttagctcagaggccatattttgccaacttttaaacaatgtatttatttatttatttatttatttatttatttatttatttatttgtttatttatagatggggtctcactctgtcacccaggctggagtatagtggcgggatctcagctcactgcaacctctgcttcccaggctcaagctatcctcccactacccgctgcagtggctgggaccacaagcgtgtgccatcatgcccagctaattttctgtatttttggtagagacagagtttcaccatgctgcacaggctggtatcaaactcctgagctcagcgatccacctgccttggcttcccaaagtgctgggattacaggtgtgagccaccatgcccagcctcaattccttacttaaaatacaattaaatttttgttaattttcagatgatatagtactctatagtgcctaaggaatgttggtccaataatcacttattattgtacaatattggaaataagttgtcttggtgtgagttcatattaaagtgtttttttttgttttctttttttttggtgtttccttttttttttttttttttttttttttgaggcagggtctcactctgtcacccaggctagaatgcagtggcaaaatcacgtctcactgaagccttgaccttctgggctcaggtgatcctcctgcttcagcctcccaagtagctggaaccatgggaacacatcaccatgcctgactgatttttttttaaaaattattatttgtgaagggacctcgctgtgttgcccaggctggtctagaactcctgggctcaagtaatcctactgctttagcctcccaaagttttgggatcacaggtatgagctactgtgcctggcctatattaacgttttaatcctctatgagagtatcctacatcattgcatttttttttccaagaaaagaatgatgcaaaattagagaaaccaattatttgcatttttggttcacagggtttcatttaagagactattgtatagataatatatagcacagttatataaatgcatggatagtaaagagttcagaaacagaacagttaaccattggaaaaagtgttaaatccagtaagatgacaaattcaaatgtttcataaaggagaatttcagaaaatggatttttgcaattcacactttgttattgaagtcaacttcttaaaaatcttgtttagcaagtaattatgagatgttatttcaaaaattttaaatccattacatatcctcattcaacaatgaggaaatgggggaaatggaggaagttgaccgtagaagcagaggatgaacaggtagaagttgagttggtagtctaagaggttttttccttttttttggtttgaaaattactgaaaagtgtcttcctaaaatgatttttatttttatctcactcggaaacaagagacaagaggctaagattgggaataatggggattggcgtgggatgttggataacctacttcatatagggtgatcaaaaggactttctaaggaggtggcatttcaggtaagattctaaggattagcagtgatacatatggaaagtgggagagaatgttctaaacaggaggatttggtaagtgcaggaatcccacggtaaggcagtttagcatgctataggaaactaaagaagaccgacatggctggatcatagtgagaatgtaggagtgtggtgccttgcgcagctggagagacagggaggggaagatcttgcaagacctgcagttttaattttattctaattgcaatggaagtctctcaagagttttaagacaaggaccatcatattctgatttacattttaaaatttctttgtgcgtttcaaagaccatattgttaggaagcatttgttggggaggcaaaactttttctctgctctcttagttcagttacctggggcctgcaaatgaaactgacaaaagacagattagcaagaaaaaagatatttttattcatgtatgtactagagttcacagaaaaatgtgactcaaaggggtggttagaatttgggacttacctactatcttaatagggaaaggggagggacagaagggcacttactggaaagcagtcaacttttttggaagataggtgggcctttgggagaacatgggagatatgatagctttgtgacaatgtctattttggtgtggtgtggtatttggggagactggggagttgtgctaagctaatgctgattgacaggcattctttctctgcttatttgctgttggctagaagataaggtaattgtgaacttgtgataggcatgtgcttgaatattcctgtcttagtccatttgtgttgctgtaaaggaatgctgaggctggataatatataaaggaaagaggtttatttggctcatggttctgaaggctgtacaagaagcatggtgtcagcaactgcttctgatgagacccttagaaagcttccattcatggcagaaaatgaaggggagccagcatgtgcagaacatatgtcaagacaggaggcaagagagaaagagagaaaggaaagaaggatgaggctctttttaacaaccagctcttgggggaactctcatgggaactgatacagcgagaactcactcattactgccaggatagcaccaagccattcaggaggtatctgcttcatgacccaaacacctcccattaggccccacctccaacactggggatcagattttaacatgagacttggtgggaccaaacaaacgatatgcaaaccatagcaatgcccaatgctaggcagtttggtgaactgtccgttacatattcatttcaattggtgcagtggtgggattaccttgcagtgggagctatcagaagtgacacaagaggaacagggaacagatagctattcctttaatggcagcatggtggaaggcaggtggagtttgtgatttttgtgagtgggggttgggggctgtctttggactgaggcttcattttttccctttatgtctctagccttatcactagtttcaaaatgggtgtaataggacttgtgttgtctgccgtgctgttcttatgtgaatttcttacagcatgtatgtatgttggagaaaaggatgtgcattatccatcaaggcttctaatttgactaggcttagatattttttaaaaatgttactcatagtttaagtgttttaaatttcatcataacagcctgaaaaaatcagtatttctcagcaaatactggagctgttatatttgaatttacttttcaagagcttattaagaataatttcaggcatattaataacaataacttcccttaatatttatgtagaatttcagaatttctctaagttaagataataaactagctaaacaaagtaaatttgtttgctttggccccaccctgccatttctatatgtttttactctttgcgcatctcctctctcccaggcgcctggactttcatatcttcctagcaccttgaaagcctttgcaagagcatctgataagttcatttacactcagatacaagtaactgatacattttaaagtgtttaatatcgcaaaggtctttgaattttagcagagaaaatgagaggccgtatatgttacagagatcaatctctactagtggagttttctgttgggaaagtgagggggctttgcttttgcttttcttcttgtttgtttgcttttaatctgtaggggctttttcaagctcttaaaattacaccacctatgtggctacagctctgcttctacccagggttagcacctaatggtaattccatcttcagtaagttcggagtgctttataaattatttctgttctttaaagcactctacttgtagcaaacagacagcaattacatctgtttgacagctgatgaaacaaatacaacattttagagaagcaaaataacatttgaaagcacctggaaaggtgttaatgcattatacaaataaaaattttgattggtaaattgtttaagacctcacaatttaagcaggctcactaaatttttaatcaagatactaatgtataatggatagggaaagtaggaggagttaatactgaaatgttttaagaatgatccaggttaagaattctatttatttgagtgcccaagttaaaccatcatttttattttttaggtttttgggtgcttgagaatggaagggtgatattgtaaactgtcaaatggccaatgccaaggtgaaaatgtccacattatatagataagcttacacctgaatgagcttctcattaatgaccactttagagagaaaatggatggcagctcctcacgaataacttgggtaattgaaagaaatgctgccaaggaaaacaactactatgtgttactggttctactggaaccctgttaacatacttcctcaaacagtttcctgaaagagccaaattcctgaatggtaatctgaccaaaacactaaacaactcctgtggttaaaacagaatccacaggattctgttttcattagaggaagtactaaggtcaagatttgtaaactacaactaaattatgaaaatgattcttcttcctagtattcaggcactcaagagttctgaaaaaatgcagtgttatgtgacttcttcaattatgtaatttgtttagatagattgtttaggaagtgcctcattttatttgattctcatatgaaaaagaatattcttatctgttacaatttttttaaaagagaaaagcataaagttactaaaaaataaaatcttttcttatcatacagagacctcagaaatttatcattttcatgagataaatcacttccctattcatagactgttttaatatgggaaattgtcgattatattttaaatataagtaaaatattactaatttttgtaccattaacaaaaacatattactccaccaatacctacttctagtttaagctcagtatataaatagaaatgttaggcctgggttcttcctttgaggacaaggatcaagaatccaccaagggtagggtggggagtgtggaattgcaagtgcaggcataagaaggggtagcaaataaacacatgaaaagatactcaacatcagtagtcttgagggaaataaaaattaaaaccataaccaggtattattttgtgttcgtttgagacaggctctcctgctgtcagccaagctggagtgcagtaaaatgatcattgcttactgtagcctggacttcccaagcttgagcaatcctcccacctcagcctcctgaatatatgggaccacaggcacatgccagcatgcctggctaatgaaatttttttttttttttgtagagacaaggtcttgccatgttgccagggttggtcttgaactcctgggctcaagccgttctcctgtcttggtttcccaaagtgctgggattacaggagtgaaccactgcacctggcctcacaatgatgtattattatacacctattagtatgtctaaaattaaaaagactgaccatacaaagtgttgactaggatgcggaggaactggaactcttacacactgttggtgtcaaatgtaaaatggcacaaccactttggaaaagagttttgcactttctcaaaaagttacacatgtaccatatgacccagccaatccactccaaggtacagtatttacccaagagaaatggatgcatttgtcctcacaacaacttgaatacaaatagccagaaactggaaacaacacaaatgatcatcaacaagcgaatggacaaacatattgtggaacattcatgcaatggaatacaacttagcaataaaaaggaattatgtgctcaatggctgggggaacattcatacaatggaatacaacttagcaataaaaaggaattatgtgctcagtggctggggtgaatctcaaaataatgatgcagcgtgaaagaagccagaaaaaaaagagtatatatagtatgattctgcagatggtctccaacttacagggttcagcttaacaaattgttgactttatgatggtgtgaaagcaatatgcattcggtagaaactataatttaaatttttatcttttctggtctagtgatatgtggtaggatacttggcagtcagtcaaccatgagatcatgaggtaaacactgatattcttcagcatactgtgttactagatgattttgcccaattgtgcactaatgaaagtgttctgagtgcatttatagtaggctaggcttggtaggttcagcatattaaacgcacttttgacttaaaatattttcaacttatgatggatttattaggacataacttcattgtaagtcaggggcatctgtatttatataaaaatatagaaaatgcaaattaacctatagtgacacaaagcccattagtggtttttggtggaggatgggaaatggttctgtgaggaagaaggaattaccaaggagcatgattaaactttttggggtgatgaaaatgttctttaacttggttataatgatggtttctcaggggtacacacgtgtgtacttacaaattgttcactttaaatatgtgtactttattgtatatcaattataccacaataaagctatgaaaatatgtgtccatatgccatatcgctctaattttgtggcttaatcatatgcaaaaactcctcatcttcctcttcctcctcctcctccttctcctcctcttcctcctccattttttggatggggaaaggagggtgtgctgtgtcgtctggtcatgctttgatttctgttctctgggtttcccaaacacattaggtaataaagacaacatgactaattacatacatttttttaaaggctaaattctctttaagatattgtaaactctatttgcctcatatttgttcagtacttacttcaaataataaaacctggtggttgctttatcagttctaatgatcctggtgactgacattccctcctgttcttttacctaagacatgatgattactttgataaaacacacactttgatctcaaggtagggaagatgcaaatctcatattctgaactctccaaataaatgtaagacttggtgcctacttggttatcaagtgacaaaattattgaaataggagccaaactttgaaatattttacatgcggtgttttgcattatgaaagtttcgtttgtcatctacttgattttctcttctttaactgtgcttatgtttggcaaaaccattctcattctctaaagtttaggggtttatctaattgttttctctagtggtcaatgagcatcttgagagtgaagaccatgccttatttatgttgtattctaaacacctccttatagctcctgggaaatttataggcatttatataaatgctccttgaatgaatgaatgtgttcccccaacatccttactgaatactgaatttgggatcttgtgaaatcctactcagtttaagctttagtggaggtgttgacaaaaaactaagctctgtaaaacatttcaaaaggtttattatgagcccatattaatgactatagcgcaggaaacagcctcaagaagtcctgagaaagtgagcttaagtggttacagattggttttatacattttagggagatacaaattgtaggtaaaatcataaatcaatacatagcaggtgtacattggttcagcctaaaaaggaagaatatcttgaagtgagagttggggtgttacaggtcataggtagattcaaagattttgtgattggcaatcagttgaaagagttaagctttgtctgaagacctcaagtcagtggaaaaatattcttgaattaagataagggaggttgtggagaccaaggttcttgttatgtagatgaagcctccaggtaacagccttcagagagaagagatggcagatgtcttttttggggaccttaaaatgtcacacttttagttaatcctttcttaaacctgggaaaagcctggctgcattaatggagattatctgcaaatgcaaacttcctccataaaagatggctttgcaggaccatgtcaaaatatgtcaaagaaatatacttggagataaaacattttgattttctttaggatctgctatctgtcatgtgatgctacatgagtcaggttggaatttggtatcttattgccacaaagagtttgttttttcggtcttaatgatctctgttttaatggtaatgctggtcagtcagttgtgtctaaactctaagagggagggggtgtaacaagacatgtccaacctccctttccatcacggctgagaattcaaattttcaggtttctctggggttcccttggcccagaggggatccatttcaatcggttggggaggcttaggattttatttttgatttacaggggcaaatacagtagaagtttgtattccatgaaaatttaataacacaaaatttagtacatggaatttattataaatggaaagactagtacatttattggctattttgaagagagttattttgcaatatgaatcaatgaataacttatatcattgcttctttgcttctatagaaaccaaataactttctatgactgggacaggtagtacctctatgtttaaataactattttctcttagagtgttataatttgtatttctcatcattaatagaaccagttttactgccaacatgaataaaacactctcctttttacattattttattctctcaattcagagagttagttattatgtcatggcttttggtaagaaatgagtgataattctaggtatttccatgatagtcctttgttggaaggaaggacttcaaaactttaaaataatcaaatttcaactaaataaaaattgccatataagagatgatctgctaaggtatctagaggactaacatctatgccctcacactcatatctagttcttgcagatttatttctttcaaacatcatatgctagctgaatgtgatgcttgctatcgcctacttatcacaaactttgctgctatttttttcctttgtaattaaatgccatatgcacaccttcaattaagataattacatttatgattttagtttagtcaagtcatctggcacttttcatgatatcagttatctgacctttaaatagatgagaacttagggaagcatttagcatgccccatgcgcaattctttttttttttttttttttcctcccaagatagaatcttgctctgttgcccaggctggagtgcagtggcgtgatctcagcccagtgcaacttctgcctcccgggttcaagcaattctcctgcctcagcctcccgagtagctgggattacaggcacatgccatgatgcttggctaattttttgtatttttagtagagatggggtttcaccatattggccaggcttgtctcgaacttctgacctcaggtgatctacccgcctcagcctcccaaagtgctgggattacaggccaccatgcctgaccccaattctttattttatttacaatacatcattttctgacctcatttaaaaaattttaactgaaggatttctagtagacaggaaagttgccaagaaggtttagctttaaaagaaatgcctttataataaatggcatagaattcccattatgcttttgttttaatttgttgtaggaaagtatgggatgtgggatttagtttcctcaccgttgtggtcattgtcctttttcatatactccagtttgtcagtaaagctgttaaagcatgacatccaatactgcatgcaatccctgtgggctcaacctagcacataactcagagggactactgccccttctgttgtggacattaacctgcaattaactcagtcttagatcacattaattttggggccaggacactttattactggttcatagtgaacttgcagcccattgtaactgccaaattttttttcttttttgcactttgcctggatcctctattagcattgatttaagaacagtactttgcatgtattatcatagtaaatctcttttgctaaatttgactgatgattccagcctggtgagataattttgggtcctgattctcttttccaatttggttgcagtttctcctttgtggttataataagcttactatctaacctcgtccaaattcctgggggaaataatgcttgttagaagtgggtcaaggagtttctggaatagcatcttgttcttcctcacacattcttacccttctttaatttctggatgcaaagtatattgttccttgttgacaaaatggaaaatgaaatcctcttaagatagtaaagtggctgtcaactgtaatgctcttaaatcactttgctgcttagtgctctcacagctgatacgcagttccctctgtgggcagcggcgttttacatcagatcaccttccatttcaatttagcatgcctgctcactcctgcaaggggaggtttagtccttggtaacaagtctagaaaattctaaattacaccaaaggaaaacaccaccaggagatggaggatttttaatgaaaacatattttcacagtgtggcatttcaagtagaataactagaattgtggaaactggggcaacattgtgttatgcaatttttcctgagaaagctaaaaatatgttttcagcagagaattaatgaattgtagtgatttgatgctaagcagttctgttttaattaaaatatttaacttactaataaaatgtcagcacaatttgaaggtagagaagttctgttggaattaaattaatattctcctttttaaacacctggctcagcatgttaaaataaaatttgaagtacttctgtgggcagtactgctaagtgatagcaaccttctaccttgtagttctagctaggtgggctcttggctcttactctcttatgagtaagtgagttgctggataagtgttatcccttagccatagaatagttgccataagtttactgcttgcatggctgcattggctaaatgaactgcttaatggtaggaaagctatgcaccactgtactttagaaaatttgataaatgtgcacttataaaagataatacatttcatcatttcaaagagaatatgattccctaaaatatagttattttaacttttatggttacacaaaacaatgataaatcaactcacttttttccaatatattaagtgcactgtgtgtttccagctgtgtggcagatataagggcatcagagaggaatatgagatagttttggcccatagaccagaaggggagtcaaagacttaaatggtacaatgtggtcaataaaatgataaagctattatctatatctttatacatatccacacacatgaccatacatatttccattcccataactataaccatgtctattgtgggaatatggaggagagatacctgccctaataggtgagaggcataggtagcattaaaggaaaattttctgttgaagagatgcctaagttgaatcttaattagtagaagctaactgggctgtattagtctgttttcatgctgctgataaagacatacctgagactgggcaattgacaaaagatagaggtttaatggactcatagttccacatggctggggaggcctgacaatcatggcagaaggtgaaagtcatgtcttacgtggcagcagacaagaggagagaggttgtgcagggaaactcccctttataaaatgatcaatctcatgaggcttcttcactatcacgagaacagcatgagaaagatccgcccccataattcaattatctcccaccaggtccctcccatgacatgtgggagttgtgggagctacaattcaagatgagatttgggtggggacatagccaaacatatcattctgctcctggcccctcccaaatcccatgtcctcacatttcaaaaccaatcatgccttcccaacagtcccctaaagtcttaactcatgtcagcattaactcaaaagtccacagtcgaaagtctcatctgagacaaggcgagtcccttctgcctatgagcctgtaaaatcaaaagtaagttagttacttcctagatacaatgggggtacccactggataaatacacccattccaaatgggagaaattgaccaaaacaaggggataaaggccccatgcaagtctgaaatccagtggggcagtcaaatcttaaagctccaaaatgatctcctttgactccatgtctcacatccaggtcacactgatacaagtgggctcccatggccttgggtagctctgcccctgtggctttgtagggtatagcccccctcctggctgctttcatgggctggcattgggtgtctgtggcttttccaggtgcatagtgcaggctgtcggtggatctaccattctggggtctggtggatggtgaccctcttctcacagcttcactaggcagtgccccagtaagggactctgtgtgagggctctgactccacatttcccttccacactgccccagcagaggttctccatgagggccctgcccctgcagcaaacttctgcctgggcatccaggcatttccatacatcctctgaaatctagacagaggttcccaaacctcaattcttgacttctgtgcccccgcagactcaataccacatggaagctaccagggcttgggacttgcaccctcagaagcaacagcccaagccataccttgcccccttttaaccatgactggagtggctgggatatagggcaccaagtccctaggctgcacagagcagggggatcctgggcccacaaaagcattttttcctcttcagccttcacaactgtgatgggggttggggggctgctgtgaagacctctgaaatgccctgtaggcatttcccccactggcttggcaattaacattaggctccttgttatttatgtaaatctctacagcctgcttgaatttcttctcagaaaacgtgtttttcttttctttctttctttcttttttttttttttttgagacggagtctcgcactgtcacccaggctggagtgcagtggtgtgatctctgctcactgcaagctccacctcccaggttcacaccattctcctgcttcagcctcctgagtagctgggactacaggtgcccgccaccacactcggctaattttttgtatttttcagtagagacggagtttcaccatgttagctaggatggactcgatctcctgaccttgtgatctgcctgcctcagcctcccaaagtgctgggattacaggcgtgagccactatgcccggcccagtgtttttcttttctattgcatcatcaggctgcaaattttccaaacttttatgctctgtttcccttttaaaactgaatgcttttaatagcacccaagtcatctcttgaatgctttactgcttagaaatttctcccgccaggtaccctaaatcatctctctcaagttcaaagttccacagatctgtaggacagggacaaaatgctgccagtctctgctaaaacatagcaagagtcacctttactccagttcccaacaagttcctcacctccatctgagaccacctcagcctggatttcattgtctgcattttggtcaaagccattcaacaagtcgctaggaagttccaaactttcccacattttcctgtcttctgagccctccaaactgttctaacctctgcctgttacccagttccaaagttgctcccacatcttcaggtatctttatagcagtgccgcagtccaccggtaccaatttactgtattagtctgtcttcattttgctgataaagacatacccaaggctgggtaattgacaaaagaaagaggtttaatggactcatagttccacgtggctggggaggcctgacaactgtggcagaaggtgaaaggcacgtctcacatggcagcaaacaagagaagacagcatgttcagggaaactcccctttataaaaccatcagatctcatgagacttattcactatcacaagaacagcatgggaaagacctgtcctcatgattcaatgatctcccactgggtccctgccatgacatgtggcaattgtgggagttacaattcaagatgagatttgggtggggatgcagccaaaccatatcacaggttatgatgtgtgtgtatgtgtttgtacttgtatttttatgtgtatgtgtatgtatgtggaggcatctgtgtgtttgggagaacaaggaaaagggctgtgatgttcctgaaagtgagttggaacagaagcttggaagtgagaaacactgtgaggttgctggagtatatagtgtgtctgtgtgagtttaggttggagtgggatacacaaggagctcgtggacaaagggaatccatcaaaggtgttggagcaaggggatggtatagtcagctttacatgctgagtggattgctgtgattacaatgggcaggatagatggaacatggcaagatttggggtgtgactgtggagtaagctgtccagatgagaggtgatagaactaccctcacttggccttggtgatagtgatttggggagggggagatcaataaatttttagaaagtaatgtcagatagatatacctatcttatatatcttttgttacattcgtttctaagtaccacatagtttctgctaatgttgcaaatcatatttctaaaaaattatggttttgaattaattctcatggttgaatattatgtagcagtaaaactattgaactgcagccatgtgcatcaacagtaataagtctaggagcataatcttgagtgaataaagcaagtcccaaatgaatgacttcatttgtataaagcttaaaaacaaaactgaaaaatgtgttggttagagatgcacaggtatgtaataaaccaatatggaaaaggagataataaaataaaattaaaaatcatggttaattctcatggaggagaaggtgagagaatgaatacagaagggggaagtatatgggtgaatggaatggtattggacagttttgattcttatattagtggtgggttcatgggtgctggttttattattatttttcattatatatatatgtcaaatgtagtattttgtattatttgatatattaaaaagataataagggaaaaacagatacataagtagaaataagggcaagatatcctcaggtttctagcttgggttacgggatcagtgatgatatcaaataaatagagacaactagaggtttattcaggaacaatgatgagctaaggttcttgaagcacatctaaacagatggatatgcaagcctgcagcttgtgggggaaaatctaggctacatatgcagatttgtaagtcataaatatacagttgtctttcaaaccaaaaaatggataaaattgccccggaagaattaaaaacaacaacaacaaaagtgaaaagaaagtaatcctgggaagcaccagcattgaagtgtcaggagacagagaagtccataaagagaaggaaggggtcaaaagataggaggaaaagtgagtggcatcagggaggaagccaaggaggtaaagtgttatgaagggaggggtgattatcagtgttagatacaccaggccatttactacggtgaggtctggagttaggaggtttgtgctgaccttagcgaactctgtttcagagctgtggggacagaagccaactgaagtggggagaggggtctggggagccagacagcgggtactgtggagggggtagaggaatctttgtagaaatatgagtgttctggggtgaatagtgccctcccaaaattcaagttctttctcctggaacctcagtataggactctattcaaaaataggatctttgcaaatgtaattgggttaaaatcaggaatgaagactggattaggatgggttcaaatccaatgactgctgaacttataaaatgagaaaaatttggacacagacacactgagagaacacaatgtgataagaggcagagactggagtagtgcatccataagccaagccattgctgacaaccacctgaggctaagaatgacatggaacagatgcttccctagagcctttagatggccctgccaacacttcaacttaggcttctaggctataggactgtgaaataataaaatttatgttgtttaaagttaccccatttggcatactttgttatagcagccccaggaaacaaatataatgaatgataactagtgtgtgattaggtaaagagagggctccactttttataggatggatgagacttagtacatttgcagaacaagagaaagtggcagtgttgaaaggtgcggactttaagaggtgattggatcttgaaggctctgccatcatgaatggattaataccttcgtgggttagtggattaatgggttaattaatgggttattatgagggtggaactgatgatttcataagaagaggaagagaaacctgagcagatacattaggagagcagtaaaggataaagataagggagaaatagggaatgcttggtggagcacaatcctggcagtcccaagagccatgagctcaggggcccaggcagagttcatcggttttaaaatgaaaacagtgtactctgtgactggaagaaaaaaagcaggatggggtgaggtggtagttagattgtaggtaagagagcaggaagtaaggaagtgcatccttgatgacttcatttttcttagagataagttcttctgctgaggatgagggtaagggaggcagttgagttggaagtagtagtggaagtttggaatagttgttcaagaccagaaggctgaccagagactacctataattgacagttggcatccaggtctcagctgagtttggaaaccattgatttgtattaaagatgcactacactgttctgagatgtttccagacagcgctcagattcctgaggtttacagcaggaaaagtggctcctagagttgggattttataagatggatgcgatggagggatgttggtacaaggaagaagagaagaggatgttggtgagacaatgagctcatgaccagcagtgcactccagcctgggtagaaaggaagaggtagagggcggaaggacatgaaagactttatggtgacagtgacaagagcagccatgaggtcagctagaaacatacttttaatccatgtgtttttgacaaggtatggccattgtcatctgtgaacatttaatatcccatactgtactcagaactaaagtacaatagaaaataataagtgctgatgaggatgtggagaaattggaactcttatgcattattggtaggaatggaaattggtacagccattgcatgaaacagtttggtggtatctcaaaaagttaaacatacaattaactataatataatacagcaattctacttctgtgtatatactcaaaagattggaaagcgggggcccaaacagatatgtgcccaccaatgttcacagcagcattttttacaatagctaaacaattgaaacaaactgtgtccatccacagatgaatggataaacaaggtatgatacatacatacaatggaatattactcagccataaaaaggaatggaattctgacatttgctgcaacaggatgaacttgaaaacattatgctaagtaaaataagccagccacaaaaggacagtaccttggttcattatctgctgcctataatagaatacccaaaaatggataatttataaagaaaaggaatttatttttcacagttatggaggctgagaagtgtaagatcaagggattgcatctggtgaggaccttcttactggtgggggctctctgcagagtcctgaggtggcagagggtatcacatggttagggggaagagtttgctaatgtatttgctcaggtttcactttctcttcttatgaaaccattagtttcatcctcatggtaacccattagttaacccatgaatccattaatccaagaatgtaatcatcaatttatgaagacagagctttcaagatccaatcaactcttagaggctcctttcactgctaccgcagtagggattaagtgtctaacacattcagtttatagacacattcaaaccatatagacagatactatatgattccacctatatgaaatactgagaataggtaggtaaattcctagagacagaaaatagaatagaggttaccaggggttggaggaaaggcagaagagagaattattgtttaggagaacagagtttctgtaagcagtggtaatggtcactatcttagtcaatttgggctgctataacaaaatatcacagactgggtagcttaaacaacagacatttatttctcacggttctggagattaagatgctagctgattcggttcctggtgaggcccctctttctggcatacagatagccatcttcattccatgacctcatgtggtagagagaaagcaagagctataagaagagaccactataagaagattcatgagtactcccctctcctgatttcttctaaacctaattacctccccaagtcccctcctcccaatatgattacattaaaggttagggcttcaacacatgaattttggggagacacaaacattcagtctacaacagttacataaaactgtgaatgtacttaatgtcactgattgaacacctatcagaatggtgaaaacctaaaaactaacagtactaaatgctagcaaggatgtggagcagcaggaattctcatttgttgctggtgggaatgcaaaaacagtacagccactttggaagacagttcagcggtttcttaggaaactaaacatatccttaacatattatccagcatccttaccttgccatttactcaagtgcgatgaaaatttgtgtccctacagaaactggcacataaaggtttatcacagctgtattcataattgcccaaacttggaagcaaccaagatgtccttcagtatttactttatagtaaataaactatggtatacccggacaatggaatattgttgagtgctaaaaagaaatgagccttgaagagacatggagaaaacttaatgcatattactagtgaaaggtatcaatctgaaaaagctacatattgtatgattccaactatgtgacattcctgaaaagacaaaactggagaaagtaaaaagatcagtggttgcctggggttaggggagagggagagatgaataggtggatctcagaggatttttagggcaatgaaaatactctgtatgatactatatggtggatacaacatttgtcaaaacccatagaatatacaacaccaagagggacccctactgtaaactatggactttgggtgataatgatgtatcaatataagttcatctattgtaacaaatgtcccactctggtgatgcatgttgatattggggtaatgcatatgcaggggcaggaggtgggatatatgggaactctgtactttctggtcaatttctctgtgaacctaaagctgctctaaaaatggtcttttttttaaaaagtggtgaaaataattatattatctctatatagatattatatatattatctctatatagataacgtatatatatatataaaatcacagccaaaaaaaaatcctaagagattgttttcaaagctgtttaccatgtaaaccaaaaataaaattccaagccccccatccacctgaatggatgactctcttgtcaaaggcattcaaaaaacctgaaatactagttcaggccatgataggaatgggtggtcagaggtgtctcattatatattcctccccttgaaactcaggcacagctgaccagcattaacattagaacagaacccttaggctgacaaaacagaccatttttgcaataagataccaacatgacagttagcaggccctaaaataaatcaaagtattttaccccaaaatatatttctttgacatattttgaaatggccctgcaaagctgtctcctgtggggaaaatctacattctgtaaagaatgctgttccctttccaggtctttttcctgatccaggagagaattaagagtctggcacctttttaagtctgataagaaacatttacagtctattctctctgaagcctgctactggaggcttcacctacataataagaacctcggcctctacaacctcttatcataacccagaaactcccttctgttgattcctgtgtttagataaactttcaaccaattgccagtcaggaaatctttgaatccaccatatgagctggaagccaccccctccacccctgcctttccagaccaaaccaatgtacatcttacatgtaccgatggatgtcttatgactccctaaaatgcataaaaccaagctgcagcccaaccaccttgggcacatgttctcaggatctcctggggctgtgtcatgggcaatggtcacccatatttggctcagaataaatctcttaaaatattttacagagtttgactcttttcactggcaactttagtgagaataccttgattcatggtattctaccaaataattaaaaactatactttgtatttttgatagtattttagtttaagtataaccagaaagtcgaataaacaggacacaagaggggcgaaaaggctttgtctagcttggtcccctcagtgatttctcttccctgggaacctccgttgtggcacctttttttttttctcccaactgatggaaaactgtgtctctgcttatgacacttctaacactgaatgtgtggattttctaaccaagcagttttctcaattctctgtggacaccagctgggtgtcctacaatttaattcaattctgacactaactattcagttaacacagactccacaggttgatgtctcagtcccacaagactgtcccgagttcaaatgccaatctcaagtagtgagtccccaggtaatccacacttctgtgcaatttgactaggggttcacatgcaaattaagggttcacatgaccccttcctcagattcaataatttgctataacagctcatgtatttcagggaaacacttttgtttactggtttattaaaaaggatattgtaggctgggcatggtagctcatgtctgtaattccagcactttgggagtctgaggtgggtggattgcttgaggccaagagtttgagaccagcccatgcaacatggcaagaccctgtgtctacaaaaaaaaaaaaaatacacaaaaattagctgggcatggtgacatgtgtctgtagtcccagctacttgaaaggctgaggtaggaggattacctgagcctgaagaggttgaggctatagtgagccatgattgttccactgtaaagcctggacaacagagctagaccctgtctcaaaaaaaaaaaaaagggttgttgcgggggatggatattataaaggatacagatgaatagccagaagaagtacatggggcgaggtccagaagggtctgaagcatgagcgcttctgtccccatgtagttgaggcgtgtccccctcccagcaagtggatgcatttaacaatcttgaagctgtctgaaccccttcagtgagagtttttatggaggttcattatatagatgtgattgattaaatcattggccattggtgatctatattcagctcctctcccctccctggagattagggggtaggagtgagaattccaactttctagtcatgtagttggattctctggcaacaggggtcaatgaagaatccccccattagcgtaaacttaggtatggttgaaagggatttgttatgaataacaaacgatacttctgtcatccccatgactcaggaaattccaagagctttagaagctctgtgtcaggaaccatgggcagataccaaatatatatttcttcttatgttgcattcaccacttggtccatagagatactccctgttgaagtccccttgccctcccaggtggccctcccaaacaacacttaaatgtcttttgggcagcttcttttcccacgtggcccacatctgttctatgggaatttttcacatattctatcctttgccctgatggtgcccagtctactcccacaggcttgagctttctctggcctaagccaggcacagaagcttccctctccctcagctgcaggatctcaagctctctgaaaggtctctcactaagcatgagggcagaagaaggcatcttcctcacttgcccttcatgggcagagggtggggttcacagatctccacttctcctgatccttgtattattatattctcagaagtgttaagggggcttgtcatccaaaagaccaccaggatggctaaatagtagaaagaagagctttattagcaatagcagtttgcaaatcaggaagagagtctctggcatcgacccagggtattctccctttgaagtgggaaggtgcaggttggattttatgctccacagagttgtattacacaatagagtcatacacattcagaagtttgagagaaaagctatccatatttacaagaggagccaagtgcatatgcagtgggtaccatgtgtaacatacacactatgttcactttggggtggagtttcagcattaaaatgaggtggaatttggctctttaaatcaaagggcaaactataggacacaaagacagtttgtgtgtaacctctataacctggctgaaattggcttaaggtttgtagttgcttatcagagaaaaatgtttataaagccagccttctgttcagtcattgagtcgtagttttctgggttgtaaatcagagttaagagtggtcgaatagctcctattgttatggagtgtagcaagggtgtggtttttcttgtagccttaggaatttaggaagttgtcatgccagctgagccctgaaccctagacctgtaggtaacttttgtttccttaaccttagggtttgtcttagttgacaaaagggaatctattttggtctctcagatcacaggcctaagaggtaaaaaatcagttctgagtcattttttatgtcaattctacatatggtggcagtctcatacttacagatttccactggaactaaaacacttttcatgaagatgtgacttggtatggtgaagtgagctctggaccagtggtgaaatgacctgacttcttgtatttctaccattttttagtttgtgactttataaagaaattactttgttggggtgtagaaaacaattccccaaaatctagcttgttgacatgctgagtgctttgaaaatgaaaaggccttagaaataggcctcagaaccaaggttctgactttcctctgtctctctcatcctccttattttcccaagaagaagagggggagagattctgtctggaatttccttatctaagaaagtgtatttcacaaagaagtgcagttgttttaagagcacgctccctagaaatctcatcaaatatccaggaaaaatcaaccttcagagaaacagaagggattgggaatcgtcaccaagtcactatgcccagacagacttttcatctgttcttctgagtgcaattccaagaaattaactggggaaatttatttgcataataagacaacctttgttctgtgcagttctgtccaccccttaccttcccataacttgttccatccagctttcaaagacaatcatttacaaaataatatataccttacaggtccttatgtctctcctctgtgaagagagatttgaagcctcaatcatctggaccctctttgagtctcatactttgtatattgcttctgtgtttatgcaaattaaattttgtatgcctttttctcctactaaactgccttttgtcagcttatttttagcaaaccttcagtgggcacagaggaagccttccctctgccactacaacttaatctctttgatgatcactttccataaaatggttttgaagattgaatgagatagagcaaatgaagatgctttgaatgtatacatgtgctaaacacacggaaaatgctctgttgtgagttcaaagtactttctctgctattgaggcttctaatcagtatgattctgtgatgacagaaactcaaaagcttacctttttttttcttctgatactgaaaacttccatcttgtcaaaagacaaaattacaacaaatttagcttaaagatcttaactggcttttatttgtgattctagaatcaggcaactcctcattttacaaaatagaatgagtgttcccaatgaattgagcagaggttggtttaatagacagaaatggaccaagaaggcagaaacggaaaaccaaaaaaggctgggttgtttcaaggttacttttcttgcaaaggttaaagcagaggggacttcattatcatgccagctagcactggcttgtttggaaatttggctattatctctctcctgatatcatggaaggttagagaaataacttagtgttggcttggtggtgtggaacttcagcttgagtgaccccattttggcttggtatgtgttgggcttagtgcaggagctcagtccaaaccgatggcctcctataacggtcttaaggaattattatagttggagcgaaagtccagtcttctgtcccatttgcttactaagctatactaagggaaaaaaaatgggactaaatttaaatattgtttttaattttctgttggaacaaatgagtgattgctatataaaggtgcatttcaagtaccaaatgcaaaattatgctattgttgtgttcttcaagtgtgaactttagtggttacagctgaaactcgtagagatgtctcagattctgccttcaattggcttatttagctttgatggaaaaacactttatttcttagaaaagctataataactgttatcattattttaataatgacatttacacgagctttagcatgtacatgctttctgggcacttgtctaagtgttttccaaatgtggggagagaaaggaggtgatccctttgctcctcatcataaaggtcatggctgacactcctataaaaaaatgacaggttaacaagagaaaagcataatgatttattaatgtgtataagcatgggaaccataaaaaataggaaaactcaaagaagggccacatggttgatgctaaagtaccctcttcactgggttaagagaagtagaggtgtaggagtaattggtttttagggggaatgaatgagcacaaagaacaatgataaatcatagtcaggatgaagttcctgtgagctctgagggaggcagtgggaacacgaggggctgaacttcactgtgaacaaaagttgtcttattatgcagatagcatctcccaggtaatctctggagctgccctaacaatagatgagaagtctgtctggacatggtgatgactcctagtctcttcattgggattcctagaaacggggggtcttaaaataattgcatttctttgataaagaagctttcttggtcatataaaggaaattctagaaagggtctctcccaatgtgcttcagcaaaaaaagattaaagaaacagataggcaagtgaaggccagagagagaccttggggctgcttctttagttcagcatgtcaaaacaccgtattttgaggtattgctctctgggccctaataaatatatggtcttatctaatcctcacaacaatcctaggaggtaggtgacactatccccattttacatagaggaaactgaggcacagagaagttacagtttacccagaacagtcagggttgtttggagtattaacatgaaataatgtgtgtgactaaaagcttggtgtgtagtacagcagattctcagtcatttttaatttactctaagggtcaagagttagtaaatatagaagtccatgtgactttggggctttcattgggcaaaaccacaagttttggcggaaacagataaagataagcacttattcttatttggcatagatagttccttccttctgcatcctactgctattttcattttatcgatggaatactttgaagcacgaaaaatcattatatcttgaaataatttttaaaataatccaataacaaactcagaactactgaagaataataaaggtaagacaatacatattaaacattttaagggtaacatttttgggaaattgactttttttagctttatggaatattattatcattattatcatgatcattattatttccattctacataggaagaaattgaagcacagagaagttacaggttagccaggagaatacctattttccagaacttttgtggggtattaacagtacttaatatgtgttaatttacatactaacttaggtaacaagcgtgtgttaagaataagtatataaaatgtgtttttggattcaaattttattttaaatgtgatagatagaaatatttttgctaagatatataattatcctccaaattatttttaggatgagtatgaattttcatatgcaatgcagttccatcttatgtaagcgctgtattctaaaattagcttttaaatcaaatatagggtatagtaagaatcatcattaggaccactgagctcaatattgtatatatgatgttgtgtatacaactaacattccttctaactttttactggtcactgtttttcaatgggtctcaattggatttttttaaaatttcttctttcaggatgttaacaaagaagaatcaagtagctattatcagaattcagttttgttttctgtggaaatctctttccctaacaggttataacaatccagtggtgtgcttgtcaaatttcagcattacctttatgttgaacatttaaaaaaataataacagtagcctacattttaaatatacttagtatgaaatgggcattgtattaaattctttctgtgcattatcttatttaacatttaaccacaaagaggaatgcattctatctcttacacttcttcataaatgctttatgctttcacttgttaatttcacacatttttatttttaaaaatttggtatgtgttcttatttgcccagccgtatatctcctatttccttttgttttttctctttggtgcttttgttaatcacttgtttatagttttaaatattctcttttctcctcttggttttttcccaattatatgaagtctcctaagtctaattcagattctaccctttctataaatcctttacagatcactctaccctaaaaagacctctccctttgtgaaatctacatagcattcatttgacaattattcattaagctgcttatcttgaaattttatttaaatcttttgcttaattttcacaagtttgtcttcttttccaactttggtaagttcttcaattatgaaatatagcttaacactttgtttccctatagtagtagttctttaattctttaatgagtagcagattttcatatggccagaaaacgccactcccaattgaaaggatatattacagaatggaaaataatctgaactttgtaacctaagaagcaaaatagtctgaattctgcaacctaagaagcacaatgtgtaattgaaggcttgctaaaaaaacaaaaacaaaaacaaaaaacccagaaaaccttatcacaaaagccaacacaggttttgggaaattgaaaatataatattttcatggtattaagcttcatacgaaaatgaagtccagacagcaacaacatactcttgagagtcttatcctgagttagtctctataactgattagaccagaaggggaggagatggctcataaaaagatctgcttctaaaaggaaagtctgagagattttgctctagagtgttggttcatactgaacgaggaaaagaacactggaagttctaaaatgctgaaagaggtattcaagacctcatagtctttgaaaaacagcaaatagtagttcagttttgacttggaatcattcattcatttattcttgtaatcatttctgtatccttaaggaatgttaaatcaaagatgtagaagacatagtcctactctctaagcactttctttgtagcactggagataaaacacaaacaactagttactacgctgtggaaggcgtaatacatgttatatgaatattcttgaacgtgttacttagccttctgggatttagtttctttatctgtaaagagcaagcactggctttggtagaaaatctttaaggctgtttctacatgcaaaatcacgtaagtagtacattcacaagatcttgaaaagctttagaggagaaacacattccttatagtggagagatcaagggaagtttcttagtggaaatgatatttgaagagggccttgttaggttgttttgataggcatatactataatagtgataaaaccagttattgagtgtttgctgtgcagaaggcagtatgcgaggcactttaaatacagattcctaggcttggcgcagtggcttatgcctgtaatcccagcactttgagaggccgaggtgggcggatcacctgagatcgggaggttgagtccagcctgaccaacatggagaaaccctgtctctactgaaaatacaaaatcagccgggcgtggtggcgcatgcctctaattccagctacttgggaggatgaggcaggagaatcgcttgaactcgggaggtggaagttgcagtgggctgagatcgcaccattgcactccagcctgggcaacaagagcaaaactccatctcaaaaacaaacaaaaaacaaaaacaacaacaacaacaacaacaaaaaccccagattcctgtggggaagagggtggagcagagttctctctcaataccctgaagttatttgcacaattctgtgtatatgtaagttagtacatttttatggggaaagtttccgtggcttttctcagatgcttaaagtagtcataaccccagaaacaagaaccgcagtataaagagtaggagatatgattcctatattttgggaaatgcccatatgtagggggcgggggaggagggatagtggtgctggtggaaagaatgaacagttgataacaaagaagatgttaaaagctaagaattggaatcaaagcctcttggaggggagagcttgaagtagtgacacacagttaatgtggggtggctaacagattgtaactgggagtcagaatgtctggatttaaatctttgactggcatctcctacctgtgtaacctcaggcaatttgtttaacctctttgaggctaaggcttttgctatttagattaattgttacatatttactcaattctttttttttaattaagggtttactatgtgttaaatgccttcattcatatattctttgatacagtatgaatttgttgagaccctatacctagttactgggagaattttggtgaatgaagcagaagaattcattctcttgccctcactgaaacctatgaaagagacactattttgcagtggagggaactgaggcttggggaagttaagtaatttctcagtcttgtgataaagaaattgcagacccttcaaacatgggtctgactccaaaatctttttttttttttttttgatacaagatctccctctgtcacccaggctggggcataatcttggcttactgcagcctcaacctccagggctcaagtgatgctcccacctcagccttccaaatagttgggtctacaggcatgtgccattatgcctggctaattttttggatttttggtagagacgggatttcaccatgttgcccaggctagtcttgaactcctgagctcacgtgatcctcccgccttggcctcctaacgtgctaagattataggcatgagccaccactcgtcgcccaaagtcttaatcactagtgtttttgttttttttttaatcactagtgttttttacttcagaatactgtaggcatggctgactcttgtgaggttaacaagaagaaacttactttatttcaggagtaatttacatataaactcaaaggttgagagagggatgctgcagatattttggatagacttctaaatttatgaaactactaagtattattaaataatgcagtatttcaaatcagtttttcatatgatgacacaatcagatcactgagtagtcactacactgttattgaaattgcagttttcattgtgatctatattattcatattaaggaccctctaaaatgagtgcacttgcttttcaagtaagatagtttttttctcatatatttttcatgactgtctatttttccactcccataattttatctattttgcaaaagaaattgattacttttcatatttaagtcccttttgaggggctctctcttttgagggtggttgtccttgtgagagagttttccattaagttcccattgagaaaattagtgactatcatagctaagtattaatttacatacaaattgagttaaagaaaaccataatacaaagttttggatccgaactttagtttgttttctttataggtgcatttctgttagcatcatttaaactgactgcataatgcattaggttttactgagtgctggctattcttgtaagaatcctctgggattaaaaacaaaaattatctaagggaaacttctaaatattttaagtttatcccaatttagataatttatacactagttgacctgttccattaattgagttttcttcatactaaggacaacctttggttcttcttttttctcctcctccttctccccctcttcttcttctactgtttttttttttgagttggggtcttggtctgtcacccaggctggagttaaaggctcactgcacccttgaactcctggactcaagcaatcctcctgtctcagtttaccgaatagctaaagactgcacgtgcatgccaccatgcctagctaatgaaaaaaagattttttttttttaagagggagtcttgctatattgcccatgctggtcttgacctcctggcctcaagtgatcctcatgtcttggcctcccaaagcagtaggattataggcatgagctactgcacctggccattgttttgctttttaaaaaactttcaagaaatgattgggttgactctattgcctgagtcatagaattatttctaccatttctaagcaaaagcgtcttatcagatgaattggctcggcattttagttttatataaccaattgtcatatgtccaagaatttccatgatatttacaagacaaaatctttatttttatttgtttagaccttttaatgtaagaatatgtactcttattaccaagttatactgtactgactaggtcgatgttgcttgggacatcattgataataaatatttttgtaggaccccaaacaatacttaagtgacttctctattagtaaagcgtttagaatagatatcactccaagttataagaatctgtgattttgttaaagtttaatacgtttatcagagcaagcatcatgggaacatacttgtgcttttagcaaaacatgttgtggttatatatgtgcaagcttgagccagaagaggaaaatttttctgaatgatgttacaatgttgcagataaagattcaaaagatagattgttttgtagaaactgacaagctgattctaaaatttatatgaaaataaaagaacccagaatagccaaaacaactttgaaaaataacattgaggttggagaattaacattatctgatctcgagacttattatacaggttccacggtttgtgcctgtaatcctagccagcagagagactgcttgagcccaggagttcaggctgtacagtgctataattgtgcctgtgaataaccattgcacttcagcctgggcaacttagcaagaccctatctcttaaaatgagggcttataaagttacaataatcaataatatggcattggcataaagagacaaatagatcaatggaacaggatggattcaaaaaatggatctacacatatgtagacaatggattttagacaaaggtacaaaggcaattcagtggagaaatggtagtctttccaacaaaggttactggaaaaaaatagatatttacatgcaaaaaataaactttgattaataccttccaccatacacaaaaattaagttggctgtttccagctgctaacaactttcaggaatttgtcatgatgactgttctcatactgctagtaaagacatactggagattgggtaatttataaaagaaagaggcttaactgacttacagttccacatggctgaagaggcctcacactcatggtggaaggtgaatgaggagaaaagtcacatcttatatggcggcaggcaagagaacatgtgcaggggaactcccttttataaaaccatcagctcttgtgagacttattcactatcatgagaacagaataggaaagacccacctccatgattcaattacctcccactgggtccctcccatgacatgtgggaattatgggagctacaattcaagatgagatttgggtggggacacagccaaaccatatcattgacatttaaggagcttaccaaaaacacactaaagatctccttcaaatatttagatgaaataatgttggcggcaacttgtgtataaaattacatactcatagaaaaagttttttgtggttttttgagatattataatgtatccagcaatgcatattgtagctctgatattttctttaaaaattttttagttacgtatttatatacttagagttctgatacaactactacttaaatctcatttataaattttgttccttgtggccaagattctgtggggaaacagtattttcattttgtaaatcttagactttctattgtatttttttgtattgaaatctgattatttgaattttcatgacaaagtctcatcattttgcttttaattactctatagatttttatttggcagatcatcttatttttcattattaaaacaaggactgacatttgctgtctcagaattagtacattcaattattcttaaaaaacattggaataactccttattcagaaactctttttgatattttcagtttctaaacttagctgattatcaagaggaagcaaaaaagagccttgagtacccaactgatatcacaaagtctttgatgtaaatctcatgcattacagggtcccagccttattctggcctttccagccttattttaaactcagaccatgcatactgggttattggatttctcagtctagagtaaaatataaaaccacaagtgagaatgggaatatggcttaaaaacagatgtgttgcgaacagcaagaagtgacaactgtaaacttgatagcaagggaagagacacaaggggagaaaaaaagcataaaatagcacataaaacactttttaagtaaacaaagtaatctatagccccaaatcattgaaataataaaaagtgtttaaattttctatccaattggaattagatagaaattgagcatctactatacggtttcctacatccttataattaacttaccttgccctttcaacagcttttgacatcaattctttcttgaaatttactctatgtctttggcttatatgaaaaatattcctggttttccttctatctctttgtttactctttcaggctcccttgccaatgcattatcttctatctggcctttaaggttgcatctgcccaaggctcctttttggttgtcatttcatattcttcttttgacaatctcttccacacggtggcttcaattacaacctgaacattacaactctcacatgtatagttcctgggctaaactccagactcatttttaactgactgtttgaaactctacttggatatttcaaatgtatttcaagctcagcatgtcaaaagccatatttataatcattttttttcccttatccacaaacctcaagcctcctccaaggtttatttgttgattccttcagtcatctactcattcatttatttattcatcaattctacaaatatgcaactggtttagttactggaaatacagcaggggtaagacagataatgctcctgttctcatggtgcttatatgccagtggatgaagacagacaataaaaaacaaatacgaaaaacttcagacagtgaccatgtgcaccgaagaaaaaaactgggcaatgtaataggatgtgattaagagatgctacttactttgtccagtcagggaaacctctctaaagagatgatattttggatgaggaaatgacaggaaggagccacacatgcagagatcagagggacaaacattccagaagaggtgcagcttatagagaggccctgaggtaggaagggacttggtgctcttgagctgcagaagggaggccattgcaagcagagcgactgagtaggtaggatggaggtagtgatagagatggcactggaggcagatgggtggcagactgtatcggactttgtagagtaggccagggtgaggaatctggatttttctaaatgtactggaaaaccaataaaaggctttaaacaggggagaagcatgatgtgatgtatgttttaaggagatctttccagctactgggtggagaatggattcaatggagcaagagtggagtcagaaagaccagttaggctacttttatggtagtacaggttagaggtggagcaggcttagaagtagcatggccatagtggaggcagtgagacggtgtttggaagagagctgaggaaaggaagctttgaacaggtatattttgagatatctattagacatctgagtggaaatgtcagttaagcattagaattagatatagacaaatctggaattcaagggagaggtgaatgtctgagatgtgaatttagaggatatatatataaaattttaaggcaatgagattagatgagatcacttagagagagaggatagagatgaaaaagagggtaagaaggtctagaaacaagtctggtgtactccaatatttagaagtgtagaagagaagggaaggaacagtcagcaaagaaccatggagaaagagcaatcagtgaagatggagaacaatcagaagagtgtttcagggaagaggaggacaatcgtgtcagatgctgccaagacatagaataattataataattatatagtttgcaacttttggccaagtgctcagaatgcttctttcctgttttctgtatttggaatatagtttatcttttataaaaaaattttgtgggtacatagtaggtagatataccctaaagaaaggaaatgagtatattgaagagatatctgcactgccatgtttgttgtagcatggttcacaatagctaagatttggaatatagtttatctcttgattgtgttttacgtggaaataaactatgagtataaaatagagttgatttttgttatactctttgagctcctttggaaaaaaatatagaactaagttgagctatgtaggtatcaacagctgctggattctgattgttgttttggatacttgtggtagaatattctgtaaaagtcccccatctctgggtatttctgtaagtgctggccttggtcttgtccaccagcactattccagttacctggggccccttaaccttcacctcttggctaagccttatccaggctttagaagcagaagaaaactgtaaaggctattgttcagcagtaaatttcaagatggcattaatattaatctctcttgaccctgaatactgttcaactggcttcggctttgtatcttgacaaaacagctctgccttccattccatgactgaatttgcatcttggttttctgcctagtttgcatttggagttttgttttaatttcctactttgccttgagagtaccagagccctgatcttaaaccctggtctctgtctccggtctgatacctgcttggcaccagctttttgtcttttatgaaatcttggcaccctccacttactcccatctcaccctattgttcttaactctcctactgagacctctaacttttacccactgcaggactccctgaggttaattgttttcttctttagatttccttttttttttttttgattgctagactttccctgtttattttagcaatacagttgagttctgttttatatctgggtcctatgtaattaatatataactaaactaaaattctaggatcttgccttcaatttggaatgacttgatgggagcatttagaaattactatttttaattaacacataataattgtacatatttatggagtacagtatgatatttcagtatatatataccatgtgtaatgatcaaattagggtagtcagcatatccatcacttcagacatttagcatttcttagtgttgggaacattcaaaatcctctcatctagctatttgaaaatatacaatttattattcttaactgtagttccccttcagtgctacagaactctggaagttactactcctatctagctgtacttttgtatctgctccccaacctctccctatctcctttgcctcccaacacttctcagtctctagtaaccactattctactctctaattctatgagatcaacttttttagctttcatatgtgagtaagaacatggagtatttattggaagcattgttatatccaaagtattctgctttaaagaagaaagaaatctacagatttttttttttttttttttttgagacagagtctcactctgtcactcaggctggagtgcagtgacatgatctaggctcactgcaacctccacgtctcagattcaggtgattctcctgcctcagcctcctgagtagctgggataacaggcacctgctatcacacctggctaatttttgtatttttcatagagacagggtgtcaccaagttggccagtctggtctcgaactcctgacctcaggtgatccacccgcctcagcctcagtggtgggattataggcgtgagccaccgtgcccggcctacagatgttctttactctaaatataataggcattagggaaacacagaagagtaaaatgtatctctgcctttgaggaaatatgtttttaaatatagtcatacatagatgctttatacagccagtgaattcagcttgttgcactgaagacagtcccttatgtatatgacccctgtactctgttttcactggagccctgtgctcacaaaacattgctattaaaacatttcagaaataagaaaactccagttaaaattttgaggaaccttgattcttagaataaagatggacaagagatcattttttcctagtgctctataataattcctttctacttaaccttgattaattaagacatatacatatttttactcatggaaggggcatattggaaatatttaaattcttacagtcatgctgtgcttttcacagatgattggaacattgcccaggcataaatgcatctcatccttcccccaaacagtttgtcagttgtttaacctagcataatttgtttttcatgaccagtaaaaatgacagtgctaaaatgttttaaaaggaaataaaaataaaatagaattatagctctgattttttaaatattctccttttttccttcctaatcattctttgatatagtaatgtatcttaacctttgcttcaattgtaggctatttttaacattgtaaaaacagaaaataatcaaaactaggagttttattttgtgaaaatgaaaacagagaaattttattttgtgaaaatgaaataaatttcaataagacaggttatactgcgacaaaataaaatttcacggatgcgttatcacggtttcaatgcttatgtacacataaccttcatcctttgtatgactttgtggctaggagatttaatgcactgactactcacattgatgctgggctgaagcctcaagttgtttgaggaaaagaccatttcatgtgcccaactatgaagcatttagaatgaaaggaatactgagaacatgtcaagagagctcatgccactggaaattgtacctttctgtaagaaagaatgtatctcaaaactataagatgagattgtgtaaccttcagacatgttagttcaccatagtataaaaccgtggtaaactatggtatactatggtttaccatagtatactatagtagaagacacacatttagcagctattaaaagatccagctattgatcagctagtacaactcgttctatagagtttgacttagatgctagaatttccttcatccccaaactacaattatcatcatagagacaagaggacacagatctatgagtctctggagctaggtagaagacagattacaggtagccctttcctgaaaagccaggtcagcttgttttgctgaattttccatcctgtaggttgaattcttttccaggaggctctttggtttccgtagaaaaaagtactttgtggttcctgccctatcggttttccagataggctgggcaggtctgaaccccagtgatggacatagattagacccaaattgtcatccctgctgtgattactctgaggtcactcatttaggatcactttttgcatgcatgtgtgtgtttgtgtgtgtgtgtgtgtgtgtataatgcattttgtatttatacagtattatagtagtatataaactgtataatagtacttatacagtttaaccagtgagatggttaaatggttaacaagtaaaccacatagttaaccagtaaagatgtaaaatgacttcagacaaatatgatcaatctctacagtcccctgatgaatttcacaggttcccaccaccatcagttctacctattcatctcatccatgctcattgttctgcctctttcctgttcctatggatgccctggcatgtttgtttctttctttctggcctcctatttccctcccctcagacatcacttcagcatctgtgccttctcacttcccttatcctgggtgttaccatttcagcctatgagcatgccattaatttgccatctttacaaaattctctcttgacttcacatccctctgtagctgccctctcccttctctcctcttctttacaacaaaactccttaaaagaactgttggctgggcacagtggttcactcctataatcccagcactttcagaagccaaggtgggaacatcacttgaggccaagaggtcgagaccagcccaggcaacacagtgagacctcatcactacaaaaaataaataaaaattagccagatgtggtggcacactgcctgtagtcccagctactcaggaggctagggtgggaggatcacttgagcccaggaggttgaggctgccttaaacctcctcctgaaggatcctcaagttgccaaattctaagatccattcttagtcctcatgttactggacatgttggcagggtttgatggacgtctcctcttttcttggctttgttttccccttactgttttctcctaccttctaagtctccatctcctgacctctaaactttggaaaacccagggcctggtactctgacctcttccctgtctaactcttgcttagtgatctcatcacttacctgacttgaatgactaccaaatatatatctctcacttggacttctccatgaacaaaagatgcatatatctagccgtgaagatatttttgtacaaattagaaaaagctgccctttcctcaagcacatgactgccatcttctggaaatttttcagagtagagacacctatccaaagactgaatatgaatggtgtctccttcagctgtgtggtcctcaaccttagtagcagtgctttttctcaacttggatgggtgtgtcatggccatcacaagcttagtaggtcccaacccacatcccatcccatcccatcccttctcatcctcttcccttcagtctttttctatttcaaactttttctggtggcttaggtcaaaccctttgaagttatccttgatgcttctctttctctcatatcgcagcttaaatccatcagcaaattctgttgctttttctttcaaaatacattagaatttaaccactcatcaccaccccactgttgccaccctggtctaagcctcagcagctctccccgggatgatttcaatagtaagcttcctttcttgctcatcattgtctgtcctcaacacagcatccacagttgtttcaaacctaggtcacagcatgtttctactctaccccaaatccttcagatggtctgccatctcactcagcgaaaaatcaaagtccttaaaatggtccacgggccctccacatccaggcctgtccacagcactggccttgtttcccacctccctcccctccacaccgcccggtgctccagccacgtggacctggctgtccctcaacatgccgaacacacatctgctttaggcactctgcccggatgcccttccatacagcatggcctgctgccttcctttcttgagtcattgctcaaaggtcactttaccctgtcatggaagccttccttatctataccacataaccaagcaacccctttcccagagcatttgctatccccctgctattttattttctccatagcacttagcatcacacacacacatattgtttactcttttacctgattagaatttaagcttcgtgagcctagagacttattttccccccttaattatatcccaatttctaaaacagttcttggcaagtagagtgatctcaataaatattaatcaaataaataaatgaatacaggaatccttgaatctgtctgggggacactattctcaacaagacactgcaaattgaccaaggggttgacaaaataaataaaaatacacaaaggtttgagatggtcctgaacaattatcatctcttgattccaagataaaagtattttcaagagtttgagaactcatttaaatctaatttgaaaattgcattgattttacacccttccggaagggcatgtttcctgcagagaaagcaagtaggtgccatctagtggcaacaaaggagatccacatttgtgttaactggaatgtatcgattagcagtgattgaaaatgtagttcctgatccagaagcttatgaactctatgacagaacagttgtgatagccataagtcttgaagggtgcattttccatggaatatatggcattgaaaaaaacacagttccatttcttctaaattatttctaatttttccttttaatttttgcttgttttctgggatttgacttcttttgttcttttgtttttcgtattgttttgtcctctacttatctatatactcttacattcacatggtactggcctaggctttgaatgggtaataaaataaaggctctatcttctgggaatttatattctaataaagacagtgcctatgagggtaagtatagaagaacatgccttatcttgatgaactgatctcttcaggccagatttctgcagcctgttgaggctttactgttggatatacttccagcattagaggaatgagctttcgggagacttagcttgctgtttttcagaaagtggcacattatatggagaaactaagatagaaagagaaatactcatgtccatgcatgttgtcaggaaagacagaaattaaatccgtctctgattctcattctaacatccaaaaagctaggtcatttcaattctttggtaaattaaagtagaaactttttggtccactttgggagcttgtgacctttccagccagagtggctggggttggtactgggaaatctttgccaccagagggcctgagtggtgatgtgacaaagcaagataagggtgtgaggcccaggaaggagacaaacttagggtgctgacactcacattaatgcacacggccttttcacagctgagtagcaccagaggacaaaagttggactagtggaatatgacaagaaagcaggtttcataccaaacataaatattttccaatcagagctttttccaatgagatcaaagtttctgttacccaatagtggatgggtccgagcagagactggatgacaacctgccagatttgttgaacctatgaaggttctctgattctctggaagacctctttctccctgcacatgtaaaaatcctccctactgttcagtattcagtccataccccacttccttttttgggtaccacagcttaaaatcatcttttctatctctacctttcttatcattttaagagcaggttagcatttacattatgctacctgcattaatgttttttctcagtggtctaatccttagctttttgagttaatgctaacctgcttgaagacacggaccacatctgagctaagtgacaaatgattctgtattgttatcttttagcattgaaggtgtatgtaagactcttttatcctttccacacagtgttaaatctaacccttgttgatctacctgcagtaactaaagtgcccgtgggagatcagccacaatagctctcttgctattgaccttgccatttcatcttcaagagtgaatattaaatgtttatgatgggtaatggtagtaaagctaccaataattgccacatctggctttttttttttttttgagatggggtctcactttcttgcccaggctggagtgcagtggcatgatcacagctcactgcagcctcgacctcacaggctcttatctggcatttgggtccaagatgcttaggcatagtctaagtttagttgtacaattcttcattgagatattagataaactaaaatctttgtggagatttgtttctttgttagatttatactcatttaaaaaatctaatagtactgtactagcttttcttttaaattgtggtgttttttacatacctgatttctctcaaagtaggtacagaaattgataatacaccagcttgtaggatgttactgaaaatttaaaaacccagttttgttatttatgtagttattttagtgtttttccctctgctgagggatttttttaaaattttacattacaggtaaatatttgctttgatataatactctataacttttttccttgagaaattgtctttgtataagttgatgtggtattttcaatagtgtgtttttaagctaaaggattccatatattatttatttttaacaaattaaatgatttcccttaacttattttgccttctgaagatatatttatataacttggcattccatcctgatgaaatggtgatactgaagaggggaatgctaacagaactcagaggtatcccagatctaatgtctttaacaatcaggtgctgttgtttgctttatcatttggatagccaaaattttctttaaattatttaataggctagatggtttagggactggttttagtatttaattgcttatctgaaaattggcaaatttagcatctatagcatttgtactatgtttaatatttctaaagtattaattgtgattcttagtaactactgtgttctgtgggatgttcatgaaggaagaagagagaatattggatactttgacttataattaaagaaacttttataattatggcaaaaatgcatgaatttaagttgtgtcattttggttttatttttgtagaatatgccgagtttctacattgcaaaggaaagaaatttacagattttgatgaagttcgccttgagattgaagcagaaacagatcgcgtgactggaatgaataaaggcatttcctccatacccattaatttacgagtctattccccacacggtaagtaaaataataaaattccaaattcttctcctcaaacatttatactacattaattaacatacatcatttgtacagaagatacaaatagtgctgggtttctagggtatcctttggatactgcccattaatgttatggttcaaagagctcttaagacatttaaggagaggcagtaggagatgactttaataaaaacagaattgagttagtcatcaaattttttcttcatttttattataagcttttagaatttgagaagggtatatatgaaaacttccatttttcagtctttgctgaaatcttagaggtacatgttactatggttgcatcttcccctattggatgtcttgcagccatatatagtcctatttattttcttcctgagaaatcagctctgactttttcccccagactatcggtagaaacttataaattagataaccaatccataatgtgtgatgggaaataacctgtatgctgactaaatttttagtgggcaaattttcatttcttattccctacttagctctattgcttttaaaacagaatataaatgacataagctcaattatgacttcccaagggtacttggtgccaacattgtttatatggagaggttgggctagagtcatgttgtcactgactctgtttgtacagctgattcagtaaacccagggcaccacgaatggctaacagctttctactaggctaagtggttaactttctattaaaaaaaaaaaatgatactttttaaggaaagggcagtcttaccctgtgagtttttataccacttgaaggcaatgtataagactggcagatagcatatgcatttctcatttggtgttttaattataaccccctagttacagatatgacagctttctgagcaaactgttaggcatgcaaatcagtgcctttcaaattatgttaaagtgatcatttggcatagcacaatcatatcataaaaatagagaaaactagcaaaaccatttttattttatgctctttattctacacacatgggttggagttgttcagatacacaaagtagaaggctgagctaagtgacaaatgattctgtattgttatcttttagcattgaaggtgtatgtaagactcctttatcctttccacacagtgttaaatctaacccttattgatctacctggaataactaaagtgcctgtgggagatcagccaccagatatcgagtatcagatcagagaaatgattatgcagttcatcacgagggagaactgtctgattttagctgttactccagccaacactgatcttgcaaactcagatgcgctgaagctagctaaagaagttgatcctcaaggtgagtgtgtgactactaagatgagaaggaattaaagtgtcaggagttttggtatctttaaaggtaacataaattcttaagatttggtttcattataaataaattagccattattaatgttgttaaaccttttgtattttaaatagaaaattcagtatttaatattaaaaaataataaataattttagtaaagatttactaaaataatgaaatttatatagtcaaaatctatataaatctaagaataatgagatctaagaaaacaggcatttctaagcctcatgggctgcatattttaaaaagttggtaaaataaacttctggtacagcagaattcagacaatctactaattattatgagttacctgcatatgcttccagtgaaaaacctttgtgttttttactttgtcttgtttctttaaaataggaagctctaatgcatgtaagatattatttagcttataattatttgagaaaaaatgtacgtataagcagggatttatttggtattgtcatctcaatatccagaaaaggtcctttcttatgcgtatgtttaaactttttacttctctaagttgaataacgacagtttatcttcagagacctcagtgctggccttggtgtgtgtctgtttaaagtgattgtggaagggcattcaatgatgtgccctttcaatatggagatacatgttcttcagttctaggaatttttcttttttgataattaattgtcccaatttctttgttctttttatctgtagttcttattagcatgttagaactcctaaatgaatcctttatttcaatctttctcttctataatcatttctttgtctttttgttctactttctgcaagattttatcaactttatcttctgctcttctgattcattttagaggttccaaaagcatatttttactttgtgaatcttatttttattttttaaaatagcatcatgttcttgttttcataaatacaatatcttcctccaaggactttagtgagagctttttgaaggttttcttttgtaatctacattgtctgaatctattgttttctgattgtttgtttttgtctctgtctttgatgttagagacctttttcaaatgtttgtcgatcttttgccgcttgttcgtgcatgagagtggagcaccaaaaagctgatttatgtacatgacagggattcattgaccagtgggttttcccatggagtaactgtgctgagagttgaccattttgttaggagacttcctcaactgttaggttctatgagtattttctcctgagctggtctggtataagcctgatgtctagtgttcttggagccaagaattggtgggtcaggggatggagtgggaggaggatggttctcactattcagtgtgtacacttttaattaattcctctgctttcatgatggcattcctgaaattcttctggagtccagagtccctctggttcaacctcttttgaagcaagtcttcagtactctgctgaggttgaggaagggtagctatgtgggtgtgtcctctaggagccttcagccaattcttttattttcagctcttcctataccctagcattggttctccaattcttaggcctttccagaattctgcaatggtaactgtttttttcttcttggtttcctccaccatccctgaaactggggcttgtaacaagcaggtagaggctccagatgacaagtaaggaccatcaccaggactccctttacagcgtcagtggcttggaagagtcagattataaactgggactggaatctagttataaaaatggtgctgaaccattcctgtcttacagccttctttcccataggagattgagccatggttgtctgattgggacagagagagtcataccatcagtgaattctagtgagttcagcccagtcacattcctgaggagtccacacgtagtccacgtagaaaaaacaaactcagcttctcctactatattctcaaacacgcttctgactccagatgtgtggtgatttctccctactgcaaacaagcaattaattcttttctgcagcagacatcagctaggtatcctctgattaaattttattctgatactatttacctggaaatagcatcagatcacactgattgagggttcagtcccacaagatgacccccacttctgatgccagttacaagatccaggttgtttaccctgtgctctgactgactggctataaattggggtttctacaaccttcttcttgtgttctattaatttgctagaggggctcacaaaactcggagaaacagttctttgttataaagaatattacaagggatacagatgaagagatgcatagggcaatgtatgagaagcgatgtggagcttccatgttctctccgggcacaccatcctctagaaacctctgcatctccagctatccagaagctctccaaacccagcccattttggatttttatggaagcttcattatgtaggcatgattgattaaatcattagctattggtgatcaacttaaacttcagcccctcatccctcctaggaggtcatatctgttctttctagtgaccagtccacttgctgaagctatccaggagctgccagccacttaccaacccattagcctgcaaaaagatacttatcactttgaagattccaaggactttagtagttgtgtgctggggaatagggaagaagactaaaaatgcgtaccgcaatatgacaatccagatgaagcttcatggaggactgcaaatgataccattcagtccctgatttctctttcgtcctaccttggttcagcctctttgaaattgtttcttttttaagataaattcttttcaagggtgacaagatggctatagatatcctgtctcacatcctcacaacttccaatctagtagaagaaaagccattggagaatattttatttgtgtgtattatgaattttataataaatgtaaactaaaaaaattggccaactaataaatcttgtaaagtgatttcttaaaattggtttaacatattcatgctatattttacccctgttgtgcacatagggaatattaatgggcagtaactacatctcatttctcaggcttttcagaagaagattcatttatgacctaaaataaactcatgtgatcacagatcattaggtgagagcaatgaatgtttgtggagggagtcatcagtttgccagaaaggaatcaatatccacaaagtcattcccagtatattcgatgtgttgttatagcgtaaggaaaatatagcattgactgtcagtcaggagtatgtcattttatgccacaaatctactccagaaagttaaatgagattaaaaaaaaactatcataggcttggcttatttacaaactcatttttattaggtgccacttagaaattgtcatgtaaatgttcatgaacttacctaaaataaatctccttttttgtggatcattagaactgctgctccaccatttacagacctacttgcccccagtttttatatcctatatatggtggtcccaagaggagacttttgaaagttttggtaggagtcattactgatgagatagaatttatgtgtgctattttgccattctttttgtgtatgtcctatgtctttttgtttctctatttctctgctactatctccttttgtgttaaatatttattttctagtatataattttaattccttggtcatttattttacttttttgttattttcttagtggttgccataggattacaattaacatcttaatttatagcaatctagtttggatcaataccaacttaatttcaataatacacagcattttgctcctatatagctccactccctccccttcctatgtgctattattgtcatacaaatcacaacttttacattacatgcctatcaacacagaaatataattatagctttatatgattatcttttaaatcagatatgagaaaaaagagttacaaacaaaaatacatttatattgtctattatatttaactatgtagttaactttactggtgttcttcagtttttcctgggtatttgagttactgtccagtgtccttttttttctgcctgaaaggctctcattagtatttcttgtaggctatgtctgtcagtaagggattctcttggtttttgtttatcttggaatgtcttaatttctccttaaattttgaaggataatttttacttaaagtttttttcctttcatcaatttgagtatgtcatcccactaccatctgacctccatggtcaaaattcagctgtcaatctcattgaggatcctttgaacatgattttcttctctcctgctgctttcaagattcttttttttttttttttgtcttttggcagtttgattatgatatctgtaggtacagatcttgttgagtttatcctacttggagtttgttgaccttcttggatgtgtagattaatgctttttaagtcaaatttgataaattttcagccattatttcttcaactattctttcttcctctttctctcctcttctctttctgagaatcacattatgtgtatgttggtatgtatgttggtaagatgttttcaccaatctctgagactttgttcatgtttcttcattctttcttttgtctttcttttccttagactgggaggaacaatctcaattgatctgtcttcaagtttgctgattctttctgcctgttcagatctgctattaaatctctatagtgaatttttttatttcagttattttatctccagattttctatttggttcttttaaaaaaaaatttctgtctccttactgatattctgtatttggtgaaacattattctcatacattctttttgttctttagattattatttttttttagtttttaaaacatatttaaaatagatgatttaaagcctttgtctagtaatttcaatttctgggattgttcagggacagtttctattgactgtatattttcttttgggtgggccatactttctttgcatatcttaaaatttttttgttgaaaattagatatttaaataatgtgatgtggcagcactagaaaccagattcctctctcccttccagtttttgttgctgtttattgttgctgcaggtgctatttatttggttactaattttcatgaaccaattctgcaagtctatattctttgtcgtgtgtggccacttaagtctttgctcagcatttttttttagtggtcaggacagggatcttcttaaatactagagtcagtaaatcgctaaacatttaccaaagctctcaatgtgcattttggggtatggcttcaatgctcaggcagacagtttacaactctgccttaatcctaacttcctgcttatgcagagctcaaggtgagctagaggtgagaatttaggatcttctgaggtctttgctgtgtttgcacaaaaccccaaacatgcatgtggctttctagattctaggttgtacatatatacaaaattttcaatggcctttgtggccatctcattcccaagttttccttttaagttttttggttagttttttctttctttctttttttttttgccccaattgttattgctccctgagacctgtgatgttgaacaattgccactgattatttttgacaaattttttctggggaaagaggcttttcacactgaataagctctgagtcaggtcaagtaaagaaaagccctgtgaatgggggtttttagggaactgctagacaggttaaatagttacaattgtctgaaaattgtatttttgatgctctccaaccccattctgtcccctccaggggtttctagggttctgattttcatcatgactgtggtgtttttgttttcaaggctactgtagagatgagagggggatgggcatagggcaagttcaaacaccatacggcttgttgttcttactgaaatccaggtttttttttttttttttttttttttgagatggagtttttgctcttgctgcccaggctggagtgcaatggcacagtctcggctcactgcaacctctgcctcctgggttcaagtgattctcctgcctcatcctcccaagtagctgggattacaggcatgtgccaccacatccagctaattttttgcatttagtggagacagggtttcaccatgttgctcaggctggtcttgtactcctgacctcaagagatccacccacctcgacctcccaaagtgttgggattacaggtgtgagccactgtgcctagctagaaatccaggtgtttttttttttgaatatttactcctcagattgttgtaagcctttggttaatttccagagttctgaaacagttggctttaacaatttttgccagtgttctttcttactgcctttatggagaagtggccttttcagaggtccttattccagcattcccgtttatattcctcattctggtcctatacaactgtaataacaacaaacttttcatataacagtcatttgagttgggatggtgagggcaatctggttatgacatctgttaccctgttggtcttcaggaatgatttggttgactgtgcaagtggcctgttctcaccacttaatgtacatctttcctgatattttgcccttggctaagcaggatgacctatttagatagtagaggaccattcttcattctttatttatctgaattagaatcttatccaccaaggtacataattatcgtcttctgagaggtagtgtattttaggcagtagctactttgtactaaattaaatctttttgacaatagacaggcaattttcacctaaacgggatttgagtatattggaatatatgcttgggaagacagctcatcttgataagttaattataaattatttgcataataatattcagattgaaaacttctataaaataagtattattaaatgttgggatgtatttacatatattttatattaagtttcacatgaaattattctttcagtatatgtagaatgtcacaaatttgtggctagacaaagttcaagctcatcttttgcatcatttgtgaaaaatagttttactgagtagaagagggtttttagcataatttcaaggggaatggctatataatttgaaatgtcaaactcctagccatcagaattatatgatgttttgaatatatttttctctgtatagtggtctttacttttcaaagtgctcttacttttgctttagtttcaccagaatactagaggttggtatgggtgagatcctattttggggtaaggaagtttttctaggtaatatatacagtggttgaataacatacctgtaaacacaccatgtgcttatggtatagcccctcctctcctcctccagtactttttccacttcatcagaccattcctctgctaggtgccttattaaatgatgtagataaaaataaacacagggcttggaagcagatccatcacatcctgattgtgtgtccttgggcaagttatttaacttctttgaaccttattacttaatctctaaaatgaaatgaaattatcataacccttacctcaaaagtttgctataataattaagataaattattataaagataataattggctcggcatggtggctcacacctataattctaacactttgggaggccaaggtgggcagattgcttgagcccaggagttcaagaccagcctgggcaacatggtgaaaccccgtctgttcaaaaaatataaaaaaaattagtgggatgtggtggcgcatgcctgtagtcccacctacttgggagactaaagtgggaggattacctgagcccaggaggttgaggctgtggtgagctgtgatcacgctactgcactccagcctaggtgacagagtgagaccttgtctcaaaaaaaaaaagataacacttagtcgaaatagctaaccaaatgctagcagttattttcctcttgaaaataattaaaggaaactttaccaggctttgttattttatttgttgtatagaacttataaatttaataagcttttctttaaagcaatcagttatatttcataattcaaactactgcccacacccatatgatttaatgaggcttgataatactaaaaaatagaattgtaatagaattattttgaatattttagtaatgtgttatgcaataagcataatttcagattcatctgcaaatggctagattaactataggtgaaagaaggtcttaggtaggttggggctggggtgggatagaaggaggattatcctgagcttggcttgatttgcttcaggactatgctagctgctgctcatggatttagagtaaaggagcagactaagattcctagcacagtctcgccatagagagagcgttcagtgctttctcaaaggagcacttcctccagctattttgtttatttatttattggcaccccagatgggacaggaaccattcagctatttacagtcgtgctcatatacactaacaattcagtcactccctttgttagtttattaatttgttgcttaaaagacatttatcaggcatctgttgagccagcaaaatgctcctggtcagtagtgtaagttcaatgtgctgtatcacctggtagtacactagactagcaggtgctcagtacgtgtttctgattatcttcttgtttctccaccattctaaaaaataggctattggtttacatggcatcttgtgtgtgaagagtcacagaagtccctggatgatcagctttatgaaatgaacattttcatgttttaggggatgtgatttggcctgcagcatatattaattcaagtgaaatgagttgtgtaataacaccatgtgcatatgttataatccaaagtatgccagtcaggtggcatcaccccagttttctataggtggaattgagctagagaggtcatggaagttgatcactgtcaagcagctggtaagaggctgatgcatgataaaagtgcctgtctcagatgccaatagtgtaattctttccattatatcatctatctctgtctgttataagcactttattcagcgataatcatgaacacatgttagacttaaaaaatataaagaagccaaaatatgaaattttacaatactaaatatggtgaaacactgttaaagttacactgtggtttgctctaaacttctagatcaaatattgtgaatgcaggaaaaacaattggtttaggagttcacacttatgttactaaatgaatgcttcttgattacatccacaaagcactcagtgagcattgtcttcaattggtttaatgtaattttcacttttccatatcagtttttaatgtggctacattgctttaattaattttaaaagattattctagttgcttgttcatttatttaacaaataatgaatgctcacttactatgtgtcaagtaccattcttatcatcaggaatacagtggtgaagaagacaaaattcttggccttctagagcttgtattctaatgggggaaacagccagataacagaaaacccattagtataatgtcaggtgttatgaagaaaaataagtgctgcaaagaaaaatgaaacagaatacgggaagagagattgattgggaatgctgtcttagacagacggcctaaggaggcagcatttaagcagagaactgatgaagtgagggaataagccctgtgaccatctggaagaagagtgttccaggcaaaggggacagtaagcacaaaggaatgagagtggaactggcttgacatgttgaggaacagcaaggaggatgttgaggctggaactcagcagaaaagtgtggttggttctgcaatcagagaggtaggcagggcccagatcatgtggggttttgtagatcacaacagaggctttgtatttttttcaaagtgggctgagcagccagtggagggttttaagagtagagaggcaagatctgactgatgttttcatagtcagtgtggctgctgtgagaagaaaagactgaagacgggcatgaatgtaagcaaggagaccagttaggttattctatcagagaggtccagtagggggtgaggtgatgtgctttggaataagagaggaatggtactgagggaagaagttgtctgattcaaggtacactgtgaaagtagagctgatagactttactaatggtttgcttcatgtgtttgaaagaaagaagtcaaagatgactccaagggttttacccaaaggaacaggttaagtggttgtgtcatttactgagattaggaatattcagagaagaaaatattgtgggagatcaagagctctattttggatatgtaaaatctgagatgctcattaaacacctaagtggtggtattacatataagagactggatccagttcaagagcagagtttcaagctggagttatgaatcattgagttatcagtctatagtggtatacaggtttaaactgtgctcctcacccctccaagaaagatatatgtaaagcccaacagtctactctcccccatcccatacctgtgaatatttggaaataaggtctttgcagatgtttttaagttaagtatcttgagatgagataatcctggatttagggtagaccctaaaatccaataactgatatctttataagagaaaagagagagatttaagacagagagagacaagatagaaggccatgtgaagatggaggcagagattggagttatgttgccacagccaaagaatgctaggagtcaccagaagttggcagaggcaaggaagaaccctcctgtagaggctttggagggagtcagcatgacactaccgacagctggattttggatgtctggcttgcagaactgtgagacaacaaattcctgttgttttaagtcacttgtttgtggtaatttgttatgacagccctagggaattaattcaggtggtgtctacagctttgagactagttgaattgagattacttaggagatgagtgtaggtagaaaagagaagagggccagagacagagccccggggcactccagtattttagcagtggtgaataggagggaaaatagcagaggtgatgaagaagcggtagagaatcaagtgactgtggcattccagaggacaagagaaaaatggcttcaagaagggcaatgtaattggccatgccaaatgtggctgagagatagaggagggtgatgtggcaggtcaaccaggcctactgcttaggaatgtgaggaagcccagtaacagctagattgctcccaacctaaagacgtcaaagacagagcacccatatttctttgtccctctggcttgtcagttttccccagttctcacaggctgtattggacttcaaacttaaaatgctgctctctgaggagccaggaagatgctgagaagctgcatccattcagtcacttgtattcttagctcctgattcctttccatccactgctggaagattcagtagtaaacagaaagaaaacaaccttgaactcggtccaaatcatcctcacctccaatctttgtatcaaaactagacttttatgtttcacccaatggagataagggtggagaactgaccattggatctggcacttgaaggtcactggtgaccttgataagaagggtttggtaggaaagtctccttagagagggttcaaggaaaacttggctgtgaggaagtgaagacaggaattatagacagctcttcaaggcccactgtagagggaaacagaaaaatgaaacactaacaatagtagtgtaagatgaaaagaatgtttctgaaagatgggagatattataacttgtttgtgttttgatggaaatgatgtagaagagaaattaaattggtgatggaggatagagatgagataaatgcaggagaatgggataaaggcaggaaaaatgagtgagaaatgtccttgatttaggagaatgaggatgggatacagggcacctgtgagagtcctggccatagattgaagagaattggattatttttccattttaatcataggaaaggaagaggacatggagacagatgaagttagttgataaattgattagtggggagatagcttttgatcgtattgagtttatttatgatggctgaatatctgcctatcctggtaagttctaatgattgtataataaagacattatgtttacactgctgctcaaggtgcctagcagtgtcactgacatctgcttgttttatagatattgctataccctggctgaaccgttcacccttgagagacattcacatttcctgtatggaaagcagaggagttagtggtggtgttgattgattacttgatcatgagttcattacccatgaagactataactgtgccttttatcttctgagcacagcagtattttagcattacccatccagtttgtcatctacaatagagggctgttcaaaggcctcgctagggaggcaaatgtgtctggaaatccctttcacggtgatttatttcacagcaaatgaatttcatttctaaatctagcatgaccagaggtcttcctagagtataaaaccatcccaagaggaatgtgagacctctggctgggaaagagggcaccatcttctcttgagatgaaattcgtgaattgggccagaattaactactcagctggtggcagacttttaaattcatcttatgggggtgtgtccctacatacctccttcagcgtttgctttttgatatctccctcttaaatctggaaaatgttaaaaatccatgggtgatgtaaactgatattcattgacctttggcaacatttagcagatatccaatctgctgtctggtcatagagatggtggaggtgctgcttagttgagcagaagcttcaaacatccaggcattgtcaacactcagaatataaagaatatgtttataaactgcaaaaataaaaacaattcatggaggaaacctattttccaggtactatatctgtctctgcacctgttcttcaccccaattagatttccattttaccttaaaattctttgcttatttgaccaatttaacaaatgtaatagatgctaattaattgcattgagcgcccaaatgctacttgatatttattgaatcagttaatatgtatgaaaaaatcagattaaaaaatgacttcatatgtagcttatagaagccatgttttgacttcttcaggaatatgtttttgagctttttataatatggttgagacccataaactcaattataaaatagaaacaaagactaaacctgaagggtttggagtctttgaaaaatttgttttacaagttctatccaattcattgttcttttaaattgagaatttactatgcattgggcttgaacaagacaaacgctaagtcatgttataattcagcttgtttgcaaagagtagatcatttatctgcatgttgagaaatgggcttgcccaagtatagaggaacactttcattttaagctttaaaaaagtaaattgagtcttatttagatttgaaaatatgacaacaaacacattagctttataggcttaaaaaagctttttatgaaagtatatattctttgatatgctgatttaattgggaaaatgatatgattataaaatttactgtgaaaaaaaggaagaatatttttaggacttgaatgtgaatgtgtgagtgtaaaatttggatttttaaaaagtaagaacaaaagaaaaatgtgaaggcacaatgataaagtgaatgtgctgttaaaatagagcttgttattatcatcaatgtaaaaggcctcaacgtggatttctaatgcgttcattccttttttgccactgggggtcactgtaaagacgctgcttgaagaagttaaaaatttccctgatgctctttgtggagtttgaatgtagaaatttaatgtagaaaagaaacactgttcatgaaaaagacttaaaaaagtaagaagataataaatatattctctctttttctgaatttaattgccaattagtaacatgaatcttcatttttttcagaaattctctttatattaatatatggatgttgcattgctattcaaggtaaaagtgtttaataatgatgactttagtgttacagaataattgtgctcttatgtctttcttatttcaaagacattaaaacacaattaatagtttcctatgcaattacatcttactcctggattctgatgtgaccatgagtttctaacatttccattaatgtaatagctcttttaaaagttgttataaaaacatattctacaagccatccccagaatatataattaaactagattcatacagttattttgttggcagtgtaaataaaatatgacaatgaaaaaaagcgaaattcttctaaagttctgtaagaactccatttttcattgctgagttttaggatcttcccctccctcctctcctgccccctccccttcctctttttcctctatttcttccccctccccttcttgctctccaacatttcttgagtggctgccaggtaccttgaatacaagaaaaactatttttttccattgagataagagtgaagtaaggaagtgtacatgaggcctatatgtagatatctggagaggtatttgaataatttattgcctattgacatagattttttcactgtaagtggggagcaaggctatcagctgaggaagaactggggtgggggtgaggtaaggatgataagagagaagggggttgtgtaagacatttggggagaaatgtattttgaccagctgctgtggagaaatatggaaggagaaagtgggcagcactgggggactctattgaggccatagtgcatctgcaccaagcttagtggttgtgtaattcccaaaaccactcagcagctgggaggttgaagaggcaaatacttgggttgcttttagatcaggattttgcagggagggttgaatggaagataaaagtgggcaaaagagttgaggatattggcaaaataataattggaaagacagactgtgaaatacttggaagaaagtgaaataaaaaagaatctgtatgttttgaggaagatgaaatggtttcagggatgggcttctggacaagattgaagaatagcaatgtgttcctataaagagaagaaagaaaaatgggagaataggagtttgtggttaaagagatgtatattagagtttatgatttacagctggaacaagtccaggttataaatgtccaggatgtggtcatgggaggaaattgctaaaatggcctgcagttgaaaaattattgaatagaagcaggcaaggaactcaatagccagcggactggatacatcgtcctcatgcacattgctgctgcttggataatggcggaactaaggggagtgaggactaacatgatgatgctaaaaccttcaaaaaatgtgtgtgtgtgtttgtgttgaaaatgggtgttgtagacatttggtagaagacagcaacaagggggaatagaagctgctttacccagacgatgtcaggttccaaagcaatgttttaatgtgaaggtggaagatttgggtttggagaagcaccaaggagtaagaaaaattctttaatctctactcttttcctctaaccctgggctctgtggagcatgggagaatatacagtctctacctgaaaggcataaaaaagagaactcagtttaaataaaggcaaggaagtgagagctattgtttagacaagagtgtgagtgtgttggagtaatttggtgacaataaagatggttccagatggcacagtgaaaaggattggcaaataggcagcaagaggaggaagcaggcagcatgttggaatgaaagtacaagctgttctgctaaagtaacagagaaacattctgaagaaattttgctttaataagaatttgcattaataaaaccataaacatataaaaattacattttaaaacagtacagcccccagtggttaatagcaccactctggagccaaactgtctgatttgaatcatggctccaccatttactagttgtgtgaccttgaacaaatttcttaatttctctgtgtctcagtttcctcctctgtaaaatggaataataataataccttccttttaggactgttttgatattaaatgagttaatgtctgcaaagtacttagtacagtgtctggcacttgataaactatataaaagtgttacgtaaaaataatttgttaagttggttaaaaagcgagtttgtggctcatggatttcagacttataaaattatttttctatcaggaattgttataaaggctttaaaaaaccaatagttttagcagttttaggaagcatatagctgttaaacttaaatctcactcagcaatgttgaccattgcattacacttccttctttcccttttctcctagggctgccgacactatcactcgtctaaggctccttgcacattgatgggttataaaggtgataaccaagtatgatgcacaaagccagagccaccctttcaaaaagcagccgtgttacctacacaattgtgtgtgtgtgcgcactggttgttttttaaaaagccaattacaattacaattattaaaagaaaaacagaaaattacaattttcagtaacagtgcctgtagaggtctgtataatgaaaatcacgttcctatttagtaggtcccaacaaaaccaattgacttaatggaaacttttgctgtagtagaaattcctgatcatggaggacagatgaccagaggagcttggatttggtttgtgagtgaaggacaaaattgactgagaaagatctgatggtactaactgtttacaagttaaccagctggaaccagttaaaagagtttcctcctgttgctgataagaatcactggatggtgttctgagcccaggacattttgtggtcaatagtcactaatatgaggtatgtgttcaggattccaaatagattgctgagggttgtgtgtggagcttgattagttattacctgaaatgtaaactcccatgagaaagcaagactgggaaatacctcacagtcccaagtccacagcagtggtgggtgcctacagggcaggcaattatgaagtctttctatgctggcagtgagggaggtttcttgattaaatcctaattgtgctttctaggaggaacgctcttgtctgttgtctattattcttcctgtgttcaacttgtgaaagtttcttccttgtccattatcttctttgacatatctgaagaagaaatgggggattgtgaccttcttgagagattcacagctttcacagcctgccttcttcttgtaaaaacttggggtgatgaaagttgttttaagactcagaggctttttcaggccaggccttttgtttctttgtgaatttagttactttaaaaactcagtaagcttctctactatctgcttcttgttaattccatgtacaaataactgtacccaatgatttttcctagacacagatcttaaatctattttatttatttatttttcatgtggccaataccctccacccccttcttctgtctctttcaacttattgtggttaccttgaggctacctgagacagtaggcttgggtggggaagtatgcattctaagtgtaaagtttgatgagctttgacaaatgtcaacccatgtaccagaacattttcatcacccataaaatctcccttgtgtcacttgccagtcagtgtctattctagtatccaactcctggctccaagaaaccattgaactgttttctgtcactataaattagatttgtcttttctagagtttcatgtaaatggaatcatacactaagtactctttgtgcctggcttctgctcagcataatgtttttgagaatcattcatgctgctgcatgttttcagtagttcatttttttaaataggtgaattgtaactcattctgtgaatataccatattctgtcttccatttatctgttagtggatctttaggtcgtttctagttttgggctattgcaaataaagctgctgtaaatattaatgcacaagttttccatgttcatatgtttcatttcacttaggaaaatacctaagagaggaattgcacatattaaaaaaattttaaaaactactaagctgttctccaaaatggttgtacaatttttattcccaagagcaatatgagtgtttaattgctccacattctcaccaacacttggtgcttgttagttttattttcattgttttcattgttatgtctgtgaggcagcattgatgtgcatgtctctgagtgtcatcttagcggtgatgctgagcatcagttcacgtccttataggccgtttgtatatctgctttgtgaaatgtctgttcaaatcttttgcctattttaaattgagttgtgttcgtcttcttaggattaagtaatgagttaaaaatatttctgatacaaatctttcattatatatttctaatgctttctcatctatagtttattttctcatattctttaactgtatcttttgaagagcaaattttacttttgattatgcccaatttatcaagtttttatatggctcttttgattatgcccataatcacattagactttgcctaacccaagtttgcagagattttttcttttatgcttttatctagaaattttgtagttttaggttttaaaaaagtttaatttatttatttgagacagggtattgctctttacatatactggagtgcagtgatgcaatcatggctcactgcagcctcaacctcttgggctcaagcggttctcccatctcagagtcctgagtagctggccaggtgcatgccagcttcaatgtgtttttcatttgcatttccctgataattattgacgttgagcatttttttcatatatcagttagctatttgtacgtcttcttttgagaaacatctattcgggtcttttgcccattttaaagtcagatggtttgtttgtcagctattgagttgtttgagttccttgtatattctggatattaccatcttgtcagatgcacagtttgcaaattttttttttctattttgtaggttgtctctttctctgttgtttcctccggtatgcagaagttttttagtgtgatgtaatttcatttgtctgtttttgcttttgttgcctgtactttcttattcttatccaaaaaatctttatctagatcaatgtcacgaagagtttctcctctgttttcttcgagtagttttttataattttgggtatacatttaagtctttaatctatttggaattgatttttgcatatggtgagagatcagagtctaatttcatacttttggatgtggaaagctagttttttcagcaccatttattgaagagactgtctcttctccaatgtgtgttctttgtgccttcgtcaaaaatcagttggctgtgcgtggatttatttctgtgttctctattttgttccattggtctagttttagccttaaatttaggtctgcaatttttttttttttgtatatggtgtgaagtaagagtcaaagttcattatttttcatatggatatgtaattactccagtaccatcatttagtttgaatggactgtcctttctccatggaattacatgggcatcttttgtctgaaaccaattatgtatgtttacgtatgtgtatgtttatgcatatgttataggtttaatatatattaatatatataatatataatatataaatattaatatgtattatataatatatattaatatattatattatattactatataaataatattaatatattatattaaaatattaataaatatatcatattaaatattatattaattaaatattaataaatatattatattaatatatttatatattaaacctataacatatgcatatacttatttatatataacatgcatgtacttatttatatatacaatatatatttatatattatataatatattatatgtatttatatattatatatcatatattatatgtatttatatattatatatcatataatatatatatttatattatatatattatatgatatataatattatataatgtattaatatatattaaacctatatttataattctggactcactattttgtttcattggtgtctgtgtgtatctaaccctatgccaataatgtactatcttaattaccatagctttatagtaagctttgaaatcagatagtgtattttttatcattgttttttaaaataatagtttatctttttatttgaatttgtaatcagctagtcagtttctgcaaaaagcttactgggattttgcttggaattatgttacatctgtagcatgtactatccaatattctagcctttatccacatgtggctattaaggtttaaattaattaaattaaaatttaattaattaaaattaaaacttaataattggttcctcattcacactaccatatgtcaagtgttcaatagccacatatggtcaatgtcttggaaaagtcaatacagtacatttccattattgcagtaagttctgtcaaacagcactatcgtagaccgattaggagagaactgacttaacagtattggatgctccagtcaatgaacatctttttttttttcatttatttcagtagtctctgcagtatattatagatttcagtttacatattttgcatatattttattaaatgtataacggtagaagtactattattggatgatgtgttctatagatgtattttaggtcaagtttgttgatagtgttgtttaaatctcgtatacctcttgatttttttatttacttgttctttgaattactgagacaggaatgttatatccttaactatatttgtgaatttattcacttcttccttcagttctgttaacttttgcttaggtgctttttaaaaatgaaactttcaatctctgccttttaattgtagcatttagaccatttacattcaatgtaattatcaatatcagtttatttaagtctgaagttgtgcaatttttcctctacctatattataaatctttctatatacaaaacacatgctatgttttctgcatatgttttaaatgacacccggaaagcattgacactatttttgctttaggttatctttcaaagatgttaaaaatgagaaagaaatattctgcatttatccatacacttattatttgcaaaggtttttttaaatacctttgtgtagatttcagttaccaacttgtatttccttcagcttgaagaacttacaatttcttgtaggacaggtctctgacaacaaattatctcagcttttctttgtctaaaaaagttattgcctttatttttaaaatatattttcactggatattgaattttaggtgataatctttttttttttgttagcactttaaatatgtcttctaatgtcctcttgctttcatagtttctgatgagaagtctactgttattagtatctctttgtgtgtgtctctcttttttccctctctgctattatggctatttttttttttttttttttttttggtcactggtgtcagcaatttaattatggtgtgccttggtatgttttgtgtgtgtgtgtgtgtgtgtgtgtgtgtgtgtgtgtgtgtagctgatgttctttgagctttagaatctgtgagtttgtagttttcatcaattattttttcttttcattccttttatttactcatgttcgtgttttattttatatttttaagaattttgtgcgtatttgtaataactgtttaaatgtcatttgtgaattccattgcttctaggtaggattctattgacagatattttttccctgacgagaggtcatactttccttattcttcatgtatctagtggtttttggttgaatactggatattttgaattttatgggagtgctgaattctacaatattccttaaaaatgtgttggattttgttttagcagatagctatcttacttgaagatcaatttcatattttttgatgttcattttttcatttattaaagaataggtccatggtagagtttactgatatcaacctttctggtgtctctaataaatgcaacatattcaataagatctttccactgtagctggtgggaacttaaatgattcccatccctttgtgagctctgggaattatttggcttacagcttcctgaaagttcttttctcccctgccatgcatgtagaattactccttttgtaacctgtataccatgcatggatttaaaaaagacataatgggacccctatgaaaatttctggacctcctttttatctggcacactgtcctgcaaagtctagtaccttggtctccatgaactccatcgatgtctcctcaatttagcatgtccaatgtttaattgatggttatctccttggatttttcctccttgccttgtggcccagaaattacctccaagcagaaagtgagtaatgtctgaaaatgactgttttatatattgtatccagttttctagtagtttacagaagaaagatatgcctgaactctgttattctcttatattcagaaacagagatttccaaaccctgggtttaactgaaaattcttagtgaacctttgttgcttagagccttttcagtctcttcttctattgtttgtatcacaaaaacaggttagctttttcaaaaccaatagatccaaatttttagatgttctctaattcctttttatttccacttgcaaaatgataaatttctcatgtgaactcatatcattcttaaatactctgctttaagcatcaaggaacaatcaagacaaattgacattctgaccctttccaacagcttctcctttcaaatccaccttaaatgttatcacatgcagcaggtttacaaaatatgcaactactgcataacatgaatcttcatctttctaatttgcaacatttgtttccttaccatttaactttggtatgccagcttttcattatgtcagctctcttcttcacagtaccattgtttctgctaataacaccacaataagtagactcaaacatgtaatggtgcaaacaatagtcctaggtgaatgttcagggtgctgtggtatttcttctccatgatgttttgcagagatccagaatcctttcatcttgtcacccttagggacgtagggagttattatagttagattcagcaaagggaaggcaaagcagcatgcaggagcacatgtgggaagttatatggaccaactctaaaagtggcacatatcacatctcacattccactagctagaattcaatcacaggtataacctaagggagattgtaattcaattgtaagaaggatttgcaaatgtaacttagctgtgtgccaaagataagaagaaaatagattcaggtagacaaagagcagaaagatttaagtgtatgtggattcttttttttgttgtttcttcatgtctcagtttattttggagtgcaaattctcagagacccacttcacatctaaatttccttatttttgaggtaattcttctcttgcctctttcccttttctttttccctctctttttcatgtctcttttttctacaaatattaaatcttccaagtactttgctagaatctggactatgttggtaagcaaggtagagtccctgccagcggagtgacagtaatttttatgttttctattatttacctaatattttacctagcatcatatacagtaatattacctgatgatttttaaaataaaaactgggttattcagaattgttgaaagtaacaagaaactactactcagggaaaacttagagaaaaaaagacaaaactcttcctattcatcaccgtttgctttcagaattaaaatattccataatctttgccagacagaaagtaacaacattgatttcaaatcaccctccctgacaactcccatcaaaacccaaaacaaaaaaaaatgcattaactggaggacatctaatttcctaagtctgtttttaattttgctgtatacatttttatattaactctatattgatttttttcattgttgttgttccagtgtacgcagtgttccagattacttttctggcaactgctgatgtggtttgtggctatgtttcgtcccatttcttaattagatgaaatgacaccccacttataatttagttacataaaaatgggagaaatgtcagtgtttttataggaaaatcaccgtgctgacaacaaatctaggtaacatggtagaatggtatcatatatcttctctggattttgtatttcaattcttgggtgatcctaaaacaatgaataagcttattttaaaattaatttattcacttaataaatatttactgagttcttattctgtgtttggcagctctgtgaatagcttagaatatatatgtagttcctgtttttgaagagactatgccccggtagggaaaatcgaaatataagcaggctcctagtgttgtataagaactatgatttcagtgtacataggaagatttaagggcacaaagaaagggctctgagttatgcttgtgggatcctgattgaggacccattaatgaggtctgaaagaaattttgaaggataggtaggagttgaccaaaaaaataaagagaagggtatttggagctgatgggaatgggattataaaggtgaggggggcatgtgaagaagtaaaagtcattgggtttgactgaggcttagtattggagtaggttgaagatattgttgagaaatgaagctggtgagatcacaacttttacttattgaatgatttttatgtaccacatactttacaggtattatttaaattaatacactttattattttgagcagttttaagtactcagcaaaattaggcagcaagtacagagagttcccatataacctcatccccaccgtgtgcaacctcccctactatcagcattccacaccagagtggtatattgtaatcaattgtcccacagacacttgaacacacatgtttatagcagcacgatttgcaacggtgaaaatatggaaccagcctaaatgcccatcaatcgagtggataaagaaattgtggtataaatatatatgatggaatactgttcagccattaaaaggaacaaattaatgtcatttgcagcaacctggatggaactggagactgttattctaaatgaagtaactcaggaatgtagacataaaattttaatctatttgggtaaatacaaaggaggacaattactgaatcatatggtaataatatatttagttttgttagaaacttgcaaactgtcttccaaagtggctataccattttgcattccctccagccatgaatgagagttcctgttgctccacatcctcaccaaatttggtattgtcagttttgtggatcttagccattctaataggtgtgtagtggcatttcattgttgtttgaagttgcaatttcctaatgtaatatgatgttgaacatctttttcataggcttacttgtcatctgtttatcctctttggtaaggctgttcaggtatttttctcattttttaattgagttgtttcttgttgagttttaagagtatttttgtgtattttggataacagttctttataagatgtggggtttcttttgcaattgttttcttctagtctgtgacttgttttctcactttttaatttttttttctgagcagagcttttaagttttaataaagtccccttattgattatttctttcatggatcatgtctttggtgttgtgtctagaaagttattgctgtaccagggtgatgtaggtttttatcctatgttaacttttaggagtcttttcagctttgtgggtctattacccaccttgagttaatttttattaggagtgtgaggtttgtgtctatattcatcttttagcatgtaggtgtccagttttttcagcaaaattttttgaaaaaactctttgctccaccatattgcctttgtatctttgtcaaggatctgttgactgtatttatatgggtctgtttctgggctctattttattgttttacatgtctattctttcactagtactacactgtgttgattactgcagctttattgtaagtcttaaagtcagaggtgtcagtcctccagctttgttcttcttttatattgtgttggctatcctgggctctttgcttctccatacaaaacttagaatcagtttgttgatatccacaaaataactgactgggattttgattgagatttcattgaatctatagattaagttgggaagaactaatatctttgcaatattgagtctttctacttgttaacatgtaaatagctcttcatttatttagttcttctttaatatctttcatcagagttttgtagttttcctcatacggatcttgcatatattttgttaaatttatacttaaatatttcattttggggggttctaatgtaaatagtaatgtacttttaatttcaaattctgcttgtttattgctggtatataggaaaatgattgacttttatatattaaccttgtattctgtaaactctctataattgcttattagtttcaggagtgtttttgtcaatacttttggattttctatatacataattatgtcatctgtgagcaaagacacttttatttcttcctttacaatctataaagagttatttcattttcttttcttattgcattagctaggacttccagtatgatgctgaaaagcactggtgagagagaacatttttgcctttttcctgatgtcagtgggaaagctttgaggttttcaccattaagaatgatgttggatgggcacagtggctcatgcctgtaatcccagcactttgggaggccaaggtgggtggatcacctgaggtcaggagtttgagagcagcgtggccaacatggtgaaaccccatctctactaaaattacaaaaaaaaaaaaaaaattagccaggcatggtgctgggtgcctgtaatcccagctacttgggaggctgaggcaggagaatcacttgaactcaggatgcagaggttgcagtgagccaagattgtgccactgcactccagtctgggcaagagagtgagactccatctcaaaaaaaaaaaaagaaaaaaaaaagaatgatgttaactgtaggtgttttgtagatgtagatgttctttatcaagttgagaaagttaccctctatttctagtttgctgagatttaaaaaattatgaattggtattgaattttgtcaattttttctgcatctttttaagtttttctacatttattaataggatcatgtgattttttcccctgctttatcctattgatgtggtggattacattaattgattttcaaatgtttaactggcccagtatttctatacttgggataaatcccactacattgttggacttgacttactaacattttgttgaggattgttgaacctatattcataagagatattggtctgtagttttctttgaatgtctttatatggttttggtattagggtaatgctggttttatagaaagagttagtatttcctctgattctaacttctgggagagattgtggaaaattggtatgatttctttcttaaatatttggtagaattcatcagtgaacccatctgggcctggtgccttcttttttggaaggttattattaatttaatttatttgatgaatataagcctgttccaatcacctatttcttctggtgtgattttggaaaattgtgtctttcaagaaattggttcattttaaatttatttttaattaattattgaaaaaaaaccatcttaatctgtcacccaggctggagtgcagtgtttcaatcatagctcattgcagcctcaaactcctgggctcaagcaatcctctcacctcagcctcctgggaattggtccattgtatttaggttttcaaatttatgggtatacagttgttcataatattctcttattattcttttaccattcatgagacctgtagtcatgtcctttctttcatatctgacattagtaatttgcatgctctctctttttgattacttagtctggctagaggcttattgattttataaatcttttcaaaaaaacaggatttagttttattttctgctctagttcttattatttctttcatttccttactttggatttaatttgctcttctttttctagtattctaaggtagaagcttagattattaattttagatgtttctttttttctaatatcttattcaatattatacacttccttctaagcaatgcttttgttgcattccacaaatttggtaagttgtattttcatttagttcaaactgttttttaagtttctcataagattttttttacccatatgttatttagaagtgtataggttaatctccaaacattttgaggttttccagctatctttctgttattgatttctattttaatttcactgtgatctgataacagacattgtatgatttctgttcttttaaatttgttagggtgtgtttgttagtgtctatcttcgtgagtgtccatgaacttagtcaagttcatgtgaactagagaaaaatgtttattctcctgttggatgtagtagcctataaatgtccattatatccagttgattatgttgctttttagttcgactatgtccttccttacggattttctgcttgctggatctatccatttctgatagaggagtgttaaattctgtaactgtaatagtggatccatccgtttctttgcagttctttctgtttctcctcaggtatttttatgctctgctgttagattcatacatgttaagaattgttatgccttcttagagaaatgacctttttattattatataatgcccctcttttctcttaataactttccttgctattaaatctattctgtcggatgttaatatagccaatcccagtttcttttggttagtgttagcatagtatatctttcctcatctatttacttttaatctgtgtgtttttatatttaaagtgaattttttgtagataatatatagttgtatcttgttgtttgatccactctaacaatctctgtcttttaattggtgcatttagaccattgacattcaaggtgattactgacacagttgaattaatatctattatatttgttactacttctatttgttgcccttgttttctttccttgtttttgtatcccactctttttctgccatttgtgcctttagttgagcattttatgtgattccattttatcttctttcttagtatataagttgcacttttctaaaacttctaagtggttgctctagaatttgctatatacatttacaacaattcatgtctactttcaaataacactatacactccccgacttatgattatttaacttacaattttttgactttatgatggtgagaaagtgatagaaattcagtacacttcttgacttattatggtgtgatgtcccaattacaaccccattgtaaatacaggagcatctgtaccactttaagagtagtgcaagtacctgataataacaaaataattttaattctttcatcctgttccttgtattgtttctgtcaaatattttatttacatataagcatatgaataggaataaaatacattgttgctattattttgaacaaactgttatctgttagatcaattaaggattgttaccttacttattccttctctgattctcttgctttctttatgtagatctgagtttctgacttaatattattttccttttctctaaagaatttcttttaatgtttccttgtgaagtaattccactggcaacaaacttccccaatttttctttatttgagaaagtctattactccttcacttttccttccccttccttccctccctccctccttccttccctccctccttccttcgccccctcccttcctccctcccttcctccctcccttcctcctttcttccctcccttctttccttttttcttcctttcttcctttgttccttccttctttactttctctctctccttcttcctctctgtcctctcttttctttctctctttccttctctcttttcttctttatccttccttccttccttttcctttcttttttcttttcttttatttcatgagtactggtgcaccaggatctccttcacttttgaaagataattttgcagggtacagaattctaagttgatattttatttctcagcactttaaatacttccaccttttcttttgtgcatggtttgtgaggaaaattctgacataattcttatatttgcaatcctttacttctttcaagatttttatttttgctttttttttttgtattttaaatatactatgcctagttatagcttttggggggcatttatcccacttgctgtcggagcttcctgaacctgtggtttgatatctgatgttaatttggggggaattctcagtcattatttctttaaatatctgttcctttctctctctcttcttctgcatatgttaaaccttttgtagttgtctcaccattcttggatattctgttctgtttcccaccctaccccctagtattttttttttcttttcgattttagatgtttctattgaaatatgctcaagcttggtgattgtttcctcaactttttccagtccagtcaaatgaacccaatcaaaggcattcttcatttctattagtctttttgatctccagcatttctttttattctttcttagcatttccatatctctgcttatattgcccatctgtttttgtaggctgtatatcttatctactagaactcttaggatgttaatcacagtttgttttttttttattcccagtctgataactctaacattagagttagagttctgagtctggttctgatgcttgctctgtctcctcaaactgtggggtttttttcttcgccttttaatatgccttgtaattttttcttgataggcagactgggtgctatatgatgtactgggtacaaggcattgtggttactaagctatagtcatgtagtggtaagatgtggagcgagaggaagcatgctgtagtcctgtgattagatctcatgtcttttagtgagcctgtgcttctggactcacaagtctcacaagtgcttcttagttcctgccccacccctttaggtgggaccggatggctacagtggactagagttgtgtatttttcttcccctatatagaaggctagagcaagctggagttagacatgtcctttgccctaatctgttaggctctggaaaaccctcagtagtataggttctggttaaatgacttctcttaaggtcagaccttgataagaagaacagaatggaccccgcgcggtggctcacgcctgtaatcccagcactttgggaggctgaggcgggcatatcactaggtcaggagatggagactatactggctaacatggtgaaaccccatctctactaaaaatacaaaaaaaaattagccgggcatggtggcgggcgcctgtagttcccagctactcgggaggctgaggcaggagaatggtgtgaacccgggaggtggagcttgcagtgggccgagatcacgccactgcactccagcctgggcgacagtgtgagactccgtcaaaaaaaaaaaaaaaaaaaaaaagaacagaatgttgtgggatatttccagttgatcactttcctcctttccctaccagaagcataaggggatttttctctttaatttactgcgagaatttatttaatcctctgaaggcaaaactcaggtccctgaagctcatccactctgagccttcaagcgattcatggattacagtttaagttttcctgccccagcattgttttccatggaggtttctgctcttgggtgtctgctctgttgagttgtgattctctatattcacctgtctctccaaattttgggaacagctaattgtctgtgatttcacttcactgacagatctaagaagggttggtttttcagtttgttcagatttttacttgttgggatggaatgatttccaagctccctacatgccagataggagtcctgctatttaattttatctttcataaaggaagccttggctgggcacagtggctcatgcctgtaatctcaatactttgggaggccaaggcaggagaattgcttgaggccaggagttcaagaccagcctgggcaatatagcaaggtgctgtctctacaattttttttttttaattacccaagtatggtggtgcatgtttgtactcccagctcctcaggaggctgaggcaggagaatcgcttgagcctagtgagctatgactgagccattacactccagcctggcaacagagtgaaactctgtctctaaaaaaacaaaacaaaaccaaaacaacagcaaaataaaaaaggaagtcttttgagagttaaagggggttatttttaataattatcccaggacaaaaaacataaactgtaatgtatgattactgtattgatgcagttgcctactgatgaggaaactaatatttcagagctaataagaggtataggtgggatttgaacccaggcagtctgatccctgagtcagtgcacttatctctatattatgtcacactcacacttttggggtaccttgtgtagcttttcaaagtcttcactaggacctatcaatactcatcattgtggttgttctttcctgaagagacacataattaaaacacaatgtcacaatgatttattagctcttaatttattatttttaatttccttttattaggagggcaagaactgtgttaaattattctttagttattactgcatataacctcttctaaatctgcaagtttttctccttcctggaattctgtacttgccagagacatctagtcaaacttagttctgtaaacagtcttagatgatataacttagttggaaataacatagctaatcacttgtaaattttagctaagacttaggaggcagaaaaatttagtgattaaaaatggaattaggttgctggatttgaatgccagtttcatgccacacagtctgtgactcttaggtaagtgtgattttcctctccaagtctcactctcctcatctgtatgcttgagaagataatagtatctatctcttggtggttgttttgaatcctatatgagcctggcacataatcagggctctttattttagctggatctttaggtttctagtgaaatgctttcaaagcatgatgactttaaaatcctttctgacagtggtttttaagatctatcaatgtaggtattgagtctgccagcaggagttcattgattattttaagctgcctatttgtgtaacttaatatagataagaaaatggtcccctttgccattttggtatatcactaagtatagatctagcttccttttcagatataagggagtagtaaagaaaatacttctataatcaacttttatttttattagagctataaatatatatagctttcttaaaagaaaaagtcagtgcaaaaggcttttaatagaaacaatcagtcccttgcccacccctcctgactcttgattattgatttccagaggctaccacttacaattcttttagctattgattttgatagttacctccatatttctatgtaatctgtttatattactattttttatttttcttagttttagatactctcttttgacttctcactgtagagaaggaggatttagctgtcttatatccttctcctatacttatgtatactcacacactcacatatgcacttatcctcctacattctactaaaagaatcatattttgctgaataaatttttataatcctgaaaatgttattcatagctgagctatgtggtaaattttggttattctttcttccatgatattgtcttttttgaggttgataattatctctgtttggtttgtttgcatagttttctgtacatctatcactaacgtattcccaatctcccctacagaagtctcaatctctcagtactttaaaaacattctggattaggtagttttatgtttattttcttggtagaggaagaaatctcttcaggactctctgttctctcattcccatagatatcaattgctctcttggtctcatactgggatctataccatcctgaaaacttccttcttttcttggttgtattcctgcttcctggatctcatgtcttcctctttattagtttgctcccttgttttgtagaacacgttctttaacagcgttcttaaaaaggtgaaagggaggtaaaatattttgagatttgcaagtctggaaatatcttttcctactgtcacgtttattgaaaatttagaattctaggttagaaatgatttttccctcagaatttcaaaaacattgctctattgttttttagtttccagtttgctgctaggaagactgatgctatagtgattcccaatcctttctttgtgtcttttctttaacttctctggaaactttttagtatcttttatcagttcccagtattttgaaatattttactgatatgccattttgtgtgtatgtgcatgtgtgtgtgtgctcatttcctgtttggcacttgttgagtttgttcaatccataaattcctatcttttacttataggacattttcttgaataggatctctccaaccccaaactgtttctgtttgattttctctctttggaatgtcagttattcaaatatcgaatcttctgggccatttctctagttttaacaatgtggtttttttttttttccttgtttacttcttttttttttctttcattttctggaacaattccttgagtttttcttccaaccattttactaacattttaatttctgctctcctattttcagttattgagattttttgcctggtgtttctgtttatggccttctaattttgttccatgaatgcaataagttctcctttctctcagaatattagtaaaaatgatcaagttgtattctgtattttacattatctttttttccttcaggtttcatattacaatgtttatttgttttggtctctgagaatctttttggcttttccttctttcttttcttttctttttaaattttcacaaaagtttctattgtgaccaacaataaacattcaaaaaagtaataatatccattgattcaatatccttcagagaatagaaaccatgtaaaaaaactgttaattttataagaataggtaaattttggtatccatatctgacaatgccattacaagaagggaaatttacagaccgtgatcctttttgaactaaatttatatatcctattcaaaaatccagctatattttataaggaggttatataatgaccaaatgtggtttatgcaattaattcagtatgtactaattcctgaataaagagtaataatagtctcaggctggcaagctgaataggaacagctctggtgtgcagctgccagtgagatcaacgcagaaggcaggtgatttctgtaatccaactgaggtacctggctcgtctcactgggactggttagacagtgggtgcagcccatggagggcaagccaaagcaggatggggtgttgcctcacctgggaagcgcatggggttgggaaactccctgccctagcaaagagaagctgggagggactgtgcctagaggaagggtgcattccagctcagatactatgcttttcccacggtcttcacaacctacaggcaagagattcccttgggtgcctacaccaccagggcctggggtttcaagcacaaaactgggtggctgtttgggcagacaccgagctagctgcagcagttttttttcataccccagtggcacctgggacaccagctagacagaacaattcactcccctggaaagggggctgaagccagggagccaggtggtctagctcagcggatctcacacccacagagctcagcaagctaagatccactggcttgaaattctcactgccagcacagcagtctgaagttgacctgggacgcttgagctttgtttggggaggggcgtctgccattactgaggctggagtaggtggttttcccctcacagtgtaaacaaagccactgggaagttccaactgggtggagcccactgcagctcagcaaagccgctgtagccggattgcctctttagattcctcctctctgggcagggcatctctgaaagaaaggcagcagccccagtcagggccttatagataaaactcctatcttcctaggacagaccacctgggggaaggggcggctgtgggtgcagcttcagcagacttaaatgttcctgcctgccagctctgaagagagcagtggatctcttagcacagcattcgagctctgctaagggacagaatgtctccttaagtgggtccctgaccaccgtgcctcctgactgggagacacctcccagcaggggttgacagacacctcatacgggagagctccggctggcatcttgtgggtgcccctctgggacgaaacttccagaggaaggaacagacagcagtctttgctgttctgcagcctccgctggtgatacccaggcaaacaggatctggagtggacctccagcaaactccagcagacctgcagcagaggggcctgaccgttagaaggaaaactaacaaatcagaaaagaatagcatcaacgtcaacaaaaaggacatccacacagaaaccccatctgaagatcaccaacctcaaagaccaaaggtagataaatctatgaagatgaggagaaagcagtgcaaaaaggctgaaaattccaaaaaccagaatgtctcttctcctccaaaggatcacaactcctcgtcggaaagggaacaaaactggaaggagaatgagtttgatgaattgacagaaataggcttcacaaggtgggtaataacaaactcctctgagctaaaggaggatggtttaacccaatacaaggaagccaagaaccttgaaaaaattttagaggaattgctaactagagaaaccagtttagagaagaacataaatgacctgatggagctgaaaaacacagcacgagaacttcgtgaagcatacacaagtatcaatagccaaatcaatcaagcggaagaaaggatatcagagattgaagatcatcttaatgaaataaagcatgaagacaaaattagagaaaaaagaatgcaaaggaatgaacaaagcctccaagaaatatggggctatgtgaaaagaccaagcctgcatgtgattgtgtacctgaaagtgatgggaagaatggaaccaagttggaaaacacttttcaggatattatccaggagaacttccccaacctagcaagacaggccaacagtcaaattcaggaaatatagaaaacaccagaaagatactccttgagaagagcaaccccaagacacataaccgtcagactcaccaaagttgaaatgaaggaaaaaatgttaagggtagccagagagaaagatcgggttacacagaaaagaggcccatcagactaacagcagatctctctacagaaaccctacaagccagaagagagtgggggccaatattcaacatgctttttttttttttgagacagaatcttggtttgttacccaggctggagtgcagtggtgcaatgttggctcactgcaagctccgcctccgggttcatgccattctcctgcctcagcctcccaagtagctgggactacaggcacctgctaccacgcctggctaattttttgtatttttagtagagacagggtttcaccatgttagccaggatggtctcgatctcctgacctcgtgatccacccacctcagcctcccaaagtgctgggattacaggtgtgatcaacattcttaaagaaaagaattttcaacccagaaattcatatccagccaaactaagcttcataattgaaggagaaataaaatcctttacagacaagcaaatgctgagagattttgtcatcaccaggactgccttactcttaagagctcctgaagggagcactaaatatggaaaggaacaactgataccagccactgcaaaaacataccaaattgtaaagactattgacactatgaagaaactgcatcaaattacaggcaaaatagccagctagcatcataatgacaggatcaaattcacacataacaatattaaccttaaatgtaataaaagggttaaatcacccaattaaaaaacacagactgggctgggcacagtagctcacacctgtaatcccagcactttaggatgccgaggtgggtggatcacgaggtcaggagttcgagaccagcctggccaagatggtgaaaccctgttactaaaaaatacaaaaattagctgggcgtggtggcatgcgcacatagtcccagctactcaggaggctcaggcaggagaatcgctggaacccgggaggcagaggtggcagtgagctgagattgtgccactgcactacagcctgggtgacagagcaagactctgtctcaagaaacacacacacacacacacacacacacacacacagagagagagaaattggatacagagtcaggacccatccatgtgctgtattcaggagatccatcgtatgtgcaaagacacacatagactcaaaataaagggatggaaggatatttaccaaggaaatggaaagcaaaaaaaagcagagattgcaatcctagtctctgataaaacagactttaagccaacaaagatcaaaaaagacaaagaagggcattacataatggtaaagggatcaatgcaacaagaagagctaactatcctaaatatatatgcacccaatacaggagcatccagaattcataaagcaagttcctagagacctacaaagagacttggacttccacataataatagtgggatactttaacaccctactgccaatattaggtcaacgagacagaaaattaacaaggatattcaagacttgaattcagctctggaccaagaggacctaagacatctacagaactctccaccccaaatcaacagaatatacatttttctcagcaccacatcacacttactccaaaattgaccacataattggaagtaaaacactcctcagcaaatgcaaaagaatggaaatcgtaactaacagtctctctgaccacagtgcaatcaaattagaactcaggattaagaaactcacgaaaaccacacaacgtcatggaaactgaacaacctgctcctgaatgactactgggtaaataacaaaattaaggcagaaataaataagttctttgaaaccaatgagaataaagacacaacgtaccagaatctctggaacacagctaaagcagtgtttatagaggaagttatagcactaaatgcccacaggagaaagcatgaaagatctaaaatcgacaccctaacatcacgattaaaagaactagagaagcaagagcaaacaaattcaaaaactagcggaagagaagaaataactaggataagagcagaactgaaggagatagaaacacgaaaaccccttcaaaaaatcaatgaatccaggagctggttttttgagattaacaaaatagactgctagccagattaataaagaagaaaagagagaagaatcaaatagacaataaaaaatgataaaggggatatcaccactgatcccacagaaatacaaactaccatcagagaatactataaacacctctatgcaaataaactaggaaatctacaagaaatggaaaaattattagacacatacaccctcccaaaactaaaccaggaagaagttgaatccctgaatagaccaatagcaagtctgaaattgaggcagtaattaatagcctaccaaccaaaaaaaagcccaggaccagatagattcacagccaaattctaccagaggtacaaagaggagctggtagcattccttctgaaactattccaatcaatataaaaagagggactcctccctaactcattttatgaggccagcatcatcctgataccaaaacctggtggagacacaataaaaaaagaaaatttcaggccaatatccctgatgaacattgatgcaaaaatcctcaataaaatactggcaaatctaatacagcagcacatcaaacagcttatccaccacaattaagttggcttcatccctgggatgcaaggctggttcaacatatgcaaatcaataaacataatccatcacataaacagaaccaacgacaaaaaccacatgattatcccaatagatgcagaaaggcctacaaaattcaacatcccttcatgctaaaaactctcaataaactaggtattgatggaacgtatctcaaaataataagagctatttatgacaaacccacagccaatgtcatactgaatgggcaaaagctggaagaattccctttgaaaaccggtacaaaacaaggatgccttctctcaccactcctattcaacatagcattggaagttctggccaggtcaatcaggcaagagaaagaaataaagcgtatttaaataggaagagaggaagtgaaattatccctgtttgcagatgacatgattatatatttagaaaaccccatcgtctcagcctgaaatctccttaagctgataagcaacttcagcaaagtctcaggatacaaaatcaatgtgcaaaaatcacaagcattcctatacaccaataagagacaaacagagaaccaaatcatgcatgaactcccattcatgattgctacaaagagaataaaatacctaggaatccaacttacaaggcatgtgaaggacctcttcaaggagaactacaaactactgctcaaggaaataaaagaggatacaaataaatggaaaaacattccatgctcctggataggaagaatcaatatcatgaaaatggccatagtgtccaaagtaatttatagattcagtgctacctctatcaagctaccactgactttcttcaaagaattagaaaaaactactttaaatttcatatggaaaccaaaaagagcccatgtagccaagacaatcctaagcaaaaagaacaaagctggaggcctcatactacctgacttcaaattatactacaaggctacagtaaccaaaacagcatggtactggtaccaaaacagatatatagaccaatgaaacagaacagaggcctcagaaataacgccagacatctacaaccatctgatctttgacaaacctgacaaaaacaagcaagggggaaaggatttcctatttaataaatggtgttgggaaaactggctagccatatgcagaaaactgaaactggaccccttccttacaccttatacaaaaattaacccaagatggattaaagacttaaatgtaagacccaaaaccataaaaaccataaaagaaaacccaggcaataccattcaggacatgggcaaaaacttcatgactaaaacaccaaagcaatggcaataaaagccaaaattgacaaatgggatctaattaaactagagagcttcttcacagcaaaagaaactatcatcagagtgaacaggcaacctacagaataggagaaaatttttgcaatctacccatctgacaaagggctaatatccagaatctacaaagaacataaacaaatttacaagaaaaaaaacaaacaaccccatcaaaaagtgggcaaaggttatgaacagacacttctcgaatgaagacatttatgtagccaacaaacatatgaaaaaaagctcatcatcactggtcattagagaaatgcaaatcaaaaccacaatgagataccatctcatgccagttagaatggcgatcattaaagagtcaagacacaacagatgctggagaggatgtggagaaataggaatgctttgacactgttggtgggagtgtaaattagttcaaccattgcggaagacagtatgggaatccctcaaggatctagaaccagaaataccatttgatctagcaattccattactgggtatatacccaaagaaatataaattattctactataaagacacatgcatacatatgtttattgatgcactatttatagtagcaaagaattggaaccaacccaaatggccatcagtgatagactgctaaagaaaatatggtacatacacaccatggaatactatgtagccataaaaaggaatgagttcgtgtcctttgcagggacatgaatgaagctggaagccattattctcagcaaactaatacaggacagaaaagcaaacaccacatgttctcactcataagtgggagttgaacaatgagaacacatggacacagggaggggaacaacacacactggggccagtcaggatgttggggatgagaggagggagagcattaggacaaatagctaatgcattgggaggcttaaaacctagatgatgggttgataggtgcagcaaaccaccacggcactcgtatacctatgtaacagatctacacattctgcacttgtatcctggaacttaaagtaaaataaaacataaagcaatataaattactaggcaaatactgtccatttcatctaatgaagaaaacaaatgacaaatatcatgtatatgacgtgctacacaaaatgtctaggttcttacattatttattactggaagaaaccttggagatcatggtttctaactctttatttgacagatgaggaaaactgagacctggggagttttggtgacttgctttgagactagaatccaagctttgtaattcctagtacagtcttctttccattaaatcatatttccttttctaaggaatagtgaatgctgtgtggcttacaagtttatttttggtgatggcactttacctgcttttcttcttttaatttttttgacctcagtgactagaactggatcaatagtaatccttggtttatgacgcactctcatcattggtccatgcataacctatttatttgtttatttgcttttaataatgtaatacataaaaatttcaaatattcatattaggtggagaacttaggagcaaaatgaaaatgtataatttccatatatgcgtggtacaaaaataaactcttatatttcaaaattatttttgtgctatagctatttgtttttctcccttgggttgaaggttatcttctggatgggtggtttggcaactgtcctcctcatcacactgaaatcaccaaactcaagtagcacttagaaaacaaagtaagacagaaggaaatgggaaaaggaccaggaaaatgtgctttacatttagcattgtgacatatatgtctaaaatttgttagtcttctgcaaattgtgtaatgttgggtttgtttatgatgcaggtctgagaaccattggagttatcaccaaactggaccttatggatgaaggaacggatgccagggatgttctagagaacaaactgttgcctcttcgcaggggtaatgtactgtggtctatacaagactttttttttttttttttttttttttttttgttatatggaagagaaatgattgggaagccactaggaggtttggttttaatgccttctcagttgtaaggaatggatttattattagttatacttttctggaatggctgtatgttcccaaatgatatactagaaaataatccaaagggagaactattccttaaaataacaggaataagaaaacaggaaaaggaaggagtttgaagggaggttataaatattcatcataggctacataaacttatactattgtaagcctggtatttacttgcctgctatatgacaaaactgctaagatacacactctcttaaaatgtacacagtttgagggtgagaggcattattgtactgatgctaaaaaattatcgtgggctcaatcagcagcctgtattcaatactgatgtttcccattgagttttataaaggaactcagtcttcaggcctaaaactagttttgcctttcttactctgcctatgtgagagccttgaaatctccctagaataagccacaaaaagtgtccccaactccatagatttgtgttttgtttcaggttacgtgggggtggtaaacagaagccagaaggacatagatgggaagaaggacataaaggcagccatgctggcagagaggaagtttttcctttcccacccggcttacagacatatcgctgaccgaatgggaaccccacacctgcagaaggtccttaatcaggtaaaaatgttctttcaagcaacaagaacaattatgaaatatgtaagtaggtgctggaattcatatttattatttttaagtttatttttttttccaaaacaagacatgcagcttcaatgatagggattttaaaaatgaatattagtacctcagattcacactattaccgttctcagtgaatagaactcaccttcctattattgcaagaacaattatcaaagcagaaacacatacctatttaggaacagtgaacagggatatacattttagcatatactcacttgtaatatgtagttatcttgagaagttaaatttttatagctttgaaaagttgatctcttgggatctgtttttgaagcaccagtctgtaatggctaggttacactttctgttaaattatttttatggctttgtttagaattgatttgtttcttaatttaaaatcttcagaatcacaaatcctaattaaataatcattgatttccactcatctaagatgcttttctagataaccccttttcccacaataatttagaattgggccttctgcctaccccgctccatgcactatgcacacacttcttccgtaaatcctcaatgctcttacttggttacagatattccttcccctattggagttaagtgttacgacaagcatcattgtcattgaatgcagggcctcctccctgagttttgattatattgacttaatgtgatcagcagcctttctcacaaatattcttgtaagttatgctttaactgttacatacaaacttaatcaggcaatcaatcaatcaagtagatttctgattcttagctcctggaaagtatcaatagctgtcacaatatgtgacattatacctgaaccatttaggcaaaacaactgagaagaaattttagaaaataaaaaattatgttataattccattttaagaggtacaatacagactattgtaaagtttatactttttaattaaagataaacatttggacactaggaaacatcactatgattgtatcatttaaaaatatgaatatatttttgagaaggagcattgttatgcaagaatgctaacactctaccaatatattttgcactgtcaaaactctctttagaatactgctttaacagctgtatttgcctacaaaaaatacaaataaactgaaaaaatctcagaggaaactcactaatatgattagaaagataaagctggaaatgagttaggttttgaatactggaaaaacaaaaggaggtggttgactattaggttattacaggtgacccccaagttatgacacaattggattctcgttgactaaaaattgaatgattttttttttaactgaagatttctcctttcctggataatcactctctctttattgcttcaataatatttatactatgtttgaaactaagataattctatggctatgtatgtgtaccaatacttctgctcctgtgggataatttatatggaaaatgctggaaaatgacatgacgtttttgaaaaattgaatgaaattttcactgtcgggggaaggcagagaaagaggtagtgagttgtattagatgatattggagatgtaggcagtggctgaatcctgtaatgtttctagaccaaattgaggattttggctcttacctaagaccaatgaggagtcatttaaaggtcctgagtagaggaacaacaagatcagatccgtgagtgaaaaaagaatgtggtattgacaagaagaccaagagtagaccagttagaagtaaaaatgagaaattatgggaatttggttgtggtaagggccagtggagagtaaaaaaaggggcgggtttgagaaatgttcaggaaaattgaggactaggtggtagattagagctgttgggtaatgggagaggtagagtcaaggttacgtctcaggtttccagattcttatgaagtcaccaagatggggaaccctgaagggaagatcaaatacttgattttggacatgttgagcttgagatatcattgacacatccaagaggagaagtcaatcaactggtcaaatatgcatgccacagcaaagataaatcttgtttggagacaacatcttacagctataggtatttggatgtttattgaagccaggatggaatgagattcccttaagagagaacagagagtaaataaaaaagaggccttggacccagatttgaggaatttcaataattactcttctggcaaagagggtgaattgtccaaggaaatagagaagatacatccagaatggatagcagaaaaatgagaggagctggaattatggaagccaggggaagaagtgttttagaaagccgcagtattgctttgctctggagatgtctgagaagcaaaaggtggaaatcaggtatttttattatttaccagttcacatggcaatcagttggttgctggtttcttgtggttgctggttctgttagatttgggtccttgtctcttgtgacgttgctgtcgggaatgctgtcctctcagctcttttgttgcctgcttcatagttagaacagcaacgcatgccagggtgctaacaataatttattactgcaagcaagggggtaatacagttataaactattgacaaataactctagatttatttaataaatatattcagctaacctcagataaacataaagatgacttaaaatagtttcttcagtcaatctggatatgttaattctccttactttttttttctttttttattttattttagtattattatactttaagttttagggtacatgtgcacaatctgcaggttagttacatatgtatacatgtgccatgctggtgtgctgcacccattaactcgtcatttagcattaggtatatctcctaaagctatccctcccccctccccccaccccacaacagtccccagagtgtgatattccaattcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtatacgctacctgacttcaaactatactacaaggctacagtaaccaaaacagcatggtactggtaccaaaacagagatatagatcaatggaacagaacagagccctcagaaataacgccgcatatctacaactgtctgatctttgacaaacctgagaaaaacaagcaatggggaaaggattccctatttaataaatggtgctgggaaaactggctagccataggtagaaagctgaaactggatcccttccttacaccttatacaaaaattaattcaagatggattaaagacttaaacgttagacctaaaaccataaaaaccctagaagaaaacctagacattaccattcaggacataggcatgggcaaggacttcatgtctaaaacaccaaaagcaatggcaacaaaagccaaaattgacaaatgggatctaattaaactaaagagcttctgcacagcaaaagaaactagcatcagagtgaacaggcaacctacaaaatgggagaaaattttcgcaacctactcatctgacaaagggctaatatccagaatctacaatgaactcaaacaaatttacaagaaaaaaacaactccatcaaaaagtgggcaaaggacatgaacagacacttctcaaaagaagagatttatgcagccaaaaaacatgaaaaaatgctcaccatcactggccatcagagaaatgcaaatcaaaaccacaatgagataccatctcacaccagttagaatggcaatcattaaaaagtcaggaaacaacaggtgctgcagaggatgtggagaaataggaacacttttacactgttggtgggactgtaaactagttcaacccttgtggaagtcagtgtcttgattcctcagggatctagaactagaaataccatttgacccagccatcccattactgggtatatacccaaaggactataaatcatgctgctataaatacatatgcacacgtatgtttattgcagcactattcacaatagcaaagacttggaaccaacccaaatgtccaacaatgatagactggattaacaaattctccttaattttaatattttttcttttttctgcatttctaggaagtttatattcttttcattgatttcaagttcatcacttaggaagttcaagattatctgttttttcttttaattcagacttttctttaactgcattgtaatagaaaggctgtaagacctaaacaatctgggtttttatctcacctttgttcttaattaatcatgcactcttaggttcttggaaaagttttcattgtactgagcttgaggtgcctgctgatctcagtggaaatgccaagtagatggttatgtcaagccttcaatagcagagagagctttcccttactcagtcatggagttgcactgggatctagagatggaagtatgagtaagtttctgcctcagctgaagaatgtggagaaaattaacagctgacaggtgcctctagcaccttggctacctgagcttcatcagtgtggtaaaccacttagtcctgagaacaccgggtagcagctgtgactcctagcttccttcatttctatcacattctaacttaaggttcctttctacaaggtaggagacctggtaaatcaatccatgctaaggtgttattgggcagcctcattagtaacattagctgcattttaacagggtcttcctggatttaaagagatagctcaagtgagtgactctaaatgaaggaattttgagcatctctgaagggcagtggaggagggagttggtgttccttctccctatctacataatagtcaatgtcaaatgcagacataatgtttgaaattttgaattattagaaaaacaatggaggcggatctttgtctcatgagttaatctttaatctgtgtatatgattcaatcttcaatctgtgtgtatcattttgttttgtttagcaacttaccaaccacattcgggataccctaccaaacttcaggaacaaactacagggacagttgctctccatagaacatgaagtagaagcctacaaaaatttcaaaccagaagacccaacaaggaagaccaaagcattgctgcagtaggtcacctttcccttccttggctcagcattttaatctaatttctttagttttctattgccttagtctatttgtcacgttgcttcttaggtagcaagtaaactatatgaggctatctatatgatacaagataactcttgaatttttatgctttgttgaacaagaattattggtattattctgttattatcaacttaccagttgagcatcctcatgcccatttaaattgtgtttttaaaactggattaagtgagtaaaaccattagggatgacccagcaggaatttttgtcccttgtcttagaagtgggtaaatacagatgcaaatatcatttgtatttttcagctgtttctatggatgtcaattgtacttattatcctttattccaattatttcatgtaacttatttgtgtgcatttttcagtggaatgagaaccaagggtttaatttaaaagttctaacaataaggctgtagtttttttttttccttttacataatgattttaatgtagtcctttgaaaatgtaaatgtgaaactgccaagcatcttttcaccccttcatgatcttcccatcttatctttgggttactagagttattcctgtggtgtcttggggtaggatagcagagaattgttagagaattcctagctctttatatcttacactttcttctctccttcaaatccttctgtctccatcagttcctttatcctgtgctgccacttgtgtcaagtccctctcaacaggaaggctcccctgcccagcacacactgcaggatacccaaggtctacctccgaagatgatgtttggcacctcttatggcgcacttttctccccagcagcgtggcaatcaaagcatccttcaattggcattcaaagtgcacactataatttctttctttgtgaggagattcccaaatgctcaaatatttaaatataatattaattgcttcatcctatatttcctcattaaaaatattatacaaaggaaagagttttttttttttcagatataactctttcctaatttattctttcttttcgttcttgggttttgttgagctcttgcaaaaactcttcaagttacagagaaagctatttctgtttaggccctaggtcattatcttaatatccaactaaaactattctgcttgcaaataccgggtcttgcctctgtgactttattggactcagattacagaacttttcacagctagattcttgatttgcagagggctgattcagctccttctttatggccctattctttctgacctatttcttttctctcttctatccttccctcctgccttcctttctctgttcttcctccttcctctaatctcttcatgcactcagtgtctggttctgtgaaatgaatgataataagattcttgccctcaagaagtcccagtagagtagggaaaaacagacataaaaattaacacaatttaacacaattaattgtgttaaagctaataaatgctatgtttctgtaagtgtaaaatattaagggagcccggatgaggaagcagttacatgtgaggaaggatgtgaatttgcagagaaaacagagggcctgtggtaggagaggaccttgtcatgtggaaggaggagggcaagagaatcatgagaactttggtaacatttgttctcggattagtaaatgggccaggtggctgaggtatagggtttaagggaaggagcagctagaagtacactttctgaaaaatttttcatgtttcagtgtgtatgtcatacctctccaggtgtttttaaaaaataaaattagcatatacatgaacataactaaatccaattacagtctagcttctttggcctaaataatttgcagctacttttcattcatccatgattttgatggaagggaatgaaaagatacaagttttagatagtttgaattttttcccttttagattttgaatttgaaagtagttccagtatgtttaaattggagtttctaaacctggtaatcacaaatgaaaatagttggtttttttttttcgtgtttctttctttctttctttcaagcagccagtgtaaggtaattcattctttcctgggacaaatatttattaaatctcccaattatgttgagcagggaaaggtaaagaaaacacacattccttgcccttaggagagtgactaatagacatggcaatgttaatgtactgtgccaaatgctctgcaggaaacacgctgaagatgcagaggaggggcgatgaggagtggtgccggatagagtcatggatcatgaaaagtttctgggaagaaccaatgcttgagctgagtcttaaagaacacgtaaaaattagtcaggcaaagcagcaagggacagagagaatggtgttctgagcagaaagaaaagtgtaaaagcacagggacatggtgcatttggggaactgcaatggcttccttatggttggctggaaggtgagttggatgagtggtaagagatggggctgaagaggcagccaaagccagaccataaaatgctgggagatgggctaaagagttttgattgtattatcgaattgtggggatccattgaaaaacaaggctagagctagtttagaggggtcacaaatctatgttattctgatagggtgaggtctgactttgacaaagataaactcaaaagcaggatcatcatctagaggagccttcagtgatgctgggaggcattgctgagagctgaaccaaggcagtgtcagtaggtgtgaggaggaagagctcaaccagctgagctgtaatggagaagaaattacctacaactggtggctccctgcaactgttgggtgagggaaagggaggtatgctggatgccccagattccctgcctggggtgggtggtatcatccaccatgaggagagacttgggaatgcaggaggatcagcaggtttgggagtgaaagaaattgagaggttgttttaagtgtgttgagttcaaggcagctaagaggaaataaacatccagtacagttgagcatatgggccactcactcttctgagagttataggctaaagcggaaggtgtggagaaactatttctcaatagcccttgaagctatggcaaccttgagatcacctagggatgaatgtgaggagagactgaggctgtgacattgggggagtaatagagctggagcatttgggacactaggtggttgtgatgtcataggagttcaggtccatttgattattctacataaagtttaattgattaactctctatttcaagtgttctttaaataccattttatgactgcaatcaaatgaacagaaggcattgaaagacaactatatttaaatatttattctaattaaatgtctaaaatcttaatgatgtgtattttgtataatcacactgtgagtactacatagagtgcaatgttaactctgccagtaggtgccactaagagcacctggaaaaggattctaaggaataatcataggaaaagaaaatgaagagtgcaaaggcttgtaactttgacttgaatctatttctctttaacaattacaggatggttcagcaatttgctgtggactttgagaagagaattgaagggtcaggggatcaagtagataccctggaactctcaggtggtgctaaaatcaatcgtatttttcatgaacgctttccttttgagatagtaaaggtttgtgtcaaacgttatttttttcttagtttcacttcacttccatattctgttttatacaacttaatacaatattgtgtgagtggtatagaactaacatagttctttgaacaaaacctccatattcaggtaatgaaattcaggagaggaatatgttcttactgatgattctgattttatttaatgagatttaactacatttcaaacacaaatactaattgagtttcctagtttgttgtctaattaatttaaaaatatttcttaagcatgtactatgcaccacatttctaggtgccagtgattaagacagagaagacccttgcttgtctagtggggaaagacagaaaattaacaaatagacaaaatacgaaagtttcaaatgtttttatgtaacatgatatgagagaggggatgggtgagccacttttaatggaataatcaggcaaattctgtctgagcaggagacatttaaactgtgcccagaatggcatgaagaggtcaactgggtaaagatctgggggaaaggggttgttcaaggcagaagtagcaacctcgggtaaggcactaaagtatgacaggtgaagaacagatgtggctgatgaaggagaggggcatgaagtgaattcagagagggaggaagtgtccagttcacacaaagctttctaggttgaggtaaagtctttatacttaacaatgggaagttacaggagggttttaagcagtaatgtgacttgatttgttgatgattttagaagaatagtatgcctgctggattgtaaagagccaagagagtgaggagaacagtaggccagaccaggggtggattcattttctgtggagtctgaagcttctacaattttacaggcccccttgaagaagaatacaaaattataaacacacaggcccagggtcttggaagaggcttgtgcaagggggaaatgctgagaattaaacttctttagctttccagtaaaagtgccccagcaagaaaggatagagagatgggtggctttggggttttggagataaagttgctagggcttcgattgaaatgggggaatggaagaaagggaagttttgagatgacttccaaggttttggctttcacagctgagggagtggtagtgcccatcagatgagggaaatggaggaaaacctctgtttgtatggagaagtgaattaggagttctgttttggatgtgctaagcgtaaaatgcccaataggcagttgagtagttttagggaccatgctacttgtctcaaacagagaggtgagtgcttatgtcttcgtgtgggaggcaaatgggtaaatagataatttcattaaaaatgtgctaagtaaagtgataaacttcagcaaagggtactatggaaacacagcccacagacatgaatcccagctcaagtgtgtaagggagccaggcttctgagctgagtttggaaggatgagcagctagttaagcaggaagaggtaggctacaggagggggtgatccagacaggagaggaatgagctatgaagccatcagttatgggtagagacctagaacaattcgtcattctagggcataagctgtgaggggaggaaatggacagacaatgaagccggagaggccaaatctcagaggtcagggttgaactcaatgttcttgggctatcccttcgaggtctaagctctgtgacactttggtcctacttccaaatagatttatggtacctagcgcttctgagaaatatttgtaatctatcctgtgttgtctttttaaaatattactaattttcttttacaaagaggcctttaactcaaatgatttaagtggccagggacaaaagacagccattgttaatttcaggacatctgtactgctactgcacagcaggtgaaactctcatttatgcattcttctgtgccctcaaatttaccatattcagcaaaagaatgaagaattatacatttcaaatgaatggctagatttatgtccagaaggcatccttatgcatagcactccatatctataacagagttaaaatccactgcccccaagctccccaaaatccctagtgttctgtgttgccttgaaatttatataaacagatgttttgaccatctgggtttaggttaggaaagacatgagtatccacttattaataatgaagtcaagttattctcattctgtaatgttcaacaatattattcaaaggaattaagtgtcataactatggctcattttgcatctgcagatggagttcaatgagaaagaattgcgaagagaaataagctatgcaatcaaaaacatacatggtatcaggcaagtgattcacatttttcttgtcatctgttcaagctaccaaaagaaaattaatgtttataaatggctaggaaactcgtcttttcatcattgaatagggtagaatacagaggtgggagtaagaaacaggaaatcctactttggggtttaatggtaacttcctgtattgctgtagtcagttttttccaagtgaaaaagcaaaaacattttctgcatttccagcctgtactctgcacaataggggattcgcagattagcaagaccccattctccagagccttcatttttcatgagggaggccagacatgctcataattaatcattacttacaccagagaagggacagattaattttgactagtgttgtggagcaagattgggaaagattaatggaggttgttactttcaagtttatcctttcctgtggggaggatggtttcaacaggccaggaggtgttgtgtgtgcatgtgtgcttgcacatgtgggagcgtgcatatgaagtgggcagcagtgtgatgagacaggagaggatggaaggatggaatggaggttgttgaggataaaagaaagggctttccggtggaaggggtgggatgaccaaaggcaaagaggtgagcgggcacagtatatatccatggagccaagagtcatgcatatgcattgggactggcttgaggaatgcagtcaggagagcagagggacctgagctgggtggggttgggggtggggtagaacttgtgtctgaatttccccttgtttaaagtgagattattctaaattaccttccatcttagtctgtttggactgctgtaacaaatgactacagactgggtggcttataaaccacagaaatttatttctcacggttctggagtttgaaaatcctaggtcagggtgtgagcatggtcgggttctggtgagatcccttttctggcctgcacagtgctgtcttcttattctgtcctcatgtggcagagagaaagctagttagctctctggcctcttcttataagggcactaatcccattcatgagggttctgccctcatgatgtaattacctcccaaaggccctacctcctactaccatcacattgaagggtatggtttcaacatatgaagttttaggggaacacattcagttcacaacaatttctttaaagaactatgataagaacaaatgattttaaagcacatatttattcatttcatgtacagaaggctaaacataacttaatgaacatatgttgaattgcagtgtccttaattcaaggaaataaaacttaggttgcctagtacatagattgcctcatacgaaggaggtggcccctgcctgttgtcatttgtggttcagcctctgccaaagggccaagttgagactgtgctgggaacaggccctgagaaggcaaagcttgacactgagtttgcatgtgatgggtgattttacaaaggagttatgatgcttgagttatttgttgttttaaaatttagacaatctgttggtgggactgtaaactagttcaaccattgtgaaagtcagtgtggagattcctcagggatctagaactagaaataccatttgacccagccatcccattactgagtatatacccaaaggactataaatcacgctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatctcaaggacaaaaaaccaaacaccacatgttctcactcatagatgggaattgaataatgagaacacatggacacaggaaggggaacatcacactctggggactgttgttgggtgggagtaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaaagaaagaaaaaagagaaaaaaaaatttagacaatctgctccacaaatctcaaatagtatgggcagatacgagtttacaaagtgaagaggagaaaacatctataaccaaatctaacgttttttcttttaccatcgataggatttctaagctccctattctatttcttctccaccaaatccagaatacatttggtgtagaaactgttttgctttttagctgggcagatttggtatttggacatgtttatctgataaatgcagtggaaccaaattacattttttggggtcatacagtatttgaaatcagccaaatacagtatttttacttcacttgtaaaactcattaccatatacagcttttgtcaaatataactgcaaaatctcagtaattcagaattgtcaatttctgatttatatgcctaccaacaggggattgttggtggttattatatgcctgtaagatgataagaaatgcacaatgtcctgagcataagacatactcatggtatgcttatttaggcctttaaatatatatttggtttgacaatttttttttcccatttgattccattggctatttgaatagtagaagccctctttgcccatgaaggacttgatggaagagatgctttgtttttcttcattgttttgttaacactgaatgctgactatgagcaagggagggagacagtccttatggagcaaatcaagataaatagggtaacaactctccttactgtgtatcctgcaatgtgaaatagaatgctgggcttccaagaaggaaggtctcagcagcaagactggaactataagtgcttgctttgcatctgggctttaaagcacaggtgggatttgaataggccaaaattgttaacagggtaaaatgaacatcatagacaaaggcaaagacatacaatataagcaaaggcaaattgactgaaacatagggtacgtgaaaggtgaggagaaaaataactgtgaagaaagattagagtcaaacagtggaaaaattttaatattgtactaaacagtttggatttgattctgtacctcgttcagagaaattaccattataatgtagtatgattactacagttagaaatagaggtgagcatggggtgctaagcaaatgataagaaggggcgtcaagtcaagatagtataagggaagtgttgaaaagattttccaaaagaggtaccatagaattcagttgcaggaagagaagttaactaaataagaataggtggggaggggagagaagagggcctaggagtggggaggacccagtgccaaagcctggagcctgccagccttcagtcatggccaagattcaaagtcccctgttattgtagcttctctctactgaccttttgtttaaatttgagtaatcatttttcattttttatgaatcacatatacacatgcacatgtatatatctgctttcctgagctcctgttcagcatgagaaaagcattattataacaccagtttgaattaattagagcccaaaggaagacacttgttattttggttatcatttgttatttttataaattcattatttaggcatcttgaaatattaaaattaattcataactccccttactgtcttatactcccagtaccccaggccctcagattgggaactatctgtaatatagttgtcctggaatggataaattgtataatctagaaactctactattttagtgtataaaaagtgaagctcactcgctgctccacaaagggcaaggaattgattttggaatctttcagaaataggaatctaaattgagaacaccatttctattgtagcatttctttttattgctgcgaaacagcaagttaagacaaattacagttaaatattagttaaaggtcacatgatgtgccacataaacattttgggcactatgtaacttttaaacttggtctattacatgcttaatttaaatggaatgttaatttaaacatttttcaaaagatttttgaatattactcaattaaaaaaatctcatgggctgcttgctttcttaccttcaggacagggttgtttactccagacatggcatttgaagcgatagtcaagaaacagattgtaaagttgaaagggccttccttgaagagtgtggatctggtaatacaagaattaatcaacactgtgaagaagtgtaccaaaaaagtaagttcgaattatttaactttccagtacgtggctttggtttatcaacattccctatctcattgcatgattctctttccctgaccctcactttgttatagatgttgtgtgtttgcctacagggaatggttgtggaaagtactgagtgggaattgctttcatgaagggcagacatactgtcttctatcattcctaatacggtggtttagaaagagtatatttctttggctgattttccccatgttgtcttaaacaaataaacattatttccaaactattaggcaaatgccctaagctcatttttcctgtggtgcatggatgagggtaattgttagagaaggaaatcactgatagtacatatatcaataagaaaattcttctaaattgcaaatatgtattccacttgagtctggctgttctgggaaggggcagtgtagtgtagtggataagaacccagccttggggtttcaatgacctagattgaaatcctggctctgatactttctgtgtgaccttgggcttaacctctctagtcttgttaatttatctgtgaaatgaggatgatgatgataatagtaataccaccttagtgaggattaaacaagatgatgcctgaaacctatgggacacctagcacactgattaaccataatttaagtgctcaataaatggtggctgatccataaattgccattttagcagcagtcagtattctctaccctgaatatctattaaatctatgctgtagagtgctggggcaagacttcccaagtaggaggactcctcactgaggaatatggagaacatgtgctgaattcctcggttcatgaaaagaatatcttgtattgaaaaacacaaaaagagaattagtgatggtatttacagtagggtaggtctagccccctgacagttaacacttgtgcttttaatatttcttcaacctatggataattctgtttttgttagttttgttatccttccctttatagatggttactagcagttacctttctgaaaaaccagtgggaagaaagagagagaatgagagggacagagaatgagaatgaatatgaatattagttcccagttacctgacagaaaggctcaggtaaagaacagatgtacatagtagaagaggcaaatgggctgaattcctagatgtgaaggctaaaagaaaagcagtaaatggaactagcttaggacccagaggtgactgggaggttcagaccccttctctagagctcctactgctcttccacctcatttcctaaactcctggtttctcttctccaaaacaagaaagagccacaggagttaagggactgagggacagaaagaagaatgcccatggagttgaaaaaaatcaatctttctaccatctcaccagttggaaacttcaagtcagttgctaacactcctcatccctgctgccctcacctactcttcagaatgcaacctatcgtgtcccttgtacatttaaagctctcttaattgatctctctactgactttcaagattaactgatactgagtttcctactaaccctaaggattgccactctcagcacacagatgtgtttagccagaggcttctctttaggttgtccatgtctcttactcccaccaattatcctgtcttctttacaagggacagttgtgctgtgtctgttcccaaacccatttagccagttgcacttattttaataatatactttaaataaagagagtaattaaactgacccaatgcagaaaagactttgagttttgtttctatgaaaactaaactgaatgctatgaaaagacttgataactgttagctacaaaagctctgctattgactaggtgtaggcaaggtaatgaaaagaatgtgtgtgtgtgagggattataaaaatctggataggtttggcattcaaattatttcacaagtatcttcatgttctccctccactgtaaagaaagcaaaactggaaatcatagatgaaggatgtggtttatgtaagacagaagatgcataactccaatcagcagatccatatgcagagaacagatcttggccttacatcaaaagattggcacatgtgtggacatttatgttttaagttatataaagtgtttatggtatgcatgaatcttttttttttatcatttcccattttatccaacctactggaaagccaacagtcagttctgatggcatgggatgagacagcttgttcccagacactttttggcttctattcttgctctctaccctttccattatgctccttggattggtcttctatacatttttactatcttctcaaaacattttatagtttgccttagttaaacacaaaatctagcttttcccctgaggttactatttaccctttagctttcttcagtgaaggatatttattccagcctaaactggaaaaatctgagggcctttattgggtatgacatttgccatttttccttttgtggcttccaaagattattccttcaccttctcatagtcttccattaaggcccaggtggtgccagctgtacctgttccttatattcactgtcaccaccaagttccaggtcactcccttgcattcatcaggatctttagaacctggcttacatttttcctctccatacccaattcaccttcaacgtggaagtgttcagtgtccatgtagatatcatgtccaatgcctaaaagctacttttctttgaaatctttgctctccattcagtccactctagcatcatagtttcatgacttctggctcttgttgtcatcaaaaaatgttttactaggaaattgtaaaccttaaagggcctgcagaatgctgatcacccccttcatcctctttagattttaagccaattgggaaattaatggaaaagctctattttgaaggtttgaaatttagtgtccacttcactgctgacagatctaggttggaaaatgtgtctgggccttgctgctaaagtgggagcctcctgttatttccccttccagcattaaaccttagagcccacaaggtgtatgggtgagcagatgtacatccatcattagtttttttatctattacttcagttccacttggattaactttgccacctgttgaaactccaggactgctaaaatttactgcttatctttattttcctttcccccaggcttctgaagagcttggagataattgtctatttgtgtgaactggtgccccaatatattcatggtcttcttcttagtccaatttcaactgctgccccatagtgcttcagtgtcttagtaattagcagcctcctgtgttctccatgataatgatgttaaacttttagcactctcttcaagcgacctgactcatcactttcatcctcactttcaatgaaggtttcgcagaaaaaataggggccataaatgggcactatgaaacattgattcttgccttctatccctcaaacttacctgtattcacagccacacccccttcttatccttgtctctgttgagatagtattcctgatcaagggggtggggggtggtttcctatctgtactctcacctccttagaggatgtactctttttagccttttatttcctgaatcatcatcttctccatcacattttaaaaaatcaacatataaatatatctatgtctgtcctaatttaaaaagaaacagtgacaaacactcacctgctgccctatttttctcctctcatggtcagccttcttgggaaaaaagtagtttatgctttgcatctttactgtgtcatctccagttaattcctcaactgaaatttggattctaccccactactctatagagttaattattgcaaagatcagtgagagtcctgattgccaagcctaaaggacgctcttattcctgagactatattccactctctttataaagctggcactcctctctcatgggttctcttccctctttctctttattccttctctacctcctttgagcattcatccatttttgcttgcctctaaacactgcgatcccacagagcttactcctggttttattctcttcttactatattttctccttgacagatcatgtctgtaatagttcaactaccacttaaaatattggtgattcccaaatctgtacctctagctcaagcctctttatggaaactgtctacagactactgcaactattctcttttcttacttaaggccctgaacattacttttaagcctgaattattccagtggccccctaactgatctatttctagcctggtcaccctcaaattcatctttgccattgctgtcaaagtgatttttctaaaatacagctatgccttttgcctatatcctcaaaattattcaacgactcctcagagccttgaaaataaagttcagatcatttagggttgtatttaggttccctgtctgatctctgaatacttctccagctatatctttggtcccactgcttgcttcagccattctagatgatttgcactatcctcaaagatttttccttcttttgacatttgcataagtgattccttttgtctagaatgtctcactttccctcctgtgtttacctgccatcccctctcatttttagggaggcagctcaatcatcctattttccttaaaatcttcctaaagggcctctgtgagtcacttcctggtctctctcccaactccctttttagtgcttctgttgataccctatgtgtatttatatcatagcatttatgatactgccttgagatttatttgtatgtatttgtttacatatctcctcttgttgattgtaagctcctttgaaaaaaaaggcgctgtgttttttatcttctctctagcctgtaacacagtgaccaactccacataggggcattttataaatatttactaacaatttagatgttctaaagttatccagtggtcaaaaatatatatacttggttttaaaatagtattttagccattccttttaaaatgataaaatttaggcaggttttctttcaaacatctatccttttccttatgctgcattttgatgtttttcatttttggccttattaggtatactttcaatatcttttatttaaaaactggtctaattaaaatattttgcaaagcaaaataatcctaattagagttgagtctgctgggactttattacttgcctcgttttgaacatgagccatagataaggtgactatataatttattgttcagtgcaggacatttttgagacttaaagggagtgctatgaatactttcactggagtaataggagtaaacaaagactgcctcaggcaatgtgaaaataagtaattccagctatattgtaattatatatatatttctgttatagcatatatacatatataaacataaaatacagttttcatttacaactcctcatgtgatgcctcatgtgtaaaaaccttaaatgcttttttcttaagctgcataaataaacaccagtgaaaaacatatgtgatttatgtgtgttcaaacaacaaaacacaaagctagactcctaacctggggaaatgcatttcttcccagatactttctcactgttgtctctggggcactggaggataagacaggaacattagagctttatgagctatttggcttcatgccagggacatctcaactttgaaattattttggtgggcatctcttttcagctgctttcctttacctcctcttcaccagtgcatcatcacagggtgctgaaggtcttttcagaaagcactgagaggaacatcttgattttttttttaaccacagtttagcaactgtgccatttactggcctcttgggaaccgacattcttggatcattattatactaattaattgatttttttcttgtttagaaaaaaaaagttttgcaaggagaaaaaaaataccttagtcagctattagaaatacagggaaagggccaggcgaggtggctcatgcctgtaatcccatcactttgggaggccgaggcggatggatcacctgagatcaggagttcgagaccaccctggccaacatggtaaaaccccatctctactaaaaatacaaaacttagccaatcatggtggggggtgcctataatctcagctactcaggaggctgaggcaggagaattgctggaacctgggaagcggcggttgcagtgagccgagattgcactattgcactccagcccaggcaacaacagcgagactccatttcccccccgcccccccaaataaagaaaaagaaatacagggaaagattttccattaagaagtgctgttagaagaaatgccaaattttgtggcttattaggtaagtaaatatctagctctgaatacacataactaaacaagtgaatccaagtccttaccatggcttacaaggccctagacaatcttgccccctgcttttcatctctaaactcatcttctcccctttctctcctcctcttggtccactccagctgcactggattccttgtttatttagcaggccaaggaaacatgtctgtagagcctttgcacttctcattcttaatgtgggaaatgatctgccccaagatatctgcatggatcaaaccattgcttctttcaggcctctgctattcaaatgccccataaagcagagtctttctccgacttttctattttcagttgcatagccttcccacaaatacacacacacacacacaccacacatgcacaccatcgttaatctacttaccaaactttttctttgcagtatatattactattaatatattaattatattatttatgtctgctgttgctgtgttataagataattaagggaccttgagaatacaagttccatgagaataagaacttggcttattaagctcatcgctctattttccacccctaaaacagcctggttttcaacaatgattattgaatgaataatttaaaaaatgaattatgtctcattgattcagcaggtgacggtcagtttggctgaagtaggatgaaggaaaatggcttcaaagcatcatactatttaggactttcttttaggtttatatagatgtgctatggtttttacactgtatgaaaatacttgcatttcggggaggagccaagatggccaaataggaacagcttcggtctacagctcccagcatgagcgacgcagaagactggtgatttctgcatttccatctgaggtaccgggttcatctcactagggagtgccagacagtgggcgcaggtcagtgggtgcgtgcaccgtgcacgagccgaagcagggtgaagcattgcctcactccggaagtgcaaggggtcagggagttccctttcctagtcaaagaaaggggtgacggacggcacctggaaaatcgggtcactcccacctgaatactgtgcttttccgacaggcttaaaaaagggcacaccacgagattatatcccgcacctggctcagagggtcctacgcccacggaatctcgctgattgctagcacagcagtctgagatcaaactgcaaggtggcagcgaggctgggggaggggcacccgacattgcccaggcttgcttaggtaaacaaagcagcagggaagctcgaactgggtggagcccaccacagctcaaggaggcctgcctgcctctgtaggctccacctctgggggcagggcacagacaaagaaaaagacagcagtaacctctgcagacttaaatgtccctgtctgacagctttgaagagagcagtggttcttccagtacgcagctggagatctgagaacgggcagactgcctcctcaagtgggtccctgacccctgacccccgagcagcctaactgggaggcacccccaagcaggggcacactgacacctcacacggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaaagcagagtgcctctcctcctccaaaggaacacagttcctcaccagcaaaggaacaaagctggacggagaacgactttgacgagctgagagaagaaggcttcagatgatcaaattactctgagctacgggaggacattcaaaccaaaggcaaagaagttgaaaactttgaaaaaaatttagacgaatgtataactagaataaccaatacagagaagtgcttaaaggagctgatggagctgaaaaccaaggctcgagaactacgtgaagaattcagaagcctcaggagccgatgtgatcaactggaagaaagggtatcagcaatggaagatgaagtgaatgaaatgaagcgagaagggaagtttagagaaaaaagaataaaaagaaacgagcaaagcctccaagaaatatgggactatgtgaaaagaccaaatctacatctgactggtgtacctgaaagtgacggggagaatggaaccaagttggaaaacactctgcaagatattatccaggagaacttccccaatctagcaaggcaggccaacgctcagattcaggaaatacagagaatgccacaaagatactcctcgagaagagcaactccaagacacataattgtcagattcaccaaagttgaaatgaaggaaaaaatgttaagggcagccagagagaaaggtcgagttaccctcaaagggaagcccatcagactaacagcggatctctcagcagaaactctacaagccagaagagagtgggggccaatattcaacattcttgaagaaaataattttcaacccagaatttcatatccagccaaactaagcttcataaatgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcaagactgggaagaaactgcatcaactaacgagcaaaataaccagctatcatcataatgacaggatcaaattcacacataaaaatattaactttaaatgtaaatggactaaatgctccaattaaaagacacagactggcaagttggataaagagtcaagacccatcagtgtgctgtattcaggaaacccatctcatgtgcagagacacacataggctcaacatgaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaactcaacaagaagagctaactatcttaaatatatatgcacccaatacaggagcacccagattcataaagcaagtcctgagtgacctgcaaggagacttagactcccacacgttaataatgggagactttaacaccccactgtcaacattagacagatcaacgagacagaaactcaacaaggatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaattagaactcaggattaagaatctcactgaaaacccctcaactacatggaaactgaacaacctgctcttgaatgactactgggtacataacgaaatgaaggcagaaataaagatgttctttgaaaccaaggaggacaaagacacaacataccagaatctctgggatgcatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcatagcagaactgaaggaaatagagacaaaaaaaacccttaaaaaattaatgaatccaggagctggttttttgaaaggatcaacaaaattgatagactgctagcaagactaataaaggagaaaagaaagaagaatcaaatagacgcaataaaaaatgataaaggggatatcaccacagatcacacagaaataaaaactaccatcagagaatactacaaacacctctacgcaaataaactagaaaatctagaagaaatggataaattccttgacacatacactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcgtactgaatgggcaaaaactggaagcattccctttgaaaactgtcacaagacagggatgccctctctcaccactcctattcaacatagtgttggaagttctggccagggcaattaggcaggagaaggaaataaagggtattcagttaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacagaaatcacaagcattcttatataccaacaatcgacaaacagagagctaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaaggacattccatgctcatgggtaggaagaatcaatatcgtgaaaatggccatactgcccaaggtaattcacagattcaatgccatccccatcaagctaccaatgccttttttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaattggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaagggcaatcattaaaaagtcaggaaacaacaggtgctggagaagatgtggagaaataggaacacttttacactgttggtgggactgtaaactagttcaaccattgtggaagtcagtgtggcgattcctcagggatctagaactggagataccatttgacccagccatcccattactgggtatgtacccaaaggactataaatcatgctgctataaagacatatgcacatgtatgtttattgcagcactattcacaatagcaaagacttgaaaccaacccaaatgtccaacaatgatagactggattaagaaaatgtggcatatatacaccatggaatactatgcagccataaaaaatgatgagttcgtgtcctttgtagggacatggatgaaattggaaatcatcattctcagtaaactatctcaagaacaaaaaaccaaacactgcatattctcactcataggtgggaattgaacaatgagatcacatggacacaggaaggggaacatcacaccctggggactgtggtggggtggggggaggggggagggatagcattgggagatatacctaatgctagatgacaagttagtgggtgcagcgcaccagcatggcacatgtatacatatgtaactaacctgcacagtgttcacatgtaccctaaaacttaaagtataataatgaaagaaaaaaattaaaaaaaaagaaaatacttgcatttcaccccctctaatggttgccatccagtcaaactctgtgctgtgctttgcatgtaatacatgtctaatgtaataggctttagtgcccaggcttcgaatcagactggttattaaagtctgaaacttttgttgggtattataggaaattcaggcctgggacttggttttaatgggatagaatctcaccttttcatcttacaactcattaaaggatttgcaatctttataattggttcttaatttataatttaccatggtccctgattttcctcccactttctgttgtgaagtttttttccattttaactgctcattaatatgtctaccagagataaacttgggaagagagagataaaaatctggttatgatcttcaggtgttgttttgccaccatgtcaacccaccctggattcctttttggatgttttctgaattacttaagtaagaggctcttctgactactctgcggcacccaagttttattcactcaaggttggactttttgtttttgtttttctactctccttgtttcttaggtgaggacttttttgtttttattccttagcatttcataaataacactagagttctcttcatttctctgtttaaaagtttttccatcttatacctcaccacttctcctgctatttgttgaaaatatttgaggtttctggattaaggatttgcccacctggagaaggtgggctaacactagcccacttggtcccagttcacctagttgggatctggcactccttttcccttcctgccaacttcactttgaccttctttgacttctcatatgccactcatatgccaatgtagaacaccccataaggaactttcccattaacccctgtacaacttagaaaacagtcactatttcttgatctctttatattagaattgcttcttatcttcaatcacctttgtaaatgtttctacaaatacatctgtttaaaaaatttttttcatagcaaatgtgttgtgcgcagatgactgccttctcatatcctgaataaatacaacactatgctatataaaaacaaaggattgctagggattttgttgggttgggtgggtggttaattcacagaaaatgaaattaaaaaattgtatgcttttatgagtgctaaaattcattatttctatttggtttgtagcaagcagccagcatttaaaggtttatagctttttcataaaagcccttatctttaggtcagccaaatcaatcaagtcaagtgatatgtatagaagaaattttgttctgaatttattttcttagacggttacctaataactccagtctttgctagaggcatcaaacttgttcctcttgatgatatggaaatcttgcctggtctcttgaccattttgagaaaaatgtactagcatagcgtagatcttatggtctgataaactgttaatacattttggaagtgtataatttttgttttgttggatagaaatgtctcccaagtgtttttttttttctctaggaaaatgtgatccatactgaaattaaatttttatattgaggttccaccaaaataattaatcagtaccctaaataacacttacaacattggaccttattaaaacatgttttgctgctttctctcagaacatgtataattaaaatattctccttgaattaaatattgaaggttttgattcctaaagtcgtgtatattatattatttctccattgaatcttctttattatttaagaatactctacccaggctggactggtggtgggcgcctatagttccaactactcaggaggctgagacaggagcattgcttgaacccaggaggtggaggttgcagtgagccaagatgtaccactgcactccagcctgggcaacagagcgagactttgtcaaaaaaaaaaaaaaaaaaaagaatattcaatgcaatttgaactataagctatttagaactaatttgctgtataataaatgtatagctttgactgcaagtttcactattataatataagcatcaaatcctcagaggacctctcacacctggtttatgcatttatttcttcatatttcccattggtttttaaaaaatatttctcttgtatgactatttatctgtataggcaacctgccactcaagactatgtggtttctaatatcaggtgttatgatataaactgagcatggagctggactgtagcagttgcaccatgaatgactgatgtgacataaatttaggaatgtaattattataactaatagcaaatccttcatcccttgactctctataaaccaatttataggttatttaattaatcattagaggaataaaggcctaaagacatcttctagatcaatattatttaggcatacatacttaatattctgattactttgacaaataagaactcccatattcttacaactgtaggcttttaatttgacattcaaattaaaaaagtgcaaaagtgattgacaattataatggtataaatgattgaggaaatggtgattgcacattaaataagagacatagaagagaggtgagggattgaattgagcaatcaaagttaagtatgttttaaagctaagtaaagggtgacacaaactgagcagggcacagtttgaatgagatcatgaaataatctcattatgagattaaatgagataatgaaatgagtggtagaaagcctaatcagaaatcaattgaaatgtcagtaggactttattttttaacctctgtatgtatgtatcttaagaattgggactatttatatgtttgggactatttatatatatttatatattttatatttgaaagccagcagttaaaaccaagattttgactcttatactcccacaatcagttcaatatcaaccagctagtaaccaaaccagttgtttcattaatgccattcagtggtgggcctagatcctacattgcttagtgtctcttcaaggtttttcctcctttgtctccataatggtagttcttctagtgtgttctctgtttcttttgttccacttagaattcaggcttattgacttccagttgtctcaattgtaggtacaaaattgtggctcttacagattccttttctggtagaattaagcccatgggcagtaagcttgaaaagatcaggagacacacacgtgcacacaaatcaatgctcctgccaaggccagtagattggaggcattcttagatgtctctacttcatgggatattcttgtcattttggcctttccctgacttaatgatggccatatactggcctggggtccttcagctatcaagtgtttagtatctgaataaatatttatattgccactatttgatggttttaaaaataactttctgctgtaatctatttgctaaatgctgttaaagccatctcactcttccttggtagacctcaaatgcttgcgtagttacttctctgaggcaatgtgattctataatagtgtggctgtcattgaatagcttgggaagctgtctgagtgcaggcggaattgattgtcttggtgacctagggcaggctaatgtttggtgtcagatacaccactcaggtttgcactagtcaagaaggactggaattgatcagctatctcttccactctgaaggcttttataagcctcacaaaaaataacttggaggactttcagagagtcaagaggggttctggtataatagagctttttctggagaatgtttccaaaatgggaagtatgagctccatttgtatcttgcggtaattcatgaaataagcccccaggtgagcgtgcatctcaggattcagataagagggtgagaaatcgaggacctcatggagacgctggtgatgatttttgtggtaaccaaagcagtcaggtttctatggttttatgatgttatgaacataatctatatccactgttgaaatatttggaaaatgtagataaataaaagtgtgcataattcaaagagttattgctattaacactttatagtatctgtgcaaatctttttctatgcacagagagtagacttgcagcaatggaagatttaatgtatatgagatctcgtgattatgatggtttcatgaagtactgcagtttgttaacttgctaagacactaatatatgttgtgcatgctataaaggtaatgtgcacagtgacctcaggtgaccatacagaagccccatttcagggaggcctagatctaactccttatgagtttggagaaatattacatgctataatattactcaagaatgttggtatttgtaagattgggctatatccttgaaaaatgtcaagggtgtatggtggtgtgtgactctgtgtgtgtgtgcatgtgtgtgtggatgtgtcttagtccattttctgtagtttataacaaaatacctgaaactgggtatacagaaaaggaatttatttctttatacagaaaaggaatttatacagaaaaggtatttatttcttacagttatggaagacccagtgttgagggtctgcctctggtaagggccttcttgctggtgcagggtatcaatcatattgtaagggtgctgagtgtggtagcatgctagctcaggtcgctagtcctcttcttataaagctaccagtcccactcccataacctattaatccattagtccatgaatggattaatccactcatgatggcagagccttcatggcccaatcacctcttaaaagccccacttgtcaatatagccacattggggattgaattttaacatgaatttggaggaaagaaatatccaaaccaaaacattatgcttgtgcataaccacattatatatttagtagcctaattttcttcaaatagtgttgtaaatactttaccatgtcattagttattattaaaactgttattcaaaatggctacattacatcacgtaagtggatctaccttcatttatttaacatcatcagatactaggtagtttatagtttgtttatcttattgttgcttttccaactaatgctgtgatgaatgtccttatcattgtagttcagaattctgtgaggttattaggttgagatctctctctctgtctctgtgtttgtgtgtgtgtgtgtgtgtgtgtttgtgtgtgtgtgcgcgcgtgcaagacttttgatacataatgtcaaattgctttccagaaagatttctcttcttgacacccctcagcaagtttaaattgtgctaatctcagtataccctcacctgtagtaagtcttataaaaaaatagcaatttgccaatataatagttatttcttttctttgcattagatcacttgtacagtttgtttttccttctgcttattgactattaagtcttttacaaattaaatcatattctttgcctattttattgagctatctgttaatcttattaatttgcaagcactttaaaaatcatcattggaattaatattttgcctggcctaagtcatgaatgtgcccacttttctccatttccattgctgtcatcccagtagaagccaccattatttccattccatctgaattgcttcagtagcctaaattcctgatagaattgcaaggatctgcttgatgtggcccctctctacttttctagctttgtctgaggatcatactcctcagtttctgcacggactttcttttacttttatcgccactaattgcccccacttccaccatgccttcacacatgttcctgttcctggcaagcttcatcttctccacggccattctcacacacctttgcctgtctaagtcttccttctggattagggctccttaaacattttcatagcatcccattctctttcttccttatattgaaaacaactgaattaaggtattcacttttgcaaactatgttttgaacaattacctgcataatttagatggggttaagtgattgacatacacaatttccatagttttgcaaaaaaaatgtacatatacacatatattttctgtgggggagaatttaaaaagttaaaggagtctctttgtgcttcatgggatgaatcatgctcgaagagtaatggacaagaccatgggctctggagtcctaggacttaggttggaatcctgaaccaaccatttttgagctgtttagtcatgggcatgagttacttaacctctctgtgcttcacttttctcctctattaaatggggttggccgggcgtggtggctcacgcctgtaatcccagcactttgggagaccaaggcaggtggatcacctgaggtcagaagttagagaccagcctggccaacatggtgaaaccctgtctttactaaaaatacaaaaattagctgagcttggtggcacgtgcctgtaatcccagctactcgggaggctgagacaggagaatcgcttgaacccaggaggcagaggttgcagtgagctgagattgcgccattgcactccagcctgggtgacaagagcaaaactctgtctcaaaataaataaataaataaaataaaaaagaaatgaggttaataattatatctgtcttttctgattgctgtgaatagtgaaagaggtaattcatgaagttcttagcgcctgacacgtggtagacactatataaaatgttagtcattatccttttctttgtcctgttttccgacttcttcatctttgaattttattaagtgccaactcagcaggagcacagtgctagatggtatctagggttctgctttcttcctaaggaattgctctgctggttttgaagtgtttcctcaacataacaaggttacttctgatgatagtttgtgaagcctctcccatcaccttgacatccttctttaggagttgatgatatttcatttttgcttccagaatggcaatgaatatcttctgtaaaataacataatttatctctgcttcttttttggtagtgtaactttttgagtattaatactcagatctgcttttcttgacagctggcaaacttccccagactctgcgaggaaacggaaaggattgttgctaaccacattcgtgagcgagaagggaagacaaaggaccaggtaaagagaggtcttccctggtgggcagggagattgtgggaggtcgaaggtctctgcaaggttgtctggtagttcccaacagtcagcctgtcgcttaaaggaaaaaaaaatagtggaacacaactacattatgtttatttttacttatttatgaattatacacatactatattcatatcttgtttatgttaaaaatatgagcaaataaaaagacttcattcagaagaatgagatgcaaaagcagtaacaggagtttcattattttttttctcaatgctccatggatcatgcatacatcctactttgaaaaccactaatccagaaacataccacattttctctttaagacagaggttcttaacttttattgggcccacagatggactccagaagattcacaaactcctaaaacattatgcaaaatgctcagtgttttcatttttttctgaggagagagtggacctagattttcatcagcttatccatacaacctatgattgaaaaaaaaattgagaactactcttttaaacatttctattttgtgaatgtatgtggtttgtaaggagtgaccctgaaattgttttctaatcctagctttgtaatttggaaagattattttcaagtgaggataattcatttaaaaaagtaaaggactacgtggaaagaataaaaatcttcttaggtttaaatggatttttcttagttacttataaaatattataacaggaaatacaaatggttttacatacccttgaattccatgacacagctgcacgtgtgatgttgtggagagaacactggacttaggccatgtgctcgccacaaaataacatcatgttcttgtgtaaatcacttctttggactgttgttttctcatgtacagcattaatatattggtctatatgctctctgaaagcctgtgtaagttagtattacaggattttgtgattctcagatgagtgggaaggaggtgagggagaaatggggaaaaggaagaagacaaaataaaagagagaggaaaaaaccacagggagagacacacacagcacacagagtgtgcgtggggaagaggagcaggtggaggagaaaggagaaaaggaaggacagagggatggagacccagcagattgggacattcgtgagtgattccagtaaccaccttgtctctgcttgagctgtggattcattgtcactactttttatcattgtgttttgaaagttaattaatcaccatttatagttttcacttgtttaccaactttcacagtcttggatagctgcaatagccaaaagaggagaaaacaggctttgtgattcagttgagatgaacaaatcagtattaactcctgagtcagtgaaatcaagcctagagccagatatggagccctagggccagaggttctccctaatgtctaatgtcttggcccctcctgggctgagaaaacttaagttcttaagaatcagctgtactcctgaccttaagtaaataagctaactgttttaatttagtgttttcatctataatattcaaatgataataaatcctacttaactctttaggatccgctgtcaaaataatattggagaaaatataggataattatttaaagcattttaaatatttgtaatcatatctatgtcagttgctagcttcttcatatttcagagtttttgttttagtaaaatggcatgttcaaacttcaccatgttgttaagattgtgggctctgggctcagactacctgaatttgaatttcagctctgttgttaacattttgtgtaacttgtgacaagttatttgacatctttacacttcaattttcgcatcttaaagtgagacaatagtggtagttaactcacagacattttgtgaggatggaaagaagtaatcaaaatacaaggccaggtgtagtggctcacacctgtaatcccagcacttttgggaggctgaggcaggcagattgcttgaggtcaggagttcgagaccaggctgggaaacatggtgaaaccctctctctacaaaatattaaacaattagctgggcacggtggcctgcactaccagtagtcccagctactcggaggctgaggtggaaggatcacatgagcctgggaggttgaggctgcagtgagctatggtcatgccactgcactccagcctgggtgacagagcaagaccctgcatatatatatatatatatatatatatatatatatcttagttcttaattaattttagttgtttttgttgttattcccaaagagctatggcacatggtagattcgaggaagaattgccttttctgattccaagggaaattgttttcaatctgcaactcagttacagtggttaatttattcctcaagtaggacataagggatggagcaggcatctccctactaagtcacagtctcaggtggtgtggtccaacagttatcaagtgcctgtcaaagctggtagtggtcacctctaatatggacttgtgtggcatagcagaaacatgcctggttttggtagtgtggacatgtcattttggatggatctcgcatttgaattctggactctgctgcctgggaccatgtggtacttttaaagtatccagttagacagagtgacccatatcctcaggcctccgcgcctgaacagctctgggacattcttgcagttttatttctttctttaaaaagtagagttactaccaacttctgctctggaagctttgtgggaaaaaaaaatcttcaaaattaagaatatggaaagccataaatctgtctgtagctttttcttaaacaaaggttttttgaatgtctgagtgtgccagctgttagtcttggtgcttccatacatgtcactgcatgttgaagcagtggactttctgggcaactactgctaccaggggtagctttactttgcttcaactaaatattcaataactgtggatgaaaaaggcagtgagaaactctgagaaagtgaaaaaatgagaaaaaaatggattatttttcttttcatcccccacatgcgacctggctcttttcctagagtgaacacagactcccagtttccaggaatataatgagaacagccatagcttttattttttttccactttttttcctatactacagtccaagttaatgtgtgtgaacgtccaaaagctattcatgacagcctttggcaatgttgagaattatgtagatattttgctccttatagtggcaacaatttatttgtgttcaaatattacagtttattggtacaaacttttggccaaatggatttggagtatacaatttaactgaatctggctttattgttgggagaagagaggcaaaactacaactaatccaataatgatcacgcttcctaatgtttcagttttcttcaagatatgaaacaaaactctgactgtatgaatttttttcatacaagtatgatgttattgacctaatagcccccatgccttgactttatttttggtagtgggagtagatttggagtgatcttttaaatctttttttgacaggtccccttgtgactctcagcaagaattggtcagatgactggttgagattagccacaaaaacaaagcctccagcctatagcactgggtactgagtacaaaacaagaacaagtggccacgtactaattatatatatgtatatgtgagaataaatcactccctggaaagttaactgttcttggccaggcacggtggctcacgcctgtaatcccagcactttgggaggccaaggtgggtggatcacctgaggtcaggagttcaagaccagcctggccaacatggtgaaatcccatctctacaaaagtacaaaaattaactgggcatgatggcaggtgcctgtaatcccagctacttgggaggctgaggcgggagaattgtttgaacccaggaggcggaggttgcagtgagctgagattgcaccattgcactccagcctgggcaatagagtgagacttgtctcaaaaaacaacaacaaaaaaaagagttaactgttcttcaagcctggtagatagttacacaaataaggccgcaaatgtttattgggcacctattgtgtgtatcatgctaggctctaagttctaaggataaaatggtgaacaagataaacataatcctagcttctatggagtgtacattcttgcagagaagagaaatattaaaaaaaattaataattaattacatttgtagtaaatgccacaaataagtatagggtgctatatagatatacacacacatacacaaacacacatatatgtatatatagtgtatatatacatgtacatatatgtatgtatgtatatatgtgtgtatttacatgtacatatatacatacatatacgtatatatgcttatatgtatatatacacatataagtatatgtgtacatatttgaacatatgtgcatatgtgtacatatttgaacatatatgcatatgtgtacatattgaaacatatatatgcatataggtatatatgtgtatatagcaccctatattttatagaatacataattttacgtatacataattttatacatatacataattttctgtatgtatataattatggcacatagactatttgagagtaatagtacaatccaacctggtcttggttgggtaggggataaggatcatggatggctttcttgaggaagtacccactggggagcattatgtagaatatgtctatgaactgttgccatgaggactctgatgcgttcaaatgctaccttcaatgaagggaggcagcaaacaaatactcacaatagtcaccaaaatttatccaacaaagttgaagagcagagctctggagatattcaggcagagatctgtaagcaccgtatttctcccttttagcaaatctcagcatcctggaaagagacaggattcagttgggagaacacaaggaaacgtagaaagaggaagtcagttttgaatatctctggtataataccttcttttttgcaggttctggttgctccacttctctcttgttttctgtcagcctcctcgtctccccattgaatactatttttcacagaggcacctcccaagtctctgacctagagattataagtatcttatatttagaatattttcatgttgcctgggacatgtatccagtttactccatcacaaatcttcatttaattatcatgatgtttcaggcactgttctaggcactggagatgtagcagtggatacaacagatgaggtctatataagaaatatgtaaaaacttgccatgttagctagtgttagtgctacaaaagaaaataaggcagggtaacacaatagagagtaaccagagtgctagtttaaatagaatgggcaggaaaatccctctgaggagtgatattctagcaaagatctgacattattattattattatttaaatttattatactttaagttctgggatacatgtgcagaatgtgcaggtttgttacataggtatgcacgcgccatggtggtttgctgcacctatcaacctgttgtctatattaggtatttctcctaatgctatccctcccctagccccccacccccacaacaggccctggtgtgtgatgctcccttccctgtgtccacgtgttctcattgttcaactcccacttatgagtgagaacatgcagtgtttggttttctgtccttgtgatattttgctgagaatgatggtttccagcttcatccatgttcctgcaaaggacatgaactcatccttttttatggctacatagtattccatggtgtatatgagccacattttctttatccagtgtatcattgatggcattttggttggttccaagtctttgctattatgaacagtggtgcaataaacatgcgtgtacatgtgtctttgtagtagaatgatttataatcctttgggtatgtacccagtaatgggactgctgcgtcaaatggtattgctggttctaggtcattgaggaattgccacactgtcttccacaatggttgaactaatttacactcccaacaacagtgtaaaagcattcctatttctccacatcctctccagcatctgttgtttcctgactttttaatgatttctattctaactggcgtgagatggtatctcctcattgtggttttgatttgcatttctctaatgaccagtgatgatgagcttttttttcatatgtttgttggctgcataaatgtcttcttttgagaagtgtctgttcatatcctttgcccactttttgattttttttttctggtaaatttgtatacgttctttgtaaattctggatattagccctttgtcagatgggtagattgcaaaaatttttttcccattctataggttgccttttcactctgatgatagtttcttttgctgtgcagaagctctttagtttaattagatcccatttgtcagttttggcttttgttgccattgcttttggtgttttagtcatgaagtctttctccatgcctatgtcctgaatggtattgcctaggtttccttctatggtttttatgcttttaggtcttgtgtttaagtctttaatccatcctgagtcaatttttgtataaggtgtaaggaaggtgtccagtttcagtcttctgcatatggctagccagttttcccaacaccatttattaaatagggaatcctttccccattgcttttttttggtcagatttgtcaaagatcagctggttgtagatgtgtggcattatttctgaggcctctgtcctattccattggtctgtatatcggttttggtaccagtaccatgctgttgtggttaccaaagctttgtagtatagtttgaagtcaggcagcatgatgcctccagctttgtactttttgcctacgcttgtcttggctatatgggctcttttttggtttcatatgaaatttaaagtagttttttctaaatctgtgaagaaagtcaatggtagcttgaggggatagcattgaatctataaattactttgggcagtattgccattttttcaatattgattcttcctatccatgagcaagggatgttttttccaattgtttgtgtcctctttgatttccttgagcagtggtttgtagttctctttgaagaggtccttcacatcccttgtaagttgtattcctaggtattttattctctttgtagcaattgctaatgggagttcgctcatgatttggctttctgtttgtctattattggtgtataggaatgcttgtgatttttgcacattgatttttgtatcctgagactttgctgaagttgcttatcagcttaaggagatttcaggctgagacgatggggttttctaaatatacaatcatgtcatctgcaaagagagacaatttaacttcctctctttttatttgaatatcctttatttctttctcttgcctgattgccctggccaaaacttccaatactatgttgaacaggaatggcgagagagggaatccttgtcttgtgccagttttcaaagggaatgcttccagcttttgcccattcagtatgatattggccatgagtgtgtcataaatagctcttattattttgagatacattccatcaatacctagtttattgagagtttttagcatgaagggatgttgaattttattgaaggctttttctccatctattgagataatcatgtggtttacgtcattgattctgtttatgtgatggattacatttattgatttgcatatgttgaacctgccttgagtctcagggatgaagccgacttgatcatggtggagaagctttttgatgtgctgccggattcagtttgccagtattttattgaggattttcacattgatgttcatcaggatattggcctgaaattttcttttttgtgtgtgtctctgccaggttttggtattaggatgacgttggcatcataaaatgagttagggaggagttcctctttttctattgtttggaatagtttcagaaggaatagtaccagctcctctttgtacctatcacagaattcagctgtgaatccatctggtcctgggctttttttggttggtaggctattaatgactgcctcaatttcagaacttgttattggtctattcagggattcaacttcttcctggtttagttttgggagggtgtatgtatccaggaatttatccattttttctagattttctagtttatttgcatagaggtgtttatagtattctctgatggcagtttgtatttctttgccgtcaaaggtgatatcccctttatcattttttattgtttctatttgattcttctctcttttcttctttattaatctggctagcagtctatctattttgttaatcttttcaaaaaaaacagctcctggattcattgattttttgaaggggttttcgtgtctctgtctccttcagttctgatctgatcttatttatttcttgtcttctgttaccttttgcgtttgcccttgcttctcttgttcttttaattgtgatgttagggtgtcgattttggatctttcctgctttctcctgtgggcatttagtgctataaatttccctgtaaacactgctttaactgtgtcgcagagattctggtacattgtgtctttgctctcattggttgcaaagaacttatttatttctgccttaatttcattatttactcagtggtcattcaggagcaggttgttcagtttccatgtagttgtgcgcttttgagtttcttaatcctgagttctaatttgattgcactgtggtctgagagactgtttgttatgatttctgttcttttgcatttgctgaggagtgtatttatgtggtcagttttggaataagtgtgatgtggtgctgagaagaatgtgtattctgttgatttggggtggagagttctgtagatgtctattaggtctgcttggtgcagagctgagttcaagtcctgtatatccttgttaaccttctgtctcgttgatctgtctaatattgacagtggggtgttaaagtctcccagtattattgtgtgaaagtctaaatctctttgtaggtctctaagaacttgctttatgaatctgggtgctcctgtattgggtgcatatatatttaggatagttagctcttcttgttgcattgatccctttaccattatgtaattaccttctttgtctttttgggtctttgttggtttttgttgttgttattgtttttttagatggagtctcactctgtcacccaggctgcagtgcagtggcgcaatctcagctcactgcaagctccgcctcctgggttcacgccattctcctgcctcagcctcctgggtagctgggattacaggcacctgccaccacacccagctaattttttgtatttttagtagagatagggtttcatcatattagccaggatgttctctatctcctcaccttgtgatctgcccgccttggcctcccaaagtgctgggattacaggcatgagccactgcacctggctgggtctttgttggtttaaagtaggttttatcagcaactaggattgcaaccctgctttttttttttttctttccatttgcttggtaaatcttcctccatccctttattttgagcctatgtgtgtctttgcatatgagatgggtctcccgaattacagcacactgatgggtcttgactctttattcaatttgccagtctgtatcttttaattggggcatttagtccatttacaattcaggttaatattgttatgtgtgaatttgatcctgtcattatgatgctagctggttattttgcccattagttgatgcagtttctttatagtgtcgattttttttaccgtttggtatgtttttgcagtggctggtactggtttttcttttccatatttagtgcttcattcaggagctcttgtaaggcagaactggtggtgacaaaatcactcagcatttgctagtctgtaaaagagtttatttttccttcacttatgaagcttagtttagctggacatgaaactctgcgttgaaatttctttaagaatgttgaatattggctctcactctcttctggcttgtagagtttctgcagatatatccgctgttagtctgatgggcttccctttgtgggtaacctggcctttctctcttgctgcccttaacattttttccttcatttcaacattggtgattctgatgattatgtgtcttggggttgctcttcttgaggagtatctttgtggtgttttctgtatttcctgaatttgaatgttggcctgtcttgctaggttggagtagttctcctggataatatcctgaagagtgttttccaacttcattccattctccccgtcactttcaggtacaccaatcaaacataagtttggtcttttcacatagtcccatatttcttggaggctttgttctttccttttcattcttttttctgtaatcttgtctctacactttactacattaagttgatcttcaatctctgatatccttttttctgcttgatcgatttgcctattgatacttgtgtatgcttcacaaagttcttgtgctgtgtttctcagctccatcaggtcatttatattcttctctaaactggttattctagttagcaatttctctaacattttttcaaggttcttagcttccttgcattgggttagaacatgctcctttagcttggaggagtttgttattacccaccttgtgaagcctacttctgtcaattaatcatactcattctttgtccaattttgttttcttgctggcaaggagttgcgatcctttggaagagaagaggtgttctggtttttggaattttcagcctttttgcactgtttttttcctcatctttgtggatttatctacctttggtctttgatgttggtaagcttcagatggggtttctgtgtggacacctttttttgatgctgatgctgttcctttctgtttgttagttttccttctaacagtcaggcccctctgctgcaggtctgctggagtttgctagagttccactccagaccctgtttgcctgggtatcaccagcagaggctgcagaacagcaaagattgctgcctgttccttcctctggaagctttgtcccagaggggcacccaccagatgccagccgggggtctcctgtatgaggtgtctgttgatccctgctggaaggtgtctcccagtcaggaggcacggaagtcagggacccacttgaggaggcagtctgtcctttagcagagctcgagcactgtgctgggagatccgtcattctcttcagagctggcaggcaggaacatttaagtctgctgaagttgcacccacagctgccccttcccccaggtgctctgtcccaggaagatgggagttttatctataagcccctgactggggctgctgcctttctttcagagatgccctgcccagagaggaggaacctagggaggcagtctgactacagcagctttgttgaactgtagtggagtcctcccaggtcaaacttccttggcagctttgcttacactgtgaggggaaaactgcctactaaagcctcagtaatggcagacgcccctcccccaaccaagctagagcatcctaggccaacttcagactgctgtgctggcagtgagaatttcaagatggcagatcttagcttgctgggcttcatgggggtgggatccgctgacctagaccacttggctccctggcttcagccccctttccaggggagtgaacggttctgtcttgctggcattccaggtgccactggggtatggaaaaagaacttctgcatctagctcagtgtctgcccaaacagccccccagttttgtgcttgaaaccctgggcccttgtggtgtaggcacccaagggaatctcctggtctgcaggttgcgaagaccatgggaaaagcgtagtatctgggccagaatgcaccattcctcacagcacagtcagtcatggcttcccttggctaggggagggagttccctgaccccataagcttcctgggtgaggcaatgccccaccctgcttcagctcaccctccatgggctgcacccactgtctaaccagtcccagtgagatgagccaggtaccacagttggaaatgcagaaatcacctgcttctgtgttgatctcactgggagctgcatactggagctgttcctatttagccatcttaccagccaccacctattattattaagagatggggtcttgctatgttgcccagactgaaatgcagtggctattcacaggcctgatgatgactcactgcagctttgaactcctgggctcaagagattctctcacctcagcctccagagtagctgggactataggcacacaccaccatgcccagcttctgattgatgtttggattcaatgatttatttgtatattgactttttgagttggctgatcaaatgctttcctgaaatgtgtaaagtgtcttgagatggttctttaagctgctaaagatagaagaggagagagaaaaaaagaggtgaattactaatttgtggctaatatatgatgtctacaggaacagtaagctcagcgcaacccctcatgggacctcctgccacacatcttatttgtgcttgtccttcttttgaacagtatgcctacattttagagaaatcaaataattctagattctgtattaaggtagcaaatagtgtatgcttataagttataatgctattctcttcatctgctgctcagatttacttttctagtagatttttaacttatgaatttagagtgcaaaattatgagtctaataaagaaaagttaaggttacttttcatgctaattgaagtatcctttaaaaaattatatgaaggtaattaatttgtgggcaattactgaatttaatgtttgagaatttttagatgggttttcactgaagtgtttctctttgacttataggtattgctattgattgacattcaagtctcttacatcaacaccaaccatgaagacttcattggcttcgcaaagtacgtgaaacacttgatggccacatgcattcctcctgttgatttgtctcaaacacacattgtgaatttttactacagtttcaccacctttgagaatacaatctgtgccaggattaactctcagtgtgcctacttaggaagtctgagctccatggtcgtagggcagggatatttactattctctcagtaaagtagttggctctattatgcagcatatgaagtcatgtatgtcttacatacttatcatctcatcatttttggatgatgttctgcagtttgtacttgaactcctatagaaaaacagtaattaatgcatgtttaaaattttgaggggaacagtttttcacatcaatttgaaataccacatgtaatttacaggatgaaagatgtttcaacttttctaagtcagaatctagaggcctgttttttttttttttttaaactttgcgaaattagatgtaatctgtcggggtgaacattttattttctgtaaagtgtgtatacaaatattgccatttttcatatacgttatcatgcaaacgttatggttagttactcaggattggctattcactgtgtgacattttgaagaccttgaatgcactatcttttcctgcccattagtgaaaccagtttttgatttaaataatcttgatatcacctctaaaatatatttttgcatttaagtggttccaacttcaagtatataaaatatagcctattttatgtaaaatgtaaaacaaaagagcctatgtacttttacttaaactgagtattcaagaacagagacaaataaaaaaatgacagaatgtcaaattaatttattttattacattctgacttagaagaaatggatatgcagaccctgtgacctaaactaaacagtggcctgaggaatttacaggcatgttttagggagaacagtcccaattatccaactgaaaattatctcatcctaaacttggctgtggttgtgatgtcctagccaattgtgtaaatatcttttgcatccaatgacgattactagtgaagggtagataagatttcttccaccattttctgtctgtggcatacgtgtattcttgttagaacccaacgataaatatgtgccctagtctagttgtctttgcagccaccctgcccacacccacttcttgataggtatttgctgcacaggcatttcgcacagacttgccctcctctcttttagccccaagactctcaccatgtgttctgttcatttccttctgcagactcacctaaactgtaacatacatccttatccctaggtccagaaattttttccaggtttcctccacagtcagtgaactctagggagcctgtgccaagctctactctagtttctatagtgggtggggggggaatgtagaaaaagaaaaaaactttttgccttttaggagcttgccaaataattgaaaagtatagagacacacaagtaaaaatttaaactgacacattcttcattttcctcactgcttctctgaggaatttaaaagacaaacaaatccttgagacatttaaaataataggaatgctgcctttaatgttgattttcatggattacaaatgccagttaggttcttacaaaaatgtagcagatgtcgatgtaaacttgacacaataacttaaaagtgaaaaggatgctgccttgttgtggtaccacaattagagggggaaaatgtagaaaaagtcataatccatttagaaaggttcaaatttaaacatattatataacccgtgcttcaatttaaatttcacctttataatcttcttgaaactttttttttctatgataaatgagctagagtttcttttccaataaatttccatatttgctgccttagaagctgttggactatggttttatattgattatattgatttataggtttccaagggcaggtgatttttcaaatttaagactttcaaacacaatcttttgacgtagtctctctgtgtctggtcctatttttctggtccaggtgtctggtcctatttttccagcagtgagatagactatgaatctttatgatattggggagaaaaaaagaagcataggtaaaactgctttagaaagccagcaactctacacatttctcatctaatttaaattgcacacttaaaccttctttaaaggactgatctgggagtcaacaatccaggttgtttttccaggatatgccactgatgagctttgggttttggcaaggtgctcagcctttctctatctgtttactgatgtatcaaatggaataataatccttgtcttgtatacctttcaggattgtcagaagatcaaattaatcaagttatgtggaaatcctttaaaaaaaactatggtgtagtctataaatgtgagagatcctccctgtctctcactctctccacatacatgcacgtgtgcacacatacacacacatacactcacatttgattactagatgtaccattttactttatgatgtagttataatgacttaagtatgattgtcactggaatattttttagctgctaatatcattatctctaaatgtgatattttgccccaagactcagagataaatgtcctttccatttgtatgtcgacttggaattgacatggggtgacgtggagtgattatgaagatgaagaaatgttcatttcaaaatcactttgaggggttgtggtattttttgtgcttttaaaaattaaaaaaatatggttgtagctataaattttaaagttggcaagaatgctgtttccatcaaggaagaaaagtcaagccatatttgaagacaattatgtaagtatttttaagttccaaagacagaaaattaaggtctggggttgaagaaaacaagcatttgtttcatgagatttttagagagttgccaaaagggaaggaactgcctcccagatttataggatggtgatgtacatagtactttacacatgtaatttttttcaacttggatgactttttgttctaattttttaaaaaatgaaaatgaattgctaaaattggattaataaaatatttactttcagagtagcattcaggacatctcaaaattcttctttctgttatagaatttatactgtcatgtttaatatgtgacactttttttccatcttctagttatttgttagacatggcctgtaaaatatgtaccgtgtgtaatgtgtccaaataagcactgctctaggcttgctttggaatttcctggcttctaaatgttttttcaactataatatagtttctgagcctgaaagttcagcatttcagaagaaaacgtcaaatttctttgtgacttaagggttttaatttgtcattctctgctttagaaaaaaaaaaaccctaaattacatatatttttacataatatagctagtttttgctatttaagaaaataagaactggcccaattgttccttcattcacttcccctcgtcctcagtaatcctcttttgaacaaaaaggcaatcttgttagtggaatgccttgggaagtgaaatttcaaactcctctgctcttcttcatttgttccatgacacaatttgctttctgagttactaggatttatgcagtccaatggttaaagagaaagagggactatagatatgtgccgttagagtgatatctctatacaccgcaagcagcagaccaaggtctgtttgtttttcaatctgctcagtaggtctcaacacctgttttctcacagttgaaatgatacagtgtgcagatttcagttcttgttatttgagcaccatgaaaattctatgggtcttaagatttgttatatctttttcctgatcctctggaatgcctctattgccgttttactgaaggcagtgcatttcaaccttgccactaaattccagagcaatcttagtctttccctttacattcttagtttatttttccctaatgcataattatattctattgtaataatgtttctagttcctaatcttacatgagaatgttctctctcttgtggaatcaaaacttaggtattggagtataaaaagatcctttttttgacttatatgcaaatttaggaattaaatgcttggttgcttactgagattgttgtcaagtagaaatacaggattgagcaacttgaaaggataccattcacatatcctgttcaaataagttataaattccaatgttccaagcaccattttaaaaataagtagacttccagttttctctttcatcctcaaatatgttattttaaacttcatcttcatccttaacatgaatcttaggaggtaagtgattcttcttttgcagactcccaagttctgtaagattttcttgcataatagcctgagccttcattaaagatcctggaggagaaacggacattgtttcttctccctttggcttcagtctgattggacggagcctggactatcacagtgtaacctgtgataagttacactcttgggactcttgtgaagtgttcataatctttcttggataatataaaagaacagtctaaaattgctttactctgtagcaccattgcacaatagaactttctgagatgatggaactattgtataatctgtgctgttcaatacagaagccactagctgtatgtggctattgagcagttgaaatgtgggtagtgcaatgaaggcaataaatttttaatttaattcaatctaattaaagttttaatctggctaccagctactgcattggacggcagagccctacagtatagtgactccggctgatggctctgggaccttcactgtgggtcctactttattgacagcttagtggtgacctatggtggtagctactgagagaaagagcaaggaagcctcttaattgctactaaacaagtctaaaagagcttctttactctatagcactgttgcacaatagaagtttctgagatgatggaactatcgtataatctgtgctgttcagtacagaagctactacctgtatgtggctgttgagcagttgaaatgtgggtagaggtagaggcacactctgatatttgctatggaatctacatctcaaagggactctccatttccttaatgcatctgagccctctttgagtggccttagtctgtgttccattctctttttcatcttcctttcacttttcggcccactgcaatctagtttctaccactccactccactgagactgcttttgtccaggacaaaacagttaatccaatggacaattctgagcctttcatttgacaccaccgttaatcactccttcttgaagagatctgttcctttgcttcaataaccttccactctctcctggttttcctcttttcactctagccacttctcagtctttaggagctcttcatcttctgatcatggcttaagaactattctttaatcaattttccaccctagacccccttctttctcactcactgcattattcctaatggatcttacccactccaatggttttagttgccaactttatctgatgactccaaatctagatcttcatttcaagacttttcactggactatgtaccatattcagatgtctattggacatctctacttatatatcctagagaagcctcaaccttctagtcccaaactaaactcctcatctgctcttataatttttaacttctatgttgttcccactttctgtggatggcacctcccagtcctattctttgctccttgttcccctcatatctttgtctccatccatctttaccaagttcatgtgattctatctccataatattttttgaattcatctatttctttctatcatcattgccactactaaagttagtcttctcttacttgagttactacaacagtctctctgtacccctgtcatcctctttctcattccttctgagattctctgttactttcagaataaagtctaaacttattaatgtaatttccaaggctctctataatctgtatcttgtttacctcttcagcctattctattgttactattcctttctactctactccctaagtccatgctgcagccagtctgaccactttgggatccctaactgtaccatacttttgctttaacacatgcctatgatatgcttcttcaaattatttaggtttcctagtacagatgatcattgatagtctggttgtaaataaccctggcatcaaaacagaattccatacgtatttcttaagatactaccataaaccctctgctaggtaatgtcagtgatgagagaggtagaaataccaagattgatgctcttgactatcaaggagcaggcattgttggaaacccaacttacaatcttgtttataaaatacaggcacagaccaaggctttgggagtgcatgaaaaggagagataactggaggtttctaaaaaggcataattcaggcatgatgcttgattggagttttaagactggacaggactccaatagtcagagacagggggtctgggctgactgcttcctgtcttctctgcttgagtcaatactatgcatttcagggaactaatttgtactaaaacattgccttgatcatgtcacttgctggcacagaaacatggaatgttttctgctgccttcagagtaacagccaaattctccataactggccccaacgtacagttattatactagatggcttttaagatcacttacaaaccccagtctatgattggataattctaccataatagttttactctccacaacttccccatatgcctcatctttctacttcctggctttgctaataccagtctattctcttggaacgtagtcatttgttttcctttattaaagtttatcttcttttcaagtttgctacaaacagttcagatcatatcatctgaaattatatttcttgtccctgaacattcagagaaattacaatggtataggatttatttgataaatggtcacacatcatagacaaggataggacactgtgcaaaaaagttttgagccaagagataacattaggggttctctgattgtcttctaatgtactcttatttttatagaagtttaaacttcttgttatatacttttagaatcattatgtctcagcatacaccaatttggttctacgttttagtgttctggcaaagccttccacagtgacttgtgtgtagtaggaatttatatgacaaacgacaaatgtgcgtgcacacacgcacacacatatgagaagatatgggtaattatatcccacatttaaaacagaagcactttgtttttgctttctattacatcctcacatgtttattaatatggattttattttttatttgttatttttgttttgtgtatgcatatcattacttgtaccagacaaattgtaggcttttgataacaagaactataccttattcatatttttatatgctacggagttcgtgccctatagtttttgatttatgttaaactaaaacaccatacataggtatgttttataatatttcagagttaattggttaagtaactatatccaagaacatgtccaagggctcaagttaacttgcaagtccttacaggttttttaaggaacatatttttaaataaatgttttgaaatactctcagttcaattattatgcagaagaattatgagaaagaatgtattctaagcaggcagctttttttgttgttgttgcttttgaagtaacttcaagtagctaaatacatcattagcaacagaatgtttaagtttatggggccaattgctgcaaaaagattctttaggtggaaaatagaggcaacttagtgttttttctaactctaatatttgagattggcttataaagtaaatctacttttcctttggcatattcttacaagtggtagatcctaaatatgcattatttcacagatggaaactgtcaatggacattgtctttatctagtgtagcttataagcttctgagagtaattttgcatctcaaggaatattggacctaaaaggaacctaagaaacaacttgtttagtcctctagccctcctctctgtctctgtttctgtctgtctcctttatgacacacatatacacattttatagctgagcgactgaagtccattttgatcaaacttttcacctaaggtagcaaaggagtcattaacgatctttgcggcttttgctttacattcaacttcttttcccttaagtgatttgaaggggactgatacataattttagggtctacaataatttgttcaaaggaagcacctgtgggtctatcacaggttttcaccactagtcagtgtttcagtgaaaacattactcctaaaacacaattatggtgcttggaagagataaacataacctatgaaggtgtcatgatctcattataatagtagttttctcatgcattcctggaagagcaggaagcctggagggtgctggaaaagtgacatttaatgtggaaaaagaaagtaaggaggagatccgaagcccttaggagagtgctactcaagacgctgtgtgcgccagggcatgagggcagccagagggcggtgtgggcacattggatcctggttacctctttcacagcctcacctacaagacctgaataatgtagatttagattgttcagagaaatggttaaagaggaaataatttcatcgtaattaagaggattaaccatttaacagaaagctggaaaaataaaaaacaaggaaggaagaagttgaaattagcaaattttaaattggaaaaaaatatatacacaaaatatttttagcaaccaaatacagtatggcctttcaccacccaccccctgcccaccttcagttgaatgcagtgttttttcatgagtttgagtgaaggaaagcagcttaaatgtatcagaggagtttattaaaaacttattttgatcagctgttctaagtgtggtgttgatttctaacttgttactgcagcacaacatcccatcactttaaacagttgactgagagctttagtctcccttttctctattttagaccatttcattgatctccaaaacagcttccataaactattaaacaatctgtaagaatactgagtattgctgatcttcccagaataaccaaaatgagttgtgtttcttatattgatacgtgtttattcatggatccaccaaaagaaagcctttgtccttttgagggatagagtaacctagtgatgaaacgtgtgggctctgttgttaagttgttggagtcctttctggcttttaaccctctgtgcttatgtctaaaatgagggttataatggcatcaacttcattgggcttttcatcgaacagatatttcatgaaaccaaccatgtgccatgtcctttgcaggccctggggatatagcagtgaacaaaacagacgcaaacccctgctcattaggagcttacagtctaatggaaaagggcagacaaacacaaaaaataaatacaccgtgtagtgtatcggaaggtgagaaatgccagacagaaaaatcaaacagggtaaaggggatgatagtcttggaggaagggagggatgcggttataaatagggtggtcagagtagtcctaactgaaaagaaggatttgaatgaagacttgaaagagatgttgggaaccatgcagatgaaagcgggaagtacatcctagggagctagcttgcctgaaggctctaaatgggagtgtattgggtgggtttgaaaaagagcagatgccagtgtggctggaactcttcagggaacaaggtgaagggtaggaggagatgagtcaaagaggcagtagtgggggttgcttgagtagggccttgtagacccttgtatggactttggtttttaccattaaatggaatggtgttgatgcagtacacggtttcgagcagaagagttaacatagtccttctgaaagtatcactctggtgtctgttaagaatagacttcagggagacaagtgtggaagcagagaccagagaataaatgattacagtaatccagatgagggatggcagtgtcttggaccaaggtgggaccaatggaagtgatgaaaagatggttaaatgttaaatttattataagaaagtagtcgacagcattttctgatggtcggatatgggttgtgagagaaagaggagacaaagattttggccaaggaacttgaatgtatggtatagaattgccattagttaagaggaggaaggaagactgtgggtggaacagattttaggggggatttcaggagtttagttttgaaatattaagaatgatatgcccattaaatacccaagtgatgaggttaagttgttaaaaacatcaataagtccagagttgggactcatacatatttggatctacatggcagatccaaaccagagatgcattaaaggagttgtcagaatatattggaattcaaagcagtgagactggacaatatcacaaagagtttgtgatgcggagccatgctacttggtactaccacttattagctgagtgattttgggaaagtcacttagcttctctcctcatctatgaaacaagaagaataatcgtaactgcttcatggggttgctgtgagaataaaaatgattaatatcgataaagcacttagaacatggcatatactcaataatcattaacttaatttccattacaactctcctctgtacctgtgagacactgcaaatatgtcaactcgtatgttattaatgttacaatgcagcttttctttaagtggtgttattatatttttggtttatatgctactaggagttatgtgctattaggagtcccattgagttggttttgcttccagaattaaactgacctggaattttggtattaggtctgtctccattgattttttttttaaagcctgtataaattttagtatttgttacttgtttaggaaaaaattatatgtgtctcttcagtgctgctttcctttgcttttctcagtgctcagcagaggagcagtcaggttcacaagaaaaccacagttggaaatcaggtaggaattgcataagagaatcagtgtatgcatgtcccaaagaatttgaactaaatcgcttgattgactatttttttaatgcaaattaatcacgtgcaaattttgcttgaaatgcagctttcattttgatttgtttttgcttttaaaatttttggagtgaattgcatttctttttggctattttgtgcagttaaccatattgatttattttaaataacctttctgctacttgctctgcatttcaaatttgactcctcatgtcctattttgcttgcttacgttacccctaagtttaatttaacattgagtttgtgagtcagttgaaggttaaaatgtggtgagtagttgcatgagctttctggggttgctaactagttcacacatttgcacagcttggtatcagtgaagggacagctcatgaagaacgcagttgttggatgtaatctctgccacactaaattcttgttggttaatgaagatgttaattcctaagaagatctgatcttttgagtttttgtgttttgggctgaccagctgtctctgactaatagcgctctgcagagattgtattaactcaacagtttgctgtgtcttttatgttttatgtgataatgaatatttgcattgttatttcttttcaagtcaaaacaatgatggtgttatagtttttaaaaaactttcagaggtacaattattgaacaaattgaaacctctgctctagatttttttcccattgttttgaaaggagaagaggtaataacagactttattttaaaaactttttttctgaactaaagcatataattctttgctatttcagggaaccaatcttccgccttcaaggcaaattgtacgagctaagttctgtaagctttactgttgctttttcatttagcttcccaagggcacagtttgtctttaactgattaactcaactagcgcttgctactaattttttttaaacttaggttgtcttgtccgtaacaccctatcattgaaataaaaatcctcttaagagggttcatcccttcactgctaataacttgctgtgattgaaaggtatgaactagtaaactctaaaatgctgtaataataaacccttaacactgtgggtgctttgatatttctctaattttaatggtccttaaaataattaaaatcattaatgatcttcatctctgtccttttatgctatgttgttatgaggtgtaagcctttctcttccccttgtatggtaatatttccaataaatgtagatgatgcttctaaaaggtgggtaaatattgagtatctgattttgctgtgtttgttgataagcctacccaataccaattatttgcatttatttaaaaaaacagaaaagcaaagttatagtgatggacattttatatggctatagagttaaatctttgaaaaccagatactatgtcttcttttatggaagtgtaaaaacattgtcataagcatttagaaaaaaaattaaactctaatttctaccacggataaagcaggcttattcttccaactatgcacagtttgagaatgagattggagcatgggtcaattatctgccccatgatattttgggaagacacaggttttagacctagacattcctgggttcaaattctgttctgtcacttaagagctatgtggcctgggacacattgtgcctgagtttgctcagctgtgtgatgagaggaatagaaaatatctctcaggatgatggtgggattcagaaatgatatacataatgaggtttgcagcccagtaccagatatgtgccctgtaaagaatagaaacattactcccaaaagttaggtgctgtttcttcaaactcttgggagaaaaagtttaagtacaagaagattataaaatttataaaatgagaacaacaaaacacttgggaaaattagaagctatggaaattgttctgatgcctgcaatgcccagattgtggttggatatgatataaaggatttacctgtaaaagtttcctcacagtcagaagcatcgcttagctcacagaagtatgtacatgtaggaaaatcaatagtataatagcatatatgcatactttagatcagaggaaacttggaacagctttcagttatattacttccaaatgctcaaatcatgctaattgtgtttctgtgactttgcttttgctggatacttcaaagcccacacattatggaagtattacatctcaagataatagaattgggtgagtgttataatggaatatagattccttatccaaaacttctggggccagacatgccttgaaggtcagaattttttggactttattaactgtatcatatattaccctacattttgtggagttagagacagcaccatataatgaaacatattctatttctgcagtgaaacaaaggaatagttacaccaagtaaacttttaaataaaagataaatcctctcacatcagatcaggttttgctgccaaatttgctaagaaaaaagctttcaatttgcaagcaagggattatgaactagaatatattattttccagaatcaaatccaataatgtatacatgatacaatatattttaaaggatcttcagtagttcttcctacttagcagaaataaaccataatgacttgaaattttctttatgaatctgagcatatgatgttgattggggtttatatgaaaacagttttgcctattaagaggctcaaatccagggagttttggggcccacccttccgactgatgctggcttttctggttggtggggctgaaacactctgcagcatcctaggaagtgattcatccatgctgctatcctcttagggctcctggttgcagaagattgttgtgcagcatctgttctgaaatattttagaaggatttaagaagggcaaaactcttctttaaagtctaaatttgctttgtttatgtctgcctagaaattgtaatagtttcacaagttgatgtcagcaaatgtacaaaaaaatgtgagcacataatttaccgaaagctggactgctcaaaaatttaaatttaaccttcattcatccttccactcatgtattcaaaacctatctgtgtcaaaatgtgtggtgggtgtttagagaagcatgatgatgcatcaatcacaggcctcaccctcaggaagcccacagctcagcggggatgatggtaagtaagcaaactgaagtccacttccttttccaaggctagctactgctgacccttcaggtcttactgaaacatcacttctgcaagaggccagccttggtcaccagatttaaagtcaccctcccttcccaatgtctttcactatctattacattttattatttgaaacaatcttatttattcacttatttattattttttgtcttccttcattaggacgtaagacccattaaagctatttttatgttgcttaaagcagtacagaattatagtaaggttttaagcacaatcatattaacatttgtggagaaaggctttgaaggtgagacaagactggaaaaaggagattagttagaaggctgttgtggatgaaaaattgtggtgatccgggcttgggtgtttgtactgaatttgaggaaaagctgatgaattcaagagatattaagtaggaagaatccaaaaaatctgtgataaattggatgtcggagagagggctggaggttgtcttcaatgcatcaagatttatgatttaggtacaagtaagatggtgctgctcttcacagagaaaggagcatagtgaaaaagtcagattgggatccagagtcatgaaagttagctttctgagtatgagtcaccgtgggagtttgaagtaaaaatgtccagtaggaaggtggataaaagtgtttaagtccagaagtgacagagaactctttcttccaaaggtattggagactcatggaaggatttccaatagggaagggaactcaactgatttttatattagaaaggtctgtaatggaatagtttgaaggagacaaactagagatatgggaattggtgaggatgcttttgaaattattcaggtgagagaaacattggttgcaggtagtatttagcagaaggaacagattcaaaatatattcagagggtagaattggaagggttataaagagttctcagggggttaagtcatcctcctaggcttatggctaagggcatgcactgacaaagggagtgcaggagaagggggagcaggtgtaaggggagatgagagcagaaggtgctgatttagggccgggcacggtgacttatgcctgtaatcccagcactttgggaggccgaggtgggtggatcacaaggtcaagagattgagaccattctggccaacatggtgaaaccccatctctactaaaaatacaaaaattagccaggcatggtggcgagtgcctgtaatccaagcttctctggaggctgaggcaggagaatcacttgaactcaggaggcagagattgcagtgagccaagatcacaccactgcactccagcctgggtgacaaagcaagactgtctcaaaaaaaaaaagaaaaaatagaagaaggtgctgatttcaattttgaatatgtttgtgcttattggagatatcattggggtttgaggttcaggactcatgtacactggagacataagtttcactgttgtcaataaatacatggtatccgaagccgtgggagtacatgagaccacctccaaaggatgagaacatagaaaggaatgtaggacttaaagcatgatggagaaagaagaactggaactgaatggggaactgaaaaggcaaataagaagtgatgagagaggtaggaaaacttggagagtggttatcatgggaaattcagtcagatatcgggcaaaattcacccccaatatttcacataggttcttttctattttccctaaatgttggctggtctgagaaataaagggacagagtacaaaacagagaaattttaaagctgggtgtccaggggagatgtcacgtgttggcaggttctgtgatgccccctgagccgtaaaaccagcaagtttttattagtgattttcaaaagggagggagtgtacgaatagggtttgggtcacagaggtcacgtgcttcacaaggtaatagaatatcacaaggcaaatggaggcagggtgagatcacaggaccacaggaccagggtgaaattaaaattgctaatgaaatttcaggcacgcattgtcattgataacatcaggagacagggtttgagagcagacaaccggtctgaccaaaatttattaggtgggaatttcctcgtcctaataagcctgggagcgatacgggagactagggcttatttcatctctacagcttcgaccgtaaaagacagccacccccgaagcggccattttagaggcctaccctcagggacgcattctctttctcagggatgttccttgctgagaaaaagaactcagccatatttctcccatttgcttttgaaagaagagaaatatggctctgttctgcctggctcactggcagtcagagtttaaggttatctctcttgttccctgaacattgctgttatcctgttcttttttcaaggtgcccagagttcatattgttcaaacacacatgctctacaaacaatttgtgcagttaacgcaatcatcacagggtcctgaggtgacatacatcctcctcagcttacgaagatgacgggattaagagattaaagtaaagacaggcaaaggaaatcacaagggtattgattggggaagtgataagtgtccatgaaatcttcacaatttatgttcaaagactgcagtaaagacaggtgtaagaaattataaaagtattaatttggggaactaataaatgaccatgaaatcttcacaatttatgttcttctgccatggcttcagctggtccctccgttcggggtccctgactttccgcaacaagtggtagaacaaaagctaaagggagagaatgtttcaaggagggaatagtcaatagttagatgtttctaagagctcaaggaacttggaggaagttgtcagatagttggactgtggaaggtcctgtgcaggttagggactatctgagggtccagtgatagcacgaattctcttggccttgtaaattgctcttctgctctacagttggaaggtggcataaagctgaggacacagacaaatgaattgatattctgagctggtgtttttctagggaggcagcatggaaggtcaagagagaagatgagttagagtttttaagagagacaggttgaggtaaaggactgtgtaatctcacatgagtagctttaattgatgtattaatcaggatagattaaccaggtaacaagcaacctcaggatttcagtagattagcataatacaaatttaattcaccctcctataataattcaatgaaggtcatcaacatgcagggagataccttgcttcacatggtcagtaacagactgggctttggaatcccagagattccaaaatctcccttctctgccttctcctgcatagaacctgcaaatttcattcttgcagcaggtgggaaagagacagaagcctgggcaagggaggtttttaagaaccagtccataagtggcacacatcatttctatatcgttgaacagaacttggtcatttgggctcacctagctgcgtgggaaatagaaaaatatactctgagcttgtgcccaggaaaaaaaaaaagacaaaaaaagatgatgttgactgaaaattgaaaggaaatgggcaaaccagggaactggaggttttactaaaatcagaaaaagtttgtgctaggattaaggaaaagaaattatgaggtgggaggttaaagtcagtgagtggcatgttgtacttgaaagtttaagagtaaagagcatgccacctgaaagtcagagatgttattggagtaagagataacagacactggagggaggggcacaagtgataactaaaaatatttgtggaacattgtcttcggaaggtgtgagtagctgaaaacaaatggggatgaaatgtccttggttggaatatgttaggggccaggaggactgatgtggcatttacatgactgataattcattcctttgtcctcaagagtcttagcaggaaggcattgttgacatgctccttggcccgagaatgtatccaactgcaattgtataactggaaagactttttctttaagcaggaagtagagcaggtgcttgcatgagcctagatattagggtacttcttagtctcaagcttattatcagttttgtttgccatccatgtgcccactattgttctaactttagactggaatatgaaatttggcttctcaaacctacaggtctccaggtaactggattatcaaccttttgtattataggctgcaaacagaaaaagatgtttccttccaaacagggtttcttctctccctactttctgaaaactagttttagtagacactagtctttttcataggatctctcacaggtctcagaaaattataaatggacctcactatcctgaaattttcctgccatgtcccctagttcttcaacctctgtatgtacatgctttgagtccaatgttaaaaaggtgacagtttaatcagttctttaacagatggataacaaagattgccaacatcctagcctaagagagatccttccagtcctctcgcctttctccgctcagctaattccaccttttagggtctgtcactcttaactccaagtcttacctgacttcctggtaccgatatctctatcagttaggattttttcagatgtaaatttcagaaaactcaaatgaccctggaaaaaagggaatttgttagtttacatgaatgaacacttcagggatagaatcgagcactatttaatccacagctcaaatagtgtcaccatgaactagttttttttccttccatatttttgttctgctcttttgctgtggttctgttcttgccccaacggactgcaagatgactgtcatcagtctccagggaattgtcttcttactttgaatccagcagaaataagagtctttctcccaggattttcagaaaaccttctaaggttcagtctgattggactggcgtggatcatgtgcttatttctgaactattcactgtggccagagaatgaggtatactgattgacttaggccacatcatatgggacaagggatgttcctcaccagaacacatgggctgcctctccccctgaaagagctattgctggaagaagaaaggatagacgctggagaaggtgcatcacaggtgaaggcaggtacttgctgagcattatttgtcttcagaacaatctaatttggatactaggatttttgtgtatgttgtctttttaaaggaatatgagatggttaatacctcatcattaaaaccctatggttcatttattaataaaatttaattatttttccaattcatgactttccccttctctccctttccttttaaaaataattctactgactatgttaggttgagaagcaacatagtgccttggttcttcagagctgacacagtagagtcactgtgtcactatgagcaaattaattaaaccttactgtacctcagttttctaatctgtaataagctgataataatagtaactgtttcataaggtttttgtattaaatgtgataatactagttaggtacttaggtatggtgttgggtgttttacacacattagctcattaattcctctcaacaactctatgaggtaggtacccctattatctcagttttacagatgggaaaactgaggcatggagaggcaaagtaacttgcccagtcacacagatcataaatgatagcaccaggattcaaatcttaatcaccatgtttaaccacagttctaatcactgtgtttaaccacagttctaatagtttgtaaatttcatcaagcatctcattttgtagtctcaattatttatagtctcatcatttacattaatttgctttttttattacttaatttttttttttgagacagtttttctctgttgcccaggctggagtgcaatggtgtgatatcggctcaccgcaatctctgcctcccaggttcaagcaattctcctgcctcagcctcctgggcagctggaattacagatgtgtgccaccacgcctggctaatttttgtatttttagtagagacggggtttcaccatgttggccaggctggtcttgaactcttacctcaggtgatctacccacctcggcctctcaaagtgctgggattacaggtgtgagccaccacgcccggccacttaaaatttttcttaaaataaagccattagatctgaaaagaatgagctcggctttatagaaattaatctgatgaaccaaaaaactacaatggctatttgaatttgttgccattttgttttttaattctataaaaatatctccaaaggggccagtcaatagcttgtaaaatataataatcattattttattataataaaatagagattagagtttatgaaaaccacactttgtcaaatatacagcctgttaatttgttctgcgtctttgagatctagagttttatttggaatagtatttaatgtatgccacttatgttttttccccagaaaataagcagatgttctttccatatttttacagccaagttgcatcttaatggagggtttagagcataaaaaccagtgaagagattatcttatctactcaaaattactttgaaataccccttcaataggcagaatctaggttttctgctatgtttttactttgggacagtagaggcatggtcttgtttcaccagaggaagaacaactggtgaaacaaaggcatctctcctcctgcctccctccggctgccccatagctcctctctctccctccctgcttccctcttttcctccctctgtctcttttatcctctttgatgctctctgttttacaagtgtggtgtgtttgattccaagtaagcaaatgcctgtattattccaattccttggaattttgataacatttaaaaatgttaatgtttctcaccaaagatattattttattaaccactgtatagcttatttagcacaaagtatccatggagccaataaagtatccatttgttacttgtatccaaagtacataattttgaatctataattttcaagttaaacaataaatatatgaacacatttttactgtgaaaaagttgaataatgcagataaaataaatacacccttgacccccacccaatcccactcacctccatagctaccaccactgttatcattttggagtatatatacacatatatacacacacaagcacatgggtacacacccacccacacacaaagacactgtgatttaaaaaaataaaaatagacaaatattgtacatgttttgttctaaaattgtaaactctaccaaggcaaggatttttgtctcttttgcttattaatgtatccctaacaatgtctaaaagctggtgtatggtagctgctgagtaaatatgtgaagttgacctcactttattcatttaatgatatgtcttagggatttttccatgtaaattcgcagacataaaatgacaaaacttctttgtggcataatattatagtgttctacagtatggatgtgccatacttaattcacatttccctaaggataggtatttctgctgtttccagtttttccaaaacacctgaaccagttcatagacccaacaactatatatgtaagtacctcaatccccagtactggataattatattttatataatttttgataatctaacagaaataataatatattgttgttgtgatttgcattttacttattgaaagttacagaggccaggcgcggcggctcacgcctgtaatcccagcactttggggtgccaaggagggtggatcacgaggtcaggagatcgagaccatcctggccaacatagtgaaaccccatctctactaaaaatacaaaaattagctgggcgtggtggtgcatgcctgtaatttcagctactcaggaggctgaggcaggagaatcacttgaaccagggagttggaggttgcagtgagcccagatcgtgccactgcacttcagtctgggtgacagagcgagactccgtctcaaaaaaaaagttacagaccagccttatacctatttaacagactttggtatcccttctcctatgaaatgtctgatgtgtcttttgcccattttagggaaccattgtattattttcttattgatttttaggattttaaaaatagtctgggtattagttttgtttgtattatatatagtacaaatattttctgcttatctatctcttgactttcagtttttttactggatattataaaacaaaaagttataattttggcttagaatattttaaacattttatggcatttattttttatcttatattttcttccaatatttttgtggatttttatacttagctatttaaatttttgtttgtttgtttgataatcatatacttctgtcttcttaaaccacagttacttatgtctataacttaccggcgaggataaatatttttcatgcttattgaccactagtatcttctgtttagaatgagccattcatgctggtgtttatattctctttgatattttttaacttttactgatttataagagaattttgatataataattatattgaccttttatcatatttattaacaattttttaactttttcttatatagaatttaattttatttataaggttcttgaggtaaagttttaaaaaatgtttgatagtaatgtttattgttctttattctctcatttcttctactgtatttacatttagaaaggtggtacctaccttaagagcagttaagtattcatccttatgtttgtagcattttaatgcatccattattgacatttttccctgtaacctgtctgagattcgtcatggcacatggtaggaggtgaggcactaacttacagagcagagtatagaggctaagagcatagaatctgcaaagtctagttctgccacttgccagccatattaaggcaagttccttaatatctctgtttctctgtttcctcatttgcaaaaggagaatgattattgcatctacctcttagagttgttgtgaagattaaacacattaatttacataaggcactgtgtattttgtaacaactcagttactatgggctattattattttattccaaaggggctaatgtacaaatataatcatatgaacagtccatactatcaccattgatttgcaatacttctgtgattgtataataatgtcaacaataatagcataataatcatagcagttcacattcctttaaagtttactctatggctaggtattgccttgaatgtattccttacatccactcatgcagttctacagcaaccctgtgaaacagggtccagtagttttcctgttttataaatgatggtactgaagcttagaaaagttaaatagtttaccctaggtcatacaatggataagtggcagaattctggcttcagtcctggtgaaggatgaactcttaacctagagtccatatctgggttatttgtcttatccctccatctgttgatttttgtacagtgacacactttttaattattgcagcagtctgttttaataactgctaggtttttccttttattattcttttttcaaaaatgagttttgcttttgtagattacttattctttcaattgaagattaaaatcttgtcatatcccaactagagttctatttgttgattgggtatgtgtaaagcttacaaattaatatgagatgaagtctcattttttcacttgctgttttcccatccaaacagttacttgttctgtttattataattttctgttttcccccttaacttaggtaaatttatatatcttgttaaaatataaaataactggaaatactcatgttgtaattttaaataggatttttcaattatatcttctaattatttattgctacatgaaaaccattgatttttaagcatttattttgtatcactggagtttactggattctctagtagttttaaaaattcaattataatttttatttcaactgtgtagttacatcttttatttctattttcatatattattccttacagaacaatataaaatagtactggattttctaagctgctttttactttagtgggaattttttagtcttttaccatcagttttaatgttggatttttgtttaaaatatatttagtatgataaagaaataaatatgggcctgtaatcccatcactttgggaggccaaggcaggcagaccatttgaggtcaggagtttgagaccagcctgaccaacatggcaaaaccccgtctctactaaaaatacaaaaattggccatatgtggtggcatgcacctgtaatcccacttactcaggaggctgaggcaggagaattgcttgaacccagaagaaggaagttgctgtgagccgacatcgtgccactgtactccagcctgggagacagagcaagacaaagaaagagagagaaagagagaaagaaagaaagaaatttaggtgggtgggaggagggagaggatacctaatgggtactaggtttagtacctaggtgatgaaataatctatataacaaacccccatgacacaagtttccctatgtaacaaacttgcacatgtaccccggaacttaaaagtttttttaaaaaaagaaattttcaaaaaaagtaaattcttctattcctctgtatctgagattctccatcaaaaatgggcattgaatttcattgaagtgattatggtcttacatattgaataaattatgtaatttgttatattgatatacttagaaaacattcttgcttttattctataagacttatttggttattgggagtgattgtttgccattgaacgaattttcttattattcaatttaaggtaacattattcttttttttttttttttttttttttgagacggagtctcgctctgtcgcccaggccggaccgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaacattattctttataaaaaaataatgaatatgcactactattaaaatccctgttgaaagagaaatgccaccaaaattagggagaaaaaaatactgtgtactttattcctgcatatctcaatttgctaaataaaacaagaggctggttcatctgttgggagtgaggggagtaggacttacatggacatcttaagaagatggtgaaactcaatatagttactaagtggaatgtggaaaaaaaaaaagtaaaagggctttcagctgttggccagctgggagaatcaccatcagttcacaggctgagactgctgcacagggatgtcaatttcttctcttattatccggcgagaactctggatctttcaatttagccatttaagggtttagcaaaagactaattataaaacctcattgactataaaggtgtcacgagatcttttgttagtgatgatgtccatattgcagaccagaatgttcttttggaaggatgccactagttcattatcacagtgaaaatcagagtaaatagatgagacattcttgtatatatttccaatagtgctcttttgttatttttgttcattgcttctcatactgaaattaaatcctctgaaaataaatatgtcccaaattcaccatgaccaaggcaaatttcagtttctgtccccaaagcacgaatcttttcacattcagtgcaataacattacagaatttttcctgagtcagaatattccacaaaatatgagacatctttacattcttaaggtatttcaaggagtcctgtattatgtattcataaaaaagaaagcttatgttgatcagagcagtcaggcaggaggtacccggtggttaaccttctggtctccattctcactcaggactctgctgtatcttaagtctcggtgtcaaggtacctaaatgccagggcatatcaggacattttatcataaattttaaaattttgttttgtaattggataatcctattcgagaacaatcttacttttttttcctcctcagatatgtatatgtcttctaatcttagggtctcagatttatcatatagtagctctacatgtcagttcaaaattccatttgccataaatcccccaccccctagtgaagtccctccttttcttttttccctcagacatttgcaatgaccaagtctcttatagcttctgtggaaccatttttactttcccttgggagtaatttgcatggtacagcaagattgtgatttaattggagtagtcttagtagcttgaaagagttaatgcaggtctcagatgtatctgaataattctggaaagagcaaaatggtttatttgcctagcaatatatattttctaattatgtaagtgcagaaaataagtaaaatttaagagataatctcttgaaaaaatgtaaacatgtggagcattcactaattagggaatgaaatgtcttactcccaaagttactatgaaatttctttgactcagcaaccaatccattccccaccccagggaattccatcaggctgaattatatgggatgaatgttccctatccaggaaatgagtgccctggttttataattgaacctcagttccttgaagctttgcactgtacacttgccttaccaaataattggctgaagtttttgtcctgattcttggtaaggttatttacacacttagcctgtgatggatggcccctgtgggcagattattagctgtactaccatttgtattgcctggatggagaactactttggaaatggtgaacaaaaataaaataagcttgggaaataaaaatattaatactaaatatagtcatcataatttaaacaatttctaatgcctataattattatttgtttgcactataatatgaattctttatggagttttgccatctccagccccttttctaagttttaatttgagtctcaattgacttttgtcttttataagaaagtacgattataacaaaaaccttagtttaatatcgagtcattttattgtttccttacctagtctactaaaactgattttcttaataaagctatggaatttttagcatatatattttattctcttcaaacatctctttcttttccagcaactctgttcttcctgttgacctgctgtaaaaagtggaggaggaaaagggaaaaggaggatttgtttttgggaactcaactatctataaatgacttcctcttgtttggtacatccacttgcagcatttcattttcaaatgcctggtcgcaggatccatgtcctggaggaaggaaccatgtcatccttcactcatcctgtgcacatagcctgaccactgctccaaatattatctcctataacttctggcatttcttgtgcgtctcctcttcctggagttcataattcatgtcactgatttccggtgcatgcagagtcaggttttagaaatatgagacaattttaaaattacagatgcaaagcctcgctgtttgagccaacatctgcaactagtttacgggattaacaaaatagctgctctggatgactgatatttaccagggcctctccatttcccatcagaaatcagaatgcctgttacttatatgttctttagttttcaatggaaatcaggaattcatctgttacatactttactttattaagtttcctcctggagtatcttgagttacagccaattttcagttagccatcattaagcagcttgggaagaatatgggtaattaaaatccacaaataattaaaagactgactttaaccaggagctccaacactctaccctgagacattctgctgaaattacaaacaagtcaaacagttaatgtgttgttctttgttttgttttggtgcaaacaaaaaaaattctgaacctgttactcctcagctttcaaccattcagaaatactcctttacatataagataaagttctaacattcattattcattccctcttttctccctgttccttctcttgcccctgacactcctgaattctgtgttccaggtctccagtcagcttcaatagctcaggctctttctctgttcttcttttccattattgccaaaacatcatttcatttatcagtttaaatagcactttcttaggagtacttttccggacttctacactattttcagtcctcaactgcatgttcccatagaaatacatactcctctcaccacagttttgtatatctacttgtttaatgtccatctccccaatttgactatatgctcagttagatcagggacagtagttgccattttcactgccatattctgtgtgtctaacatagaatccgcttataaatatccaacaagtaactgttgaatgaaagaattaaatattttaaaatctggaattaaatcaccagctacataaatgttctataaaataatgactcaaactgtgacattaacatccaaaagggagactctaaaatatattaaagctgcttattaattttggacattactttctgtcattcaaaggaaaaaaggtattttaaatttaattgtcattgcaggtgtgactatttcagttttccatctaaataaatatgtcaccacaacaattgttacatgtaggttgggtgcagttgctcatgcctgtaatcctagcactttgaaagggtgaggcaggtggattgcttgagcccaggagttggagacaagcctgggcaacatgacaaaatcctgtctctacgaaagatacaaaaattagctggacaaggtggcatgcgcctttagtgtcagctactcaggaggctaatgtggaaggatcccctgagccggggagatcgaggttgcagtaagctgaaattgtgccagggcactccagcctgagtgacagaatgagaccttgtctcaaaaaaataaaattaaattaaatacgtgtagctctgaaatatgattctgaacatagtaaattctaatctaataaagaaactgatttaagcttgattaacaattagagcaaaccactgaattatgacttatattaaaaccctagcagatgctattgttgctttagatgggagagattttcctttatcatccttgacctcccagacattgtgacaatacaataagactgctacatgtttacagtagcccttggtgttgatattgcccttgatttagaaccatggtaccaataatttattgactaatctgtgatctagggaaggtataagtatttggtattccaaaggagtataaagcacagttgatctctacttgataataatatcagcccttcactgatgccagacattctattgagtactttatatacattcatctcacttagtatttacaaaatctatttgaatttaggattattagttccaattcttagttgacaataaatgaggcttggctatattaagtaagttgcctaagttcacatagctagtaaatggcagaactgacctaaaagcccagaaagtctatgctttgaacgaataagctgtaatcttattgggaaaatgggagcacagcaaacacagtggcgagtaattcaaaacaaggtgatgtaagtgctaaactcagatagtgaacagagtagatagaagaaagagagccacatgggctaccagagcttctttatttgttaaaatagtataatagatggactcctttttttttttaatcttagaatgttactttcaatttagccatttaagggttttgcaaaggacaaattataaaacttcattgactacaaaggtgtcacgagatcttttgttggtgatgatgtccatattgcataccagaagattcttttggaaggattgcccagaaactgctctacgtatttatacttctacctgtcattctctggaatatttgatattttaataatcataataatagctataatttattgcatgggtgttttatatcaggcagtgtgttaggtgctttgttcttcaaaataaccttgcagagcatatactcttatcttcatttcgatggataataataaaaatagctgatatgattaagcatttcttacataccagccttgtggtaagcacttgacattcattattttccttaatcttcacaacgaccttatggtctaggtagcaacggtttcatgactgaggtaactggggcacagagaggttggataacttgtctggggtgacacatgtagtatgtggtagagctaggatttaaactcatgaagtccagcaccagagctggggctcacaattgtttgcttccactctggtttctccaaggccacgtgactaatatggtggagctagggatcaactacaaagtcttggccctttccactcattggtactcttttgactcttaaatctgagtgattctttcatcacagtgaccctggccctgaacctcttcagtctttccattttccagtatgtgccattcctgaaaacataaccaattcctgaatgtcaaaggaattgctttttttccagtgataaaaatctgtagtgatatctgtctttttatccctgaaaacagaggggagaatttaatagcataggcctggagcttgagatgagtttggggccccacttgccacttgtaagctgaatcattcacatcataaggttgagtcgctctatgcctcacagtgttcaaagataaaagaggaagagcagtgtgaatctcatagggttgttgagaagattagtgagacatccatgtaaagtgcacactgcttatagtaaatattcattaagggttagcaaccatttttattattgcaattaataaagttgtccttttgaattctcagaattgtaccagtaaactttaacttaaccagtagttctcatggctcctctaatttaataacgttagcagtttaaagtagtcctcagggttataattaatgccttatttatttactgaatgtggggtatttactgaaagtatagtttgatgattaaaggtaaatagggtttccttagtgaaagatttgtcttgatgagataagaaagtcaaattggaaagaagtaaaaaattatattcagaaaataaactccaagaatgaccactgttattttaaattttatcttggtaacgttaacattccttaacttcctgctatgtgtgaggccctgttctatggattccctcatttaattttcaccacaattctataaggggatatactattattagctctttctgccactcccccacttttttacaattgaggaacagatgtactcaaagaaactcaggaagtcggagttcgagatcagcctggccgacatggtgaaaccccatctctactagaaatacaaaaaaattagtcgggcctggtggcgggtgcctgtaatcccagctacttgggaggctgaggcaggagaatcacttgaacctggggggcggaggttgcggtgagctgagattgcaccattgcactccagcctgggcaacaagagcaaaactctgtctcaaaaaaaaaaaaaaaaaaaaaaaacaactcaggaagtccatgttttcttaacgtaaatttttactttcctggcatcaaaaattggtcttgacaaaagtgcccaaagcgtttacacaaaattttacagcacatcctgcatcgtgtggcatcagctgtgagttatcccttttgtgttgtcaatcacattttaattccctgataggccaatctcaatcacaaatttattgtgagtgtcttttcttcttaaataatctgatgcaaagaggcaaataatactgcctactgcctagaaaagggattttgacattatttcctgatttaatttcctatgtattgaatcgatgccagacactcttctgggggtggggtggtaaataagacagattaagttctcactctctcatgaagcttatattttagtggtggaaaagatagaaaatgaacaacaaaaagacaaatgagcaagaagaaattgtacatattttcagtgtagagaattaaaattggttgctatgaggaaaagtgaagatggaggggcagtgtggagagaggtaataggagaacctctctgaagagggatggtataaggtgagttctgcatgacaagtcgtggctaaccatgcaaaggtcagaaggtagagtcttgccagaaggtacagcaaggactagaaagaacttgcatgttgtagaaaccaaaagatagccagtgcggctgaaacatgtggcaaagagtggaaagagattaggctgggtgttctaagacactttctgtttttagtgtggatattgagatgtaggtgatcacttctacctgtttcgtactcttcataaaggttcttccattacagaatctctaagactctatatacttatgtacctgccctacccagcaatttggcaagagtacaaaggaaataaggtatcccaatttatctaatgaatgagatcctttcctcttccatgcacttgtgccttttgttccctgtactaacacttacttatataatgctatattctggagtaatggttacaagtactgtttagtgctctgtgcattctcatttgtcctccaacagtaggtactactatcctcatttatggatgggaagattgaggctccgagaggttaaggatcatgctctagagggatggagctgggtgtagatgaccctggagacttgctacctccttaggagtgttgcttattttacagtatgcataagttttatgccacatgtgaggctacgggcatcttgaagtcagtccaaaattttatcttttataatcttcatgccatgtactatctagtaactatgataaagatgttaaaaatgttgttggcaggatgaaaatatttgattaagaaatgacactaaaattatccccatcaaaattatcttcatcttctcaagagaatataccaaggaaagaaacagattgtttaccttacatttgtatccatatgaaacatacagtcttttcattgtctgggagtctgtccacaccacagtaacaaaaaaagtgcaggttgtatatttggtgctggagatagaaaggtgttagataatattcctgtcctccaagggcatggcatctagtcctgcagagagctctcattccttttttcccctctcataccacatctcctttccaatagcaaatcctgtcatctggaatctgaccacttctctctctgcccattaccaccaccctgctcaaagctccatcatctctcacctgggttattggcctccctcctgcttctcctctttctcttgtgagtctctcccctcagcagccagaaagcattctttaaaacagtgagatcatattacttccctgttcaaaaccctctagtgatttccatcctactgagaatcaaatctaaaggtctccaatgactgttaaggtctatgggatccgtctcctccagcctctctgatccaagttcctaaggctcctccccctctcgctcactgggatcaggcaattggcttccttggtgttcctgcctcaggacttttgtacttattcactgttccctcttcccggaattcattcccctcctccatcctgttacaccaacacaatccacatgctctttaaattccttcaggtctctgctgaaatgttattttattgaagaggcctttcctgattaagtgaaaaacatcattttctctccaacataaaccaagagcatgcattatctcacttagattgcttcgttttttcacagtatttatcatctccagatatataattatatggttattgtctattgctgaactctaaccacaactctaccccaactggagaatataggttctagtgcctagaataaaaaaaaaataggtactcaattaacgtagtaagtattcaataaccatctattcaacggatggatggatggatggatcttctatctctggctaatatttagactcagcttatctttggctctaaaaaggtagcacttgctatgtaaatagtgttctgataatattaatgaaatatcagttctttcttgttggattgtgtatatcagaagctgtaggaagaagcatacctacatgcatcttcccctttttcaatttgtgtcattatcttgttcttgtattgtgctgcctgtggatggcattctgtctggatggatgtgtctttttcacacacatatgatcattctaaagagaccccacaggaggttctcacatgcctgctctttgcttcccttgttcactgacttctgcactcatcatccccctatttccttgcactgctgtagacctggttgttttctgagacagtccctatccagtattcttttctcacattccacatttggtgcgaatccaaagccagtccagcatggagtggacaggtggtgttggggagggggaacagggaaaggcagaggagaagcaaagctccaatggagattcccttctttctcccatagctgaggaccctgtattctcaagggtagccacctcagctctatgaaccaactgtttttggaagtacatctggaacactttgggatattaaaatagggctttgtggtcaaacttggagttggtaagcaaagttaaaaggtgtgtttatcttgatacttctcagcatttttaatagaagaatgtgcattgtgtacgtgagagaagaccgtatggtattgcaggaatttcataacttttttagtcatgaaaacttttttcatggaatgtctctcttaaatagcatttcttagaacgtactttgagaaaccctgcctcaaccccatcagttacttaaaagtcttcactgggccggacgtggtggttcccgcttgtattcccatcactttgggaggctgaggtgggcggatcacctgaggttgggagtttgagaccagcctaaccaacatggagaaaccctgtctctactaaaaatacaaaattagccaggcatggtggtgcatgcttgtaatcccagctacttgggaggctgagacaggagaattgcttgaacctaggaggcagaggttgtggtgagctgagatcatgccattgcactccagcctgggcaacaagagcaaaactccatctcaaaaaaaaaaaaaagtcttcactgaggcctaagccttctctctattttagaataccagaatggcggcatttttttttaaaatgtgcatggctcttatatttagtctttgtgactgatatggtttgactgtgtctccatgcaaatctcaccctgaattgtatctctcagaattcccacgtgtggtgggagggacccagggggaggtaattgaatcattggggccagtctttcccgtcctattctcatgatagtgagtaagtctctcaaaatctgatgggtttatcaggggtttctgcttttgcttcttcctcatttttttctcgcagccaccgtgtaagaagtgcctttcatctcccaccatgattctgaggccttcccagccatgtggaactgtaagtccatttaaacctctttttcgtcctagtcttaggtatgtttttatcagcagtgtgaaaatggactaatagtgaatcagggtcccacaagtatcatctttaatctttctctgaaagctgaattgtattggaagtggagagaggagaaagaggttgtttttaggaatgagctcttttattttgacccctagtaattactagcaggtaaatccttagaagcactgaaaaaggtagtgatacataagggcaagttagaagttgtgaagtgtgttctcttgcttggtaagaagaaagacaactgggtcatacataagagattgtggcactgaacaggggagttggtaagccactcctcgggacctcaagactaaagtgcacagggctaaccaaactgacaggaaagtatgtttgtggtttgcacaaggtgaaagccccagttacccacagctatgtgcttaatggtgtctatatcctcacatcctgcactgccaaaatccacagaacaatcaaaggtgaggaaggaaggtccttgattccttcacattggaagagatttaaaactaggattccacattagatacatgcatgcatttttccctagaacattagtatttatggtagtgggttctctatgaaggattggctactaacacttatttaatacctgagtgtgtgagcatctccttagtaatactattggtactctttttcagaggtatgatagggtaaataaatttttctagaatgtcttaggaacccaaaaccttaaaatttgtcagccattctcattacttgacattgacaaattgctctatagctttaatttgaatgattgaatgatagcacatcttgttgcttccctttagggatcaaaatttccaggaagtcttttaaaactgattctctgtttgatatgttttcttcattggccaattcttgttttgttttgttttttcttcttttgcaattttggaagattttttttttctgcatctggaagatgctgagaaagtattgattcaccatatgaaatcagacttacatgggaaaatttcacctctgtcacccacccgttccactctcgagctccccatctccatcaagccacagcaacaactcttagtgacgtttcccagccagcaggcatcaggagagccagagtggtttttctcatatttaatgctttcaaaccagtcacagctggctgctcctgcaagtgcccatctctcatcagagatgctgaagctcctctctgagtccctcaatcctcccctctgtccagagattaaagacaaaggcctggcacagaagggagcctttggtaccctgctttagcactgtgaccccatcacctttggggattggtcaggctgatgtcatactagttgttaatttttttttttttttttgagacagagtttcactcttgttgcccaggctggagtacaatggagcaatcttggctcaccacaacctccgcctcccgggttcaagcgattcttctgcctcagcctcctgagtagctgggattacaggcatgcaccaccacacccagttaattttgtatttttagtagagatggggtttatccatattggtgaggctggtctcgaactcctgacttcaggtggtccgcccgcctcagtctcccaaagtgctaggattacaggtgtgagccaccacacctggccagttgttaaatatttttaatattctctcttcagtaaccttaaaaccagtgaaaaaaattttacgtttgaccttacagtggcatttgacctttgacctttcaatcttttcacctttacgtttgacctttcaatcctttcgccttattgagacattctctttcattcatttttgtagtattctctgttctctctctcttctagccccgcctcggtttccttcatgggtccatcctctcctcccagacattgcacgttggctttcctcagcgctcagtcctgggccctcttctcttctcacccaaatgctcattttaagtcatttttttcacacccacagttttatttacacctgcaaacaacaattcacaaatttgcacatctgatccagacatctttacagccaatgatctatttcacatgttcacatcttgacatgtccagactgaacttatgactcctccactccctaaacatagtcctcctactctctgtccatgaatgtgcctcaacagtctgtttagtttcttaaacgtagacctcgggagtcatcttcgacacccctttctctcccatcttccatatccaatttatcattgtcatactaacttctcttcctaaatattcttcaaatctgtccacttctccatatgttcatttctaaaactttggtcaaagttatcatcatttttaatgtcggattctgcaatagtcaactatcaatcaccctgtatcctttttcctctctcgaatctcttcaccaacccagagctagaagagaacttttcatgtgcaaatatgtattagtctgttctcacactgctaataaagatatacctgagacttggtaaattacaaagaaaaagaggtttaatggactcatgttctacgtggctggggaggccttcacaatcatgatagaaggcaaatgaggttcaaagtcacatggtggcaggcaagagagagcatgtgtaggggacctcccctttataaaaccatcagatctcatgagacttattcactatcaggagaacagcatgggaaagacccacccctcatgattcaattacctcccactgagtctctcccatgacatgtgggaattatgggagctacaattcaagatgaaatttgcatggggacagagccaaaccatgtcaaaatctcatattgttaccctactttaaacacttgaaagccttcccatttctctcaggataaggaccaaatttcttcacataaattacatgactaagtgttgtttgctcctccaggcacgcctggtaggaggctcactcttgctttaggtagagtggccacactgagtttgcctctccctctcccactcctgccccacacatcctttagatttcagctcaagtgctgaatactataagtatgccttttcttatacccggtgcaggtgagagcactgttcatgtaaggaaccacttcttggcagcaccaaccagagttataactttacatttatctgtgtgagactttgtttagtgcctattctctcacttgtctataagctccatggaggttggggactgtgcctttgtgtgtgtgtgttactgtttccttggtttattcttgtatttccagtgtgccctctgacacctctaaggtgctcactaactttctattaaatcgttaataaatatttactaaggtgttttttttcttcctctgttaaataagctctctggattatttttagtaaacatccacattttattcaggccttgataattatgaggtattttttcctcatgtgtgcatatttttgtccttgaatgtgagaaatagatgacaggcttagttctcattctgttttgtatcatttggaatcccttccacatggagggcctattaacttcaaaggaagctctgcacatgggaaagatacacaggaaaaaagtgaaaaaaactagagccctgattttcatcatggttaatggcctggatcttatagtggtttaggtgagtaaactctgagaataaacagctcactcttagtgaactcttagaaataactgtacatgtggcagaaataatgcatatgcaggcatttgagcaaattctgggaagcaataagaagagaaaaacatctttagaaataattttaagaatcaagatagtgcggaagcctagtaagccacagaggcataaaaaatgccctcattatgtgagcatgggctaatgttttggaagcgaagctcagtgagaagaggtttctggtgcttttgcagggcagaatgagtagacgatgatgaaggcactgtagacatagtcattgtagacttgggaagtccagaaaaaagtgagaaagggactccttcagttgcatgatgaagttcttctgcgaaacagtaacttggagttctgtttaatttataaaatctttgttagttggttacaatttaaacttatgcctgtgttattaggtaggggttgggatttacagaggaaccagggaaacagaaagttattaattttttggcagctgtattttaaaaagtgggggtttgatatgaatattaaatattggttccttattttcaatcagtttttattgaacactattaatgttttcagtcaatccagtcagttccttatttaaaacagtcaggcttctttcatcacagtgatttcccatatactacttcagaatgctttctttttatgttgtgctgttaggttatttcactactaggttgcttataatctgtttcagttttttcaaacatgctgtgttcattatacattaaagggaatctcaagaaattgcctcttttaaacaagcaataatgtgatgccaacttacttttttaatcacatgagtattataggaaaataggaaaaatacagggaaatggaaggaggaaataaatagaactttgtgttttaccatcaagtttcaatcataggtaacattttgatatatattacaattttttccctgtccttacaataacaaatataactgaaataatagcatacatataatactaataggtactaatctaaatcctttacatatattaactcatatgattctcataacaactctacattataggtattattattattccatgttacctatgaagaaattgaagcaaagggagtttgttccttttaactgacccaatgtcacccaggcagcaactattgaaaccaggagccaatcccaggtagtctgactctagggtcctgcccactattagcacaccctggcaaaaatatttttcccacatcatgtactaggcatttttgtttagcttaatttaacatcagaggattatgccacaacctgttaatcagtttcctgttaggaaaatggattgcttccaattgcttgccattagatgccatactgtagccaacatcgttgtatgtgtgtgcgttaagggtgggggctctgaaatcagtccactagagaggttttattttattcaactgctgaatcctctaagcgtgctctgcaaattggagtaaaatggcaaacagtgcagaaactcctacaaggaagacctgtttattacaaacatggatttgtcagttaaatagaagtacaatctcattttcctcacctatcggggaggaaaatgttccttccctcacagaattattatgtggattaaaagaaataatgtgtgtgaagctcttagcatagtgcttggcaccgagtaatatttagtaaatgttagccattgttactattcctgaatttctaaaaatggagtcaaattattatattctttgcctattttagatacttaggaaactctcatttcctagaaggttaaaaccaggaagtaacatccaaatgtaaaaaagtcacttagccaattcattcgtattagtaacaattgattttgtagagtcttgtagagtcttgaaaacaaagaaaaacaatctttcatcaaatatttgattattttgtgtctcaatttcactattctttaaatcccttcatatatacttcatcttattttcttgttttcacaacttctttatctctgtcatagcattagttcatcagatgtgaaaatctattttctaccatatagctggccacttacaagtcacacctgggcatatttgtggtggccctcacttgtgtttctggggccagggcacctggcacagtacctgatccatcataggcattcaggaaatactggatgactgactgataagtgtcttaggtgagagagacttttgaacactttcctgaattgaacttgtccctgaaaactgcaggcatgacccccttccttccactgttagagcatacaccctctgtgggcaggcgagttcccttgatgaatgggggcaagaatggcagaaagataggcccaggactacacttccctttttgtccatccagatcaatgtgagaagtcactttactcctcctggggaggactgagtgaggaaacaacaagagtgcctctccattcctcaaccctcagcggtattgctccatcttctcccaccttttattccattgagtttaatccttattctggtggccaaccagggctgtggctatccctctttgaggtaagaagtcaaagctctatcagttctgcttctaccttcttgatatcactcccccaaagctaatcatggctcctatgggcatcctcttagcaccactagtggacagaaagttctgagaggggtcaaagcagtgcatttgtagagtccacttcaaggccagcctatgtacaaggttacacgtttgctccttatttcttgtttcaaattatgttcagacatgctgtttctatagcttatcagaaattctgcaatgatcaaatgaaataatatacattaataataaaatatcaacaaactagacatgggaattttgtgagccccctcctcaatgtgaatatgaatcctctcctactgtgaagttcctagatacaaaagttcaagaattacattcccaaaggtgtttttaagaagttagctttgccaccatgcatttaccgtcaagggggaaagccatctatgtgcatactcttggagaaggacacttgaaacatggccgtctattgcaaaattcaggaatttgcagggaccacagctccagttacccaccaggatattttttagttgccttccttttccatacagcatattcaaaacctcctaatttttactttcctttttcctttgcatttctcctcctgcctcctgttacaaaatttactggtctaagaagcctaggcttcctgaggagacattctcccctctatctcattaatccagagccagctggaaagcatgtgcttaggagaagagtgagtggggtgggagagacccttaagtctgtaaataagccacaccagttaaggttagctctccacagttcccttcttgccctggcccagagcacggaatggcactgatggcagctgatctaacccttccttcctaggcctggctctgacaggttaatactagaacctatagagtgcattgtggtatgtacagacctcagctaccttatagtataaaattaggaaatctagttcacctctcgaggcctgccaggcctgtaaatgggaagactcttttccctatagttaaatccctgtctcaggcatgccttagaaacgagtctgctagccaaattcaaggacaagtaacctgtatcctgaggatgcctgtgctcgcaaaggtagatctttcctaaccaactgggtgactggactgtccattgccttcgaggagcccatgcagctccccagcatttggccaggtaggctccaaggtatgtgaactacctttatagaagcagctgcttatctactgagaaagcctagttataagcttttgtaatctaccaagatcaaactatctaacggtgcatggattataacctttatctaggctgcagcagttaaaaaaaaagacagctgcatagctgaaaaaaacttgcatggtcgaccataagtgagatcaaggtcaaaccccctgctcacagggttcaagaccttggccacactagaagtcttccacatgtacttttgtcttcccatgattttattccttgtctctgtattgattttatgatccagtatgtcagccagatgttggggtctgaacttacccgtaacatacaggttttgctgaccttgacaaaatctgttttctcatagcatggaggaaactaacagaacacatattctcttagggtaggctaatcaccaagagaagaggctgggctgttccactcttcccattgctggtcttgcagttgctttcaaagttttcctatttggcaaaagaagcttgggtgatatttatgggcaataaatttaaaaaaaacagtttgtctcctgctgaacaaatgagaacatgcccttttagctctcaaggtcctttctagtcatgtaattatgggtttgcttgttcttgtttactcgaatactcaaaacagaatttgatattcaaatactaagaagatgtaagtggctgttgtagtggacattaatagatttattttggcagttttaaatttgaatataaaattaacattttatattttctctttctctgtgaagggcttctaccactaatcctatttgtcttggcattcttttcaaattttatttagtctttgacttctgttcccacttactttcctttttcttttctttttattaatttccccttattggtcttactccttgtggtctgaccatttttcctgaatgtctgccttttcttatctcattccactgttttactttgattttgcagcttctttccctcaattccttagtgaaaagtacattaggaattgttctttctaaaatcctattttgagctgattgttatcagaaaaacaagtccatttgtgaaaaatgtgcttcctttattgtaaaagaaagggctgggattggactactgcttcttaacctttttatgatggcagcttaattgctgacaacatccagtgctgaactcacttccatgggtaactggtaagagatgtgggtcatgtttcttcacaacatggcagctgtaatcttctttttcccttcaaattagaaagcatattgcattgcaagtgatataatgtcatagggataatcttaaatatattctaattatttgtatgtccattctttgaaaattttaactgttattagtaaaatttttaaatttttaaattaaaattagcaaaataattgtcctgtagctcagttgactaaatccactggactaaatgatgtttaataaatatccttttcagctacattaaatgcttctagaaatagtggtgcatctttgaggaatgaatctaatggtgccagtaagatcaggcaatttatttagcatcacatcagcttaaactctgaaaactccattcttgtcttcgtttacacggtacctgctttttttttttgacttcattggactcttattccttttatcttctcattttctacctctccagtggcacctcctgaccttatttctctgcttgacctagattgaatggatgatcacctgaattactctcttgcctaaaaccttcaacatcgttacacttctgtacttaggtcacccggattcagaaactcagaaccctggatcaattcccatttatcatcttattttctacatcacgtgtgcaaagtgctgctggaaaagagaacacaattacgctgattgtgtccctgaaagtttgttctttgttctcagctttcagccatttaagaaaatgaattctagttgtacccactctcactcaactactggttgcctcaatatcactaccttcaagcctcccttccaacttcatactctcactctcccagataattttgtctgctttgtcaacagaaatggcaagatcaaatataaccttcctaaacttcctactctgctcctcacgaaggacttacgtccacccttactctctcaacctccccggcctcacaagatgaggcagctttattcctattcaaggctagacccttctctttgctgttcatgttatccactcctatctttgtccttgtatcctctttattgtatcgccaatctcttactctctacttattattattattattattattattattattattattattgaggcagagtctctctctgttgcccaggcgggagtacagtggtgcgatcttggctcactgcaacctctgcctcctgtgttcgagtgattctcctacctcagcctcccaagtagcttgggactacaggcacccgccagcatgctgggctaattttttgtattttttgtagagatagggtttcaccatgttatccaggatggtctcgatcccctgacctcgtgatacacccacctcagcctcccaaagtgctaggattacaggtgtcagcaccgtgctcggccctctctactaattatgaatcaataaacatgctcaattgttgcccatgctaaagaaagaaagaaaggaaagagagaaagaaagaaacctaaaacaaaacagctatcactaccatcacctcctttgaccctgtgacctattctggttttaactgtcttcctctgggaagagctctccccagtcactgtctccattttttgtttcccattcacttttcgacccaaagaactctgactccttgtcccaccaccacactggcatagctaaagacactgtgatgtctgcattgtactgtcatatccctttcttgctgaatttgacacttccaacctcatactccttgaaattcaccttggctttggcttccatgatcttattgcttttgtttctctgacattcctttacagactcttgtgactacctctgaaatgttgatatttccccgaggattccatcttgaaccactgctattttgcttggagttttaccgctaccagtgtttgtgctgaggacttgcaagtctatacctccatcctaatctcttccttttgcttcagaggtcagatcacactccatctgtgtttcctacagctacctcaaagtcagcatagcctttgctgaatttgtcaactcctccagtttcccaaactgggtctttttcctctattccttctgaattttagaatggttggttttaaaagttggtagctgcgatagtttcagaatcattctaaaacagcacacagttcaataaaaatataatgtaagctacatatgtaattaaaaaatttctgatagccacattaaaaaacaaaaggaaacatgaaattaatttttacaatgaattttatttagcccaatatatgtaaaatacattttgacatgcaataattgttttaaattaatgagatattttacattattttttgtattaagttttcaaaattcagtgtttatttgaacacttatggcacatcttaatggaaactagtcaatagggctcaaccaccatatgtggttagtggctaccggctacactatcacctacttctgtctttccccctcactaatcccactctcattcactcataaatcctgttgattttacctcctagatatttcttcagtaggttcatttccttttaactttatacatcatggctttaattcatatcctggccatatttcacttgggttattgcaatgggttttataacctagtttctctgttccagggagcatgcaagatccattgaaacgcaggtactatagtaagatatctactgatacgtagttttaacgagaaaataagaaagctcagattcatatttaatatttatttattatacatactgatgccagcacccttgctctgcatctctgatacaatgaaataactagtatattttcattgagtggtatgattagcatgctacttgtaagccctggtagggtgggtaatggtcttagtgtgaaataatttaaccagctccttcttactcaaaactattaaatagatgtgatcatttactctatggaaaataaagtttgattgtatgtgtgcatgcacgggcttcaagcttcattgtgaataagaatcaccttggcaacatatttaaatgtagatttttgggtttcatatatatacattctcattcatttggaatggtaggtggcccaggaatctgtatttttataaagcatttgaatgattgtaatataactggtagaaaccatactgtattagtctgtcttcatgctgctgataaagacatacccgagactgggaagaaaaagaaaaagaggtttaatggacttacagttccacatggctggggaggcctcacaatcatggtggaaggcaaagagagacaagtcacgtcttacatggatggcagcagacaaaaagagagcttgtgcagggaaacttccatttttattccatcaggtcttgtgagactcatttactatcacgagaacagtgcaggaaagatcttcccccataattcagttacctcccaccagtttcctcccatgacacatgggaattgtgggagttaaaagttaagatgagatttgggtggggacatagctaaactatatcactatactatactatcactatactttgagtattagtctgttctttgtgaagtagagagttaaaaagccgtggagaaaagtgcattagcccagactggagagggatgctaaatgggggttataaaagcaacagcacactgaaatggaaattgggcaccaaggcaatgctgaaacagggaatcaagggtgacaggggctggaaatatggagagaggcttggaagacagtgatgagaaccgtggtctattccataattttctctgggattggccttccttcttcaactagaaaagttaatagcaatataaaaatgaaatctgattattagggtattttcatcttcctttagtaacttacattcattagtttttcaataagtaatttttaaacatttcaggatgtcaacatattgaggaatttcagtgtaggacagtttttgaccttagaacaatatcatccaattgcatttagcatttcatttctagttctgtgacaacaaaattatcttgtatagaggacatggtaaatgatgccctctggataacagaatttaacttcacaataactctgaggggaaaaaaacctcacatttttccttaaattatataaatacttatctataaataatttctgttaaatctataatccaagttgttaatattttaaaacttaaaacctgtttaaaaaattttatgaagatgctacatgttttgtaatatggtagagaacaaccagaagatttaaacttcataggtttaaaattttacaatatgctgttcaaattataaattaagactattaaaaactccaaacttttcattttagtttattattttatctttctccttcagtcagccttatttaggactaacaaggggctaactgattgaattgagtttcttcttttcgtcatttgctggcaggtctctggtggaaatcctaatgggctgcaaactaggcaaacaaatgggccagtaggctggaagtggggaagggacagtggatatggagagtctattgttcatccagtcaactaaatatgttttaattgtagcaacaatgccataagtaggcctgacacagtctattagtttgcctcacttcattcttgtttcagtcactccacttcaaccatcgatgagtctgagatttttattccattcattgacaggagagacttcccttcactcatctgcacttttggaagataaattctcttgaataactcaatggaagttgagtttggagggaaaatactatttttattgcaattaatatcttgtttttaacttcttagtccaagacatctaatctccagtggcttttgttaaactaaacacctctgctgatttctgctttttcgtaggtgattcgcaaggggtggctcaccatcagcaacattggcatcatgaaaggcggctcgaagggatactggttcgtccttactgcggaaagcttgtcctggtataaagatgatgaggtaagtcacagagagtgataaagttttcttgttaaagtatttctcattttaaattaactgatattattatactatgcaattttgagacaccagtggttctctttcagtgagattaagcttggaatgtttgtttaaaaaggcactattattttcttatagattttaaagtttacaatattcgcccaaatttctttttctttttgtttatttctttgctgtaaccatatgtttgcttacctgaagaaatggaggtaggcatcaaagttgaaaacctccttctttataatcatgtcaatgtactggtaaagtgaaaacaattttcgttaaagaaagtgttgaaggacccaaggtaatagaacattttaagagtgaaattaataatattgatgcacagttaataaagcatgttggaattgttcctgtgacatctgtctcaaatgaaaggcttttaagaacgtccacatcgctagtcttcaagtgagtctcagatcattgtttatacaaattttgttctttgagaatttgatatctatgtaaaagcatgaattatggtaattatagtgttctggttcatgttagatgttaataattttggtcctgtgacttactactcatttaaatttgatagctataaaagtgcaaacaaaaaacttatattagtcttacagaaccatttaagtgctagaaatcgataccattaaaatgtgagggagcacagatagaaattaaactatgtcttgaaatttttaatagccctggtctgacctgataatcttttggtacttataatgcggcatgcaaacattagataaggatactctgtgatagcaaaactatgtacaggtgagattctcaatttcatgtggccacgaagggcatgtgttcaaagttaaaagtttttcctatcttggcctgacatcttttgaaagcattaccgggtgcctttgtcattccttggaggaaaagtttcatgtcttatatagcacttttcatttctcaggagatctgtgtgtaatagtgtgttgaaaaatattggataattggttgattgccactaaactttctgcaataagggaaatgaaatcctatagaaatgtatttaaatttttatgtcattgaccatagtcaaaagtagatttggtcactgtgatagtatgagggttagcagtggtttctttcctgtgctggctgcttagctatctctgtcattctgtgggaagctctagttttaacatagtttgaggagctcagagacacttccctagatgtaaaaatcactaaatagatgatcttctttgctgttcagttgtaataaggtatttctattagatatattttccctccaaggatttagatgataatttatgtgcatttaaatacgtgtaaaccttgggacctttctcagttatacaaggccgcagaaaatattttactaaggaatcataacagtgatggctagtgttttatatgtattaattaactcatttaaccatattcagccttaactactactatccctattgttgatgagaaaactaaaaataaaacaaaacctttttttaaaaaagtcttttctacaggactattttccttattgcagaacatttagtcttggcgaggataaccaacttaccaaagtcacacagctagttggtggcaaagcagaaatttgaacccaggctgttgagctccagagcctatgctttcaaccacaaataaaggcaagaatcccagagatgcctggagttgtccaagccaacctcatcccacagaggacttatgaagatgaattccaggcatctcagcattgacatgttcctgggtgttagcagcagagacactgaagactctggagtagctactgctgttggagtgtggcattagtctggctctgtgagtcctgaaaataagcccattggaaggtataggatgctctctgtagggaaggaagaagctttgaaggcttggtgagctcttggttattggctcatctcctctcctccagactcaggataattctttacaaaatcactgcccttgtagcttccttatgagtacttgattacaacaaatggaaaataaatatgcacagttataatatt
